United States Patent 7,868,149 (PLANT GENOME SEQUENCE AND USES THEREOF) - sequence listing, part 37

SEQ ID NO: 19187 - DNA, 4306 bp, Oryza sativa
cacctaatcctccacaccatcagcatcattgtagaactcttcctctgatgaatgattgcaaggcgagtatatgacatactcagcaagccacacagcaaatatgcaagtgcacaggataacaaaggatggcataatagggttccatttgcacaaacagcctttaataaacatttcagaatttaataaaacagttaagtaataattaatcaatattaatccaacgctatacaacataccctgttgcataggcccaaccattctgaacaaccatcccggctgcacagttctatctccaaaccaggaatatatcattccaaaccaggagctaatcaaattattaccaattaaagcaccttttattatgatgagaagtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccatggtacctcggaaaggagctgtgacattacctctcgcacaacacaatccactacagcgcacctttcctggatcataatcacccccttataaacaaggcatggactccccagcgacccctgtgggcttatctccgccacttctcagtctggtgctccgcaatgaaccatgctatacaaaagataaagccgttgcccacgctggcttgtggttggcacggttaatgtttcacaactgaaactcgtgaaccggtccttaattgtcatgagcacgactctcaaaaccatgtgctcacaacccaccattatcaggttttagttggcatgtaattaattaaccaatcacgattgaccatcgtgaactatcattaagccatcattaaataatagtgagtcaaaagttatcccaatagtgtgctaatgtttctaagcatggctaagcagtcatatctaatatctagctaaaccaatatatatagcccaactagtcaagttataataacccaaggtatcaaggaataaagtaatcaagaacaaaagggctataacaaacaataggttaattccacccaatgacattcgaaaatagatgcaatagttgaatagaaacaatagctttaaataggatcaacatgctcaaagggttgtttgggatctgtgtgacttgccttgctggccttggaactcttcaaattcttctcctgcaaaaacggactctccggaaacgtcggaatctaaacagaaaagagcaaaaacaccaaaacagcacataaacaagcatgaacagtacatgtggatatttttaacatgtagatctcaattttagaaaaaattagagacttgaaccaactaaatccgagttaagatgaattagttatgaatttttgaagatttaatcggattaaaacacttatattgattttaattgaattatgacgcaataatgaattgtttttgaaaaggaaaaagggatttattgcgtcagcggctagggtttgcggtggaccgggtgcactgcggcggttcactggaacggacggccgagatcgatccatccaaaatggacggccgagatcgaacggtccacgaccggctcacggcaaacggccacgatgacgtcagcggtgacgtcaccaccggcggcggctcgggcggcgcaagctcgccggcgaacgacggcgcgacgacgagaacagagggcaccaggacgtagagcgcgacgcggcgaactcaccggtgaccaaaggagcggcggaagaccaacggacgacgacggcggcgaggaggaaacggcggagaagatcgggtcgatggcggcgacggtgcttcggcggtcttcggcgacggcgaaagggcggacgaggacggcaacgcgacggcgaccacgacggcggtctttccgagcgatggcgacagctggaacagcggcggcgcacggctggagcgacggcggcgacggcggctcgagggcacacggcgctagggcactacggacgacgagaggcgaaggcgaaggtggcgacgggtagagaagagctccggggtccttttaaaggggctaagaggcgacggtgaaggcccacggcggccggcgacgagaaggaaacttcggggttagaaggaaagaggccgatccgaatcgaactcgattccacgaacttccaaaacgaattagccgatgtttccaaaggagaaaaggtagaggagatcccaaagattgtttcccctcaatcaatttcaccggaaacggaaaggaacggccggatttggaagggaacggcgtcggcgcgaaactagggtttcgggcggcggcggccggaggttgacgacgaccctgacaggtgggccccacctgtcagcgggcgaacgcgcgcgcgcacggcgacagactgggccggctaggccgaagagagagagaagggttttgggccgactttcggcccaaagccaaaagagactttttaaaacctttttcaatttaaattatttcttaaatgcaattccatttattaaaaatacttccttagctcaaataaatcccagaaaaatctaggaattataaaattaagcaaagtatttaatgaaattttatctggccccattttatattggaatttattaattaacattagatcttctcttcaaggcttttaaaaatcatttctaaaaattccaattaaacaacaatttatatattttgaatttttagggtgtgacatctttgatcgtaacatgtgggttttctaaaattagaattatcatccactctagaagataagcttgaaatcccatgcccctgtttggcaacgcttcctggtcaccgatactcttataaaaaccgatgcaactggagggaggctagtgtgtgtgtgagtgcgagctaagcaagcacgcatgcagctcatggatcatttaactctctaccttatcctctcctactccaaccatccacacccttgcgcagccctttgccctttctaacctaactcgatgacacttgttttcctcgccggtaacaccatccactcttgactgcgataggaagcaccactactatcgcccgtctcactttcaccatcaccactactaagtgccacctactattggtgggcctattatctggcaatcgctctaagcctagacctctttgggacatccctctccctcccaccatccctacccctaccttgaaaccttaatccacgagggcttagacaataatgacggtatcggagcgctactgcgtgccccgacaaaccgatttgttcgaacccatgcgcgggtaacgaacgctcgcgaattagcattcctacactgtgtaggaccctgttcagtaacctgcctcatctgccgctgatttctccatgtccatcaacgaagaaagcgatgggaaacgcctcccactcgcacgcgctggcacggcaccatgtgattgactacatatgtaggtcaataattaggccacaaccacaacaaccgccacaaaatacaatgcaaaacctggcattcataattcatacaaaaattattaaaacaagatcgatcgatcgatcgatcaagagttgcatcccaaaataaataatccaccgcaaaagctacaggcgccagcctccaggtagcttcgctatagcccatcaaacaagcaagaaagggggagagaagggaaggagaggtcgtcgtcgccgtcgacgacgattcaccggccatgtgctgctgctgcggcggcggcggcgacggcgacggcgacggctgcaagtgccggccgctggggtggctgctgggtctgcctttcgcgctgctcgccgtcctcgtctccatcgtcggcgccatcatctggatcatcgggtatgtactttgtactcctcactcttgtgagaaatcaagttgcaagaagccaagaactcgattcatcttcttgtgagaaatcacaattcacagcgattgattgatggatttcgtgtgtgtaggctgccgatctcgtgcatctgcccgtgctgcctgtgcgtgacgctggtgctggaggcggcggtggagctcatcaaggcgccgctccatgtcatgacctggttcacctccaagataccatgctagctatagcttcttgatttgttctaccatttgatcagatataaacagaatgatcagtaactgatcagtaagtataccgattatttattatttatttatgcatatgtactctggcttggagatatgattaatttgtcattccaatcgagattcattcggtgaaaaaatatactctgtggtgctggttcatctttgatcccctt

SEQ ID NO: 19188 - DNA, 1788 bp, Oryza sativa
tagtgcaccacattcaacacgatgcaatgcaaggattcgatttccatccatcgattaattaccagctattataattataaatatcttaagtgcgggccctgtatgcatgcatccaaaaatcaattagatttggccaggttgttgttggagctggagtactgtttctgggttataaacaagatggacctaggtcaacccggaaattaaaaacaatcgatcgttcactcaatctggttagccatatatattgattaattgatatatacgttgccccaacactatcatacatgagtctgtaaaatccccacagctggataaaacgcatgcacgtacgtccccacccagggacgaaggtacaatcaattaccggggtcagtagaccccgatgattttattttaacctctcgtatcctctttattttaccagctatgaccccggtgaaaacaaatattagaccccggtgacattaatattgattggtgtgtaaaattccaattgacaactagaaacgatactagcaacagccaatagaaaattacctagcatttatgattatacgtgagccgaatatgcatatactttgagtttttgagatttgagaccatgcataaggccaacggctcgtaacttttcaaattccctagaaaaataatttctataggaaattgttttaaaaaccatattaatctattgtctttcaagttttttataagctaataatgcttaattaatcatatggtaatctcactctattttgcgtgctgggagggaagggttcagatcccgtagctaggtctgaacacacccagattgtatcagggttcaccaattcgatttaaaattagattccaaatatagcaatatggcttttttttaccaaaatttgatgtttttttattaatttggtttaattttacaatttcaaatttgaattcttgaaaaactattctaaatttcactcaaaatctacttttgtcccaagttggaacatcgaaattgcgttgttttcaatccgttttggttgaaaacatagaccctggttagtaatgaccccgacaatcatttatcctggattcgcccctgtccacacctatctttgcaaatttaaaatttttcggggaggggctaaaatattgatctgaaatttcggtgattttgaaccaccccttaaaagaaattattttggcttttcacaattaatattgaacctttggctatgaattggtcgatctatgaagaaacaaacaatgatgaatatacatatatacgacgtgggtgcacgcccatgctgctctatcggtttgcagcgaaactgcatgcatcccgggcctgcggaagtgcagagcatgcagagaaaaaggaagaaatcgaatcgatcgagcaacctgcagctgcatagctgcatcatatcgatcgcgcagggacagggacagggcagcggccacactcgcacaacaggcagctaaccctaacatatactgtagtggggtagcacaaacaccatgcgcacaaggatttgttccaatcgtagcaagcactacttgcgcacaaggggcggcgcggtaattaattagggtatgtttggttcttgcctgatattaccccaactcaatttgtcattagggtggcatatgccacgtaaagttgttggccacagatatgataatgtttagcttaaaaaaaataagtgtatgacatgtagacccatcaagtaagaaagtgtgacttgctacaattgaaataaacaaataattaataaattgcggcggccctcctcaccccccacc

SEQ ID NO: 19189 - DNA, 1046 bp, Oryza sativa
cctctttagattctaactttttttctttaaacttttaactttttcgtcatatcaaactttcctacacacataaacttttctacacacgtaaatttttaatttttccatcacatcgttccaattttttaaaacttttaattttaacgtgaaactaaacacagccatagtgcaatgaatcatgctcattaattcggtgggcaagatatcactacagtgcagtgtatcctacgcagacaggtaactgtcacgagtagaacccagagcccagagcccgtcgccccgtcccactcactaaatcatgcacatacctatttaaaaattgaactctttaaatatctaactaataaataatttattataaactaaattttaattgataaaaataatatcatcggttgttatttacattcagttttactcctatatgattattttgtttgtcaaaaatattatactatgtgagaaatttaaactcgaatattaattttaaaataatactaagtttataacaagttacagtacgttttactgaatacctcttatgttccaaaatagacaaatctcgtccgaagaaggagcgaggatacacatcatcaacgtatcatcatcgtcatcctcatacacccccatgcctatatatgccgacgccaccccgttcgtctacctccccacctcacctcctccattcttcacttccttcgattcctctgcttttaatcggcgctctcctctgctttctacctagctagctactagcattctagttgtcgctcactcatggtggttttggcgaagggggagttggagcagatcgccctgccggcggcggtgcagaaggcggcgccgccgctggccgacgtgccggaggtggacctgggctgcggcgcctgcagggcggacgcggcgcgcgcggtggtggcggcgtgcgagggacacgggttcttcaaggcgacgggccacggcgtgccggcggggctcctggcgcgcgtggaggccgcggcggcggcgttcttctcgatggcgcagccggagaaggaggcggcggc

SEQ ID NO: 19190 - DNA, 5009 bp, Oryza sativa
  unsure (1)..(5009): unsure at all n locations
gtctgtcatttgtaccggtcactgccagtgggccccgttgaagcagtggctttttaaaatatttctggaattaaaatcgaccggaaatggtgtgcttatgttgtttttttttggtagcaaattgtgtgcttttcttttcgtttacctgtatatttttttaaaaaaaaccttaaaaaattctgtgaaagaaacgtgtgcaaaaccataggagcggcaggttgatcagcacacggttttataaagtttccaatagctgagtaggaaaaagcgatcaacttttagctaaataattttattttatttttcattatagagaattcttcaatgttaatttctgaagattaattcaagtaatgaaactaccaacctattttttcattcgacaatctttattcatggttgtatatgtggtggtggtcggactctaatttggtaatgacattttagtcatgcaagttttacaatcttatcttatctcatatagtgaaagcaacaaacctttttttacgaggatgtgccacattatcaaaaatatattagtcatcggataaatagttcggataataatagtcattagatcaaaagagtgtatgtattaaaaaaatatattgtcctagccaagtatggatactttgtgaacaaattaacttatatcaaaaccttattaagagctaaagtaaactaataggccatatataaaagttcttaaacagtataaaaagttgtgcagagtgcgactaacggaaaaaaactaagatcaattttgtttagccatgtgatgcatatgcgtaagtaatattcgtggttagatcagatgaggccataaccatgggttacagtgggcagaaaagatgagatacaaatagcacgtgatgaattttgaagcaagagtagagaatctatgaaatttcgctaaactcaccccaccacatggacccttctaccatttttcccatctctctacagatatactagattctgccctagattattgccatctttctctttctttctttctttctttctttctttctttctttctttctttcttttcttctttttttttttgaggttagtttgcctatctgtttctcactattgatgaaactgagcccatgtatgagtagatttcagcttttgaaagcactgatataatgcattttgattctctcatgcaagcatgcatgcccctcatcacatgaccacacatcagcaggttccctctgcttcctgcagcaaccctacgtgtcacctggcatcacttttgcacaatgcttgcttagtcactgttttctgaaaagagcaagttctgatactgaggagacacttactatcaataattattgaaagagaagaaaaatagtgagaaaacctgggttgcttagtcactgttctcaccccattcctcaatttctcttttagatctatttgagaagcttaaagattttaacaagcacttataagtagatagctagcgaaaatttagaaaagcttgttttcttagcttatactatatactcttggaatataaatgagaatctagaccgtttaggggagcgacaatttgagcctcctttttattggaaaaagaacttataaaaacatttttaacataaaagtttgagctggccgaccagtttgcttactcatgttttcagagctcaaaattgtgtcatgtgtggtttgtgcccataaaagagtaattttttagttggtgcacgtgtggttaccgctgtggtaatatggcctacttcaagctggcctcaattaatgccttcccttttcctttgtgatgtcttcgtcgcatcaagtccctttccagaaactctcctgctcagcatgccagcatggcaaataaaattggacccacagtgacatctcatgccactggtttgatttcatcacccccccaattattgtgagcccaaaaaagtgatgcataaagtaatatatcgattttcatagtattatgattttgaaaccatattactattatttttcataaatgttatatttgagtactcccaacgtcaagaaagagtataattttaggagtatataacgttgttcggtaaattgagacaataatatctatatataccatgaagcaactttgatgtttaaatgttaaaaatcattttttttgcccattgtgtgcattgcagcgatatcttaaatgagtacgttgtggcggtgagagcgatgatgtgggaggtgctaaagttaatggcggaagggctaggcctgaaggagaaagatgcgttggttaggctggtctcacacgaggagagtgactccgtgctgagggtgaaccactacccaccacaccctgagttgaagcagcaaggccatggtaggttaaccgggtttggagagcacaccgaccctcagatcatctcggtgctccgatccaacgacacctctggccttgagatctctttgcgtgatggtagctgggcttctgtgcctccggatcgaaagtcgttcttcgttaatgttggagatgtcttacaggtagttactgctccctctgttttaaatacatgatttttagacattaattttgagcattcgtcttatctaaaatttttgtataatatgtttgaaaatataagttatgcttaaagtatatttaatcatggatcaagttaaaaataaatattatataacctttttaataagaggaatggttaaatgtcacgtcgaaaaattaatagcttcatatatattgcggaaattaaattaacacgctgaacttaacaaggcctagcacctattaattagttttttttcactgaaaataagttcactcgtatatcaaacttttccttttccttttcttttttctgaaaatggtttaggctaattagctgtaaggctcaggagacggcgatgttgaatctgacgtgtgatcataaaaacgaaagaagaaaaatcgtgtggatgtcaaagtccatcccaatcagccaaccttttggggaaccaagctgccagtcggtgtgttgtcaaacaggcaaaaccatcagtcattattcagaatcatttcataataaaagtccaatgtaaagcacacggctatatatacagtgatctgaaaacacggtagtacaatgatcaattgatcatggcaaccgtgcaatgcggtcccttagattagattcaatggttaggtccacgctttgccgacttcctctgtagccaggtggtagaattaaattagaggaactgcaaggttttcttcatgccgtgtcgctccgctccagggcaacacgggaggcgacccgaagccgccccgccgccggccttctctccctcgcctcccccacctcgccgccgcctgagcagccgccggcaaagccggacggcggcaaggacggcggcggcggggccttctaccccctccaacaccctgcggttggggccccgacgggaaacaggcggaggggcggcgacgcgtcgaggcggctccggcgacgccgacggccagaggcagcagagccagcgtcgctgttagcggatctggccccctcgcagccagatcgggacgaagtggcgccggccgcgctgcatcaggacgaggcgctggctggggcagtcgtggcgccggcggagaaggccgctggatggggcagtcgcggcgcgggcggaggcgacgtcgctgccggcggggacgaggcagcgagcctgggcgccgctggatctggctctcccaggccggatccaacgcccgcagctgggccacgaaggaggccggctccggggcggcggcggcggcgatgacgacgagacggcggaggcggcgctgacggcgggagaggcatgggcctggctacgcacagcgcctccggctatggctccccctatttcgacaccggctcccccagtccggatttggcctctctggcgagggaggccggatcccctccggtggctcctcagctgtggacgacgcgacaagggcagcggtcagagggcagcaggaggcgtgggtgtccgcggcaggagggcgagtgctgcggctggtctggcgatctgccagagctgtgggtgatggcctaggactgattgctaaagggacgatgcagccgaccggcgacgatcattcttgcgcgaattgggtgtgtgggtttggacgggaaatcgctggcgaaagcctcgccgtgccattggccggctgacgacggcggcgcctttggcgtcgttcccctccttggaggcgtcgttctggcgttgatccctctcctttccctaccgttctccgagtgaaaacctggctccggcttccggacgagcggtgacggagatccacgtcgtgtcctccttggaggcaccgctttggagaaacattttcgtgcaaggatgtagttaatggtctatgcattggcttcgaagcttttcagtacttggttttgatgaggccttcgctgtctagtcccactttttgttttgcggcgggcaatcttcgctccttgcttgtgtttgctaggtgaagtcggagctgcttcgtagggtgacgaagctgggcaacgatgacacgttgcattctctttctaggggttttgtttgttggccgtgaataggatgtggcgtttagacggctttggctgaagttcttcgtgggaagttgaagccacttgaccattgacagcgagttaggtatggatgatgcaaccgatttgaagtcggagctgctgtgtcgctaggcggcaagctcggcaacaatgacacggttgcaaggtcggaacccctttgccgtcttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19191 - DNA, 649 bp, Oryza sativa
gaaaggggtgaaaaaatcgaatatctcaatcgatcagttggtgagtagggccgggcgccgttgctgacttgccgtgatacagaaatattcctgctttacttttttccgaagggaaagaaagccaagaatcaaatggccaaatgaaccagcttgctataacaccctatatctcgtttgaagcctataattgttatggtgttggcccatatatataatgcagttgtcatgcaatggtggtgatttagtacaacattggaaatttaagaggatgatcagggtctctgcttataaatcaaaggatgattatatgataatctaaagcgttaagtcaccattcaaaaatgattatatgaccactactagaaaaacgatttttcatggcgttggtctatgattttcgctggcagaaaaatgccaaaaccacaagcaaggtcgtaatgagggaggtggggggcaccgaccgccagcgaaaatagatcttcgctggcagccacgttataccagccgccagcaaagatatgttcattttcactggcggtcacttaggtgcgccaccaactaaaatagatcatttttgctggcgcttgggttatatagtcccgtagggaagatacaattatttttggtgacggcccacttaagtaaccgc

SEQ ID NO: 19192 - DNA, 1307 bp, Oryza sativa
agaagcaatgaaaggggtcaagcatcttcttgttcgaaaaactattccaaatgggctggtcttcgttggggagctcccctatggacgaaatagtggttttagccctaaaatggatcacctggtatgcaactacttggaactctctctatttcttttataactaaaaataataattcgataatccttcaaatcttttctttttcccgggcattttttgaccccttttgtgatgtgcaccactttgtcttcattctgtaggtgtgttttcttcctggtacccttgctctgggtgcaacgaagggtataaccaagaaaaaagctcttgaaaatcatttattgactgcggaagacatagacaatctgcagcttgctgaagatttggccaaaacttgtgttgaaatgtactttgtgacatctactggacttgctcctgaaattgcttattttcacattgaggtaagtggttcagcattttatggagtattacaatgtactcctgaattaaatctccattacttgttatttttcatatatattgatgtccattttgattttgaagaaaatattggcatgtgcattttacagggtaattctgagggaggacctgatggtgggaacaaaagttctcaatatgttaatgatatcataatcaaacctctggatcgtcacaatcttttacgcccagagactgtagaatcactatttgttttatatagaatcacagaggatccgaagtaagatataacactactttattatctttaggtcacctgccactcaattttgaataatgttatgggttagggttcatagggggtaaacaccgccgggaggatagccaggcaataatgccaccactgactatccttttattatctccttttcttttacacaggtatagggaatggggttggcagatttttcaggcttttgagaagtatacaagagttgattctggtggctatacttcattggatgatgtcacaagcttgcccccacctaggagagacaaaatggaaactttcttccttggagaaacactgaaatacttgtatttgctgtttggtgaaagcaatattcttccattagataagtatgtattcaacacagaggcccatccacttccaatcattcagtctgcacaacagatctctcattcggtatagtttccaagtgttttagtgggtgtagttcctctactatcatgtgaaaagtgtactaccatgagaaaattttaccaaacagataaagtgagaaaatagttacgcagacaaaattattggacaatgagagaaacatactagcct

SEQ ID NO: 19193 - DNA, 2535 bp, Oryza sativa
aggtgactatgattggcaaatttcctcatgacattagagactaatattgcacgatgataatagtaataaatatcatgctatgatgatatcaaatgaagaaaatattagttgatcggttgatgcgctgtctttgttgttttgtggaataaatttcctgcagattgtcatgcaatcagacatgctcattcttgaatattgaagctacttagtttctatttccgtttgtcgtgctccagatttatgaataaaatatgccgaatgccgtattgttactcgtgatttggaagaaattatctgattctgtttatgaagccatctttgtccaaacatctttttttctgtcgcgggaacagtgaaactagccttagagcataagcaatgggtgtcttggagccgttcccctagctcacggcgtcgccgtaccgtttgcttttcggcctgagccgtccccccgcgtaggcgcgcgtttgctcgcggggggatgcgttcctcagtcgcttttggctgagccacggcgccaggctacgcgttggacgcgcggtggctagacgtgtgtctcgtggacacagctccgcaccacaaatttcctcttccaccctcaacagcgacgacgacaaccctgcgacggagacgaccccgcgacgacggcgaccatggccgacagcggcggatctcgctccgccgcgtcctcctcgctccgcgcgccgtcgatgccgccaccgctgttgtgtttgccgtcgtcgcccttgccgtgcgttgtggaggtcgcgatgacctcgagcactccagatctggcctcgagctcgactgggcggcgtcctcgatgcggccaccgccggcgctgccaccttctcctcctcgatgcggcatgggaggagggacgccaccgtgcgccactcgggggcgcagccgtcctcagcgtcggtgtgggagacggcgacggcccggagctcctactcccccgcggtggccgcgttgacgacgaggaactcgaggttgacgccagcggaggagacgggaagaggagaggaagagacggcggcttgaggcggtggccggggatgacgaggaggaggaggagcagctctgctcgacggcatggaggctgggcgtgccgtgcgcgtcctccccggatgtagcggcatggcgaggaggaggagcagctctgctcgggcatgaacggcattgtttatctcaaggtgaaaagagagagagcgagcaagctagctctatttctctgtgtgtgtgagagagagagctactagactagtacgatgaataaattccccctgtactagtttgtgtgagctactagtggttcttttgagaagagttattggttttggtttctagggccaaaccaaagaataaatgcccccaaactaaaagctacacaaacacaatgaaaatatggagcctcttgaataaaacttcatgtcaacgagggcgtcggtggtgggctagggagggaatttgtcacctgggactacttgagaccgggatacccattgtgaactggagtatcctcaccgagtagctttggattttgaagaacccacctacctgtggcctctattgcgagatgagttttcctagaagtgccctcgcttagtgagggcactctaggagtggcttacattgctgatgcccttacatttcttacatgctttcaaatcatgaccgaccatcatgtattctgtcggtgcttctaaattatttaatttgtctccatggaaaattgtaaacttctctttgacttcgaaatgaactgcctttggaggtatttctatttccagtttttagtgccacccagggcttcccaggctaccatgcttttgcattaccacctaaggtggtccaagactcccaacacgcagcaagctggatccaggtgatgcaggatgggcgaccaacaatgtggctgggctgattatgcctacatttcgtgctgcaagatttttgttgtgctttttttccctcatactagtaatttactacttcctccatttcacaataagtcattctatcatttttcatattcatattgatgctaatgaatctagataaatatatgtctagataaatatatatgtctagattcattagcatcaatatgaatgtgaaaaatgctagaattacttacattattcaactttggctacgcgttcttcgtctcagcgggcccacaggtgggacccacaccgccgctagatgagagaggggagaggggagagggacgaggcagccgagcggcaggggaggatggcgctgaccgacgccgacgcctgccgacgcgcagccactcctcgccggatcctgccgcctaccaaggtcgcgccgatttccttgagcgcgcgaaggctgaaggaggaagggggcggcgcggaggccggacgccgcttgccgcttgggaggatgccgtgccgaccgagctcccgcgccgccgccggctctccgtgccctcgatgctcatcgtcggctgggagatgaggggccccggagagggacgggaaggggagcgccggcgtggatttg

SEQ ID NO: 19194 - DNA, 1814 bp, Oryza sativa
aatgatactgttcagcactcacctcctgttttgcagccacaagatgaacctattgcacatcgcagaacaaagaggagttgtggagctccagtccgccttattgaggaatgtgatatggtttattatgcttttatttgtgctgaacaggtggagaatactcttgagctagccacatacactgaagttgttgtttctggagaccgtgagaagtggatctcagctatgcaggaggagatgcagtctcttgagaagaatgacacatgggagcttgtgcacttgccaaaacagaagaagcctgttcattgtaaatagatcttcaagagaaaggagggtttatctcctagcgaccctccgaggtttaaggcaagtttagtagcaaaaggttttagtcaaattgctggtgttgattataatgatgtgttctctctagttgtaaagcatagttcaattcgcacattcttcagtattgttgctatgcatgatcttgagcttgagcagttagatgtgaagacagcatttttacatggagagcttgaggaggagatatacatggaccagccagaagggttcatagtgcctggtaaggaggattatgtttgcaagttgaaaagatctttgtatggtttgaaacagtctcctcgtcaatggtataaaaggtttgattcatttatgttgtcacatggcttcaagagatctgaatttgatagctgtgtgtatattaaatttgttaatgtgtcacctatatacttgctgttatatgttgatgatatgctgattgctgccaagagcaaggaacaaatcactacattgaagaaacagttgagtagtgagtttgatatgaaggatcttgatgctgctaagaaaattctaggtatggaaatcactagagacagaaattccggttggttatttcttagtcagcaaagctacattaagaaggttcttcagcgttttaacatgcatgatacaaagcctgttagtactcatattgcacctcattttaaattatcagctttacaatgtgctagtactgatgaggatgtagaatacatgtctagagttccatattctagtgttgttggttctttgatgtatgccatggtttgctcccgtctagatttatctcatgctatgagtttggttagtagatacatggctaatcctggtaaagaacactggaaagctattcagtggattttcaggtacctcagagacacagctaatgcttgcttgaagtttggcaggactaataaggggcttattggatatgtggattctgattttgctgcagatttagataagagaaggtcactcacaggttatgtgtttaccattggtagttgtgctgtgagttggaaggcaacattgcggcatgttgttgcccagtctaccactgaagcagaatacatggctattgctgaagcatgtaaagaatcagtttggttgaaaggattgtttgctgagctttgtggagtttattcttgcattaacttgttttgtgacagtcaaagtgctatatgccttactaaagatcagatgtttcatgagaggacaaagcacattgatatcaagtaccattatgttcgcgatgtagtcgcgcaaggtaagctgaaggtatgcaagataagtactcatgataatcctgttgatatgatgacaaagcatgttcctgttgctaagtttgagctttgctcaagcttagttggtatagtggtttagcccaagaggctatttggcgccgaaagtgtttttgtctttgttgtgttcagggtaaaggatggatcgtgcacctggggacgcccgggggggtgccg

SEQ ID NO: 19195 - DNA, 4325 bp, Oryza sativa
tttttctctcctgttaacggaggggtttccacgttaaatctcgtgtcttctgtgattgatctattgttctttatcgcttgttcgcttatcgtttcctaacaactagaaggagaaacaaacctggcaatccatgaatatgacatcatagggcaatggcacattatgctctcctgaaacacttactctctcaatagcatctttgaatatatccacagccttagctccatcccctgccaattcaattgttgctcctagttggttcaacacttttctctgaatagtgtgcgctccgcctggcggagtgcgcacttctgcttgacgaggttggcgtcgagcgccgcctcccacgccaccgccagccgcagcgcccgcgtcagccaccgccagcgtcccagccgccgccgctgccgccgccaccgtggagcacaccaagatgattgtggtgacgccgcctgcctctcgccggagcacgtccgccatggcgctcttgtgaaaaccggcgggaatttatggtgtcaactccaccagctagctggtccaattcacggccgtcggccgctgccggtgacggcggcgatatagaggagcgtatactgtttgaaacttagaaggtaacatggtggagtggagagagggggaatgaattacagagtgattgatgggcttagcttaacaagtaaaatgggaaggaaaaggtatactttgactcgctcaagtatcgcccgagtaagattcatatcctccaaccacaaaaccgggttcatcgactcctccaactatcaaaactggtgcaaacaatgtccctcgatggttttggaggtggttttggctgaggtggcagtcttgaccaagtctttgtcctacgtggcgcttacgtgtcaatagaatgaaaacaaaaataaaaaaatatgtgagacccatatgttattcacacaaaaaaaagtattgtgggaaagtatactttttcccaaaccctactcggtcggggaagccaccaatgaccagcccaccactcgccttggcgcaccgtcgcctccgcagcagcagccagagatggagatggaggacatcgaggatgtgctggggccatctaggctcaccggcggcggggcgcctccgggactccgtctcccactcaccgttgtcgccatgaagcccaagcatctgagatcatctagggtcacgcagacccggccgcagcccgaggcctggatcctcaggatgcaggtgaaaccgccgccatagctcgagctccgatgagggcagcgcaggagaggaggcggacgaggaggcagttggcgcggagggagtggggggtcgatgacgacagcgacgagaaggcgacccagtagaagaaggtggctcacgttcctggcgacgagctccaaggaggaggccgtggcgaggccaaagaggtttccgccaccgccaccgctgctatcgccgccgcgccgcgcaagcacgcagccgctccccgctgccgccaccgccgctccccaccgccgtcgccgcgccgcgcgagcacacggccgctccccgtcgctgccaccgccactccccaccggagcacgctccacctcaacccctttgtcgccgatttgtgagctaccctgttgtcgcccccatcactgccatgttgcctctcctcaacctccgcgcaccggccaccctgctgcatccctgccatcaccctactgccaataagaggagttatgttggagagaaaggaaggagagggtatgatacatgggccccactctatttctatgattaatagattgtcacgtcaaatatcacctagtcattttgtgtcggtttcaatagttagaggaatcattataccttgttttatgattgaattgaaggatacgaataagatccaacctaatgttttgaaggagtcaaagtgaactttctcctccattctgtttccatgactcttttagcatgggctatttcctagcccatgccagaaatggactaccagtaataatttattagttaacttagccttctccataacgttaaattttagaccgaactagttatatgcccgtaggttgtaatgggattgggtgataaaaatattgttttagtttatttctatgccggtttttttacggttgtttggttctatgcggttttcttagagaaagatgggaggcagtggctttgttaggaggaaggagggatttactatagattcaggaaattttgaaaaagaaaactaacaatagtgttatagtggctcctttcgaccaaattctttttagcatttctggctctactactacaaaagggttacaaaatttggcccgtaaagttccgactagaggggccggaattgcagttgcaaggccacgcaaacgaaagcccctcaggacctcattgagagccagcccataacaacttgtgaaactaaaatggaaaagcccttgtttgagcttcattattcacttggatcagtttgattcgatccccaactaaatacatcatcaggcttaaaatcaccctctccaaatcacaaccaaactctaattaagtaaaccccatgaacaaatattaattaacccacacacaaatacaaacacacacttcggcctaattaagcaaacagtgcacaattaattgggtcacatctcatctctctgcagatattatacatgtaggattaataaatcagtggaggatgggagggttgcagtaggggcccttgagccagccatcggcgatggagcggtaggcggcctcggtaaggtggatgccgtcccagatgaggtagttggccgggtcggcgcaggcgctggacccggacatgccgcaccgcgctttgttgttgtagttgtacgtcccctgccctcccgccccgcagcacaccttcagcccgtatttcagccctgccatattatattaacaaggtgagcaaccaatatcactctccaaataaatatattgatcggtggataccggagatgtaaacaatttttcacttatcttagaaattgatgtcatatatacgtgtttcggatgtttcactagaaatagttttacaatggcagaaatatgtagtgtcagatttttgcattatttatttggctgtgtatatctagtttagatgtagaggctcggttttaaatctatctttgataaaataatatttctatgtttcaaatagtgccgttgttttttttttttgtcgttttttcggtttgctttgtaatgtgtgctctgttcttttgcagtggtgcaagcagagcaaggctgagagggtttgaactttcaagatcatgcaaagatatgaacatgttcctttgttttgttttaatttgtggccatgagcttttggccaaagggtatctttgttttcaattggacgatgtcgcatgcaaagaagagctagctagctgtgatacatgcatgcatgctttagcactagtattacataaatcatgccagttgttattatttcataatactccctccatttcaaaatatttgacaccgttgactttttaatacgtgtttaaccattcgtcttatttaaataattatttattcttttcatatcatttgattcattgttaaatatactttcatgtacacatatagttttacatatttcacaaatttttttaataagacgaacggtcaaacacgtgctaaaaagtcaacggtgtcaaacattttaaaacggagggagtatttgatatagtatgatagatgccattccaattggattacaaggtatcaattcctaaattatactgtactagctagtatatggacagaggtcatgaatggtccacacagggaaggcacaaatcatttgccacactaacaggacaagtgagctaagaatccaacaagtaattggactatttggagatgtaaagcttgttgttatgcacgtacagtgtattaatttatacttatctctaacaacctttggatatatcctttacctagatctgacgtgtgggccatgtacccctagctaacctacactaaacatgccgtgaccactgaaaacttcaactctgtcacggcaactggattctgggacgcttttgatttttagcacataaaagggtgatgtgtgctaccggacaacgatggtgccttgcagctctgggcagtaatgttcagggctgatctgtaactactatacaaaatacaatttataggctgatctaaatattatgcttcctagttgctacgaaatacctcgtaaaattttataaaacgggtatctcctatcaaccataacaaggctggattaaattccattttgccaaaaaaaaaaaaatcaagcctaacagaaaaaa

SEQ ID NO: 19196 - DNA, 1655 bp, Oryza sativa
gtgagttgatcaggtggagagcgtgaaatgatcaggttagttggttagttacctcgaggccacggatgatcttgctgacgacctgtggcacgtagtccctgacctccgtcatggcgcggccggcgaagagcggcgcgttgtagtcgttgccgccgaactcgcccaccacgaacagcgacttggacaggtagctcctgcaatctacacacacccgtgatccgatcgatccatcaattcgtccgttaattaattaattaattaattactccacatgcacatatatactggtagttgttggtgagacgactaatcaatgaattggatcattaattacagtggtagttactgtggtaaataataagatgttgaataattagttagttaccgttgccgcagacgaaggggaggagctgacggaaccactggatctgggtgtcgagggggccattgttccaaatcttgtcgctgaggccgatggacttgaagaaggcggcgtccatggaggtggcgccgatgatcgccatgttcgcccccttcttgaagtcgccgccgcccttcgacgccggcggcagcggcagcccaaagtgctcagctgcatatatgcatgaaattcacatgtcattttctccactactagctcgatcgatcgatcgatcaggacgtcgtcctaccgaggaagtcgacgacgacgcggccgtcggagcagcggccggtggggcggccgaagaaggtcttgccgtaggggggctggccggtggtgagccacgacgggcagccgccgacgcagaggttgccggtgtcggagatggagtcgccgaagctgtagatagcattgtaccgctgcgccgccgccgcgtgcgcgaacaccaccaccaccatcgccgccgccagcagcagcagcgccgccattatcacgaacgtgtaaagctagcgtcgtcgcgaagaccgggagagggagactacgtgagatagctaggacgatggataggtagctcgtgtgggttgatgcgattttataggcttagcgctagttcgtctcgtctcggcagccgtcggttggtgggtcgctgtcgcggcgggctactgcgtttccatattcttctttgcttcactgatcaccactgcaaccacgacgtcgtcctctgcacactcacgtaagcgtgattctttatcgtcataaagctacggcagtaacatacagctttttctgttgagttttcggtgtttgtttattttctgttccttttgttttggatgtgatggatactgttattgttgttttcttttctgttccttttgttttcgatatgatgcatgggtgctgctgctttgcaaattacaatgcattcatcattgctaaaaacctatatatagactctagctatattttcactccagacttcgctcctagagtaaatttaagagttagaaccctatcccatacatgtccgtagtcacagatgttagtgatatgccctagaggcaatcatagagatgattatatcacacactatgtttacatatttatccgactttgctccttaaaatagataaactaattattggttaatgaatgtgtgattcttttataagactctttatgttatgtgttgctatttctaaaggatccctgatcaaatatcatatgtgcaaca

SEQ ID NO: 19197 - DNA, 558 bp, Oryza sativa
agctcaatagcagactattgacatacaaaatgcacgtacatactactgacgtacaaaatcatccgcactagctaccttggttattgggccaagaggctaagaatggacgggtaagcgtagacgccgttgagccagccgccggcgacgtacttgtatgcggcctcggtgagatggatgccgtcccagttgacgtaagccgacgggtcgccgcaggttgacgcgcccggtgagccgcatgccgctccagggttgtagttgtacggcccgcccccgccgcagcaagctttcagtggttgctgcgtgaaacctgcaagggcaagtcagataagttacctttttcttttttctaagataatgggatttttttttcaaaaaaaaaaaaataatacaagagcacttaagactagtattattagatatgaagtgtaatgacatattacattgttacgttgctatacatatggagtgtattgacatgggacgagagatatgtaaattttatatcgtcggacaaaaaaattttggcaagtatgtttgaaacaagttagtccctccgat

SEQ ID NO: 19198 - DNA, 1494 bp, Oryza sativa
ggttcattagtggacataattagtaccaccttgtaagtagtaaaccatgtgccctactatataacaatcccctaagcagcactgcttttagttgtcccctcctcatttgcttcttcttcttcttcctcctctttgtttcacacttgtggtttgtggttgccaactttgtgagcgaccatggagatgaggagggtggcggtgctggggttggtgtggctggcggcggcggcgacggtggccatggcggatccgctgccgtcgtactacaacgcgatattcagcttcggcgactccttctccgacacgggcaacttcgtcatcatcaactccggcaagctccccaacatgcccaagttccctccgccgtacgcccgctgctccaacggccgcctcgtcatcgacttcctcggtacgtcgccggtttaccggccatgatcatcatcatcatcatcatctcctcgatcgaatgcgagtggtttgattcggttggatttgcagctgaggcgttcgggctgccgctgctgccgccgtcggcgaacaagggcaccaacttcagccagggcgccaacttcgccgtcatgggcgccaccgccctcgacctcaaatacttcaaggacaacaatgtctggagcatacctcctttcaacacctccatgaacgtccagctccagtggttcgacgaggtcaagcaaaccatttgttcctcccctaaaggtccgtccatttcaaattttccgaatggcattggcatcggcgccggcgatctaattgaattcaagaacatgtaaataaatacagagagcagggagttcttctccaaggcgctgttcgtgttcggcgagttcggaggcaacgactacagcttcgcgtggaaggcggagtggagcctggagaaggtgaagacgatggtgcccagcgtggtggcctccatggcggggggcatcgagcgggtgctcgacgagggcgcgcgccacgtcgtcgtgccggggaacctccccgccggctgcatcccgatcacgctcaccatgtacgccaccgaggaccgcagcgagtacgacccccgcaccggctgcctcaagaagtacaacagcgtcgcgctctaccacaacgccatgctccgcatcgccctcgaccagctccagcgccgccaccccgactcccgcatcgtctatgccgactactacaccccctacatccagtttgcccgcacccctcacctctacggtaagtctatcttaacttctggctatgtatctggacatatctacgttcttttttttttcttttgccgtgcaactctgctttcctctgcaatgcgatgttcaagacagaaatggtagtttgagggttggtcagtatggggccgggggaccatgccaggcagcattgcaatacagcaagagctagcactggatgatggttgggggtactgtgtgtgcagggcggccagccactgacactaacctgacggttacatctcacaaaaccgtaccc

SEQ ID NO: 19199 - DNA, 9081 bp, Oryza sativa
gagagagagagagagagagagagagctaacgtgcattccatttgttgttggtgtatattggcataagtaaatcgattagatttttaaatttcttttttgttttattttgttttttaaaaaattgggcggttttggtgccatgtaatactgcctactacttggtcataaattaatggtggatggatgaactgtttggtgtaaagcttggcagattggagtagtttattgtcagaaaagggaaaaaaaacagaattgcttgtgatgatcatgatcatgttttataccttacgtttgagtgggagtagcatccaaactccaaaagagaagaaatcatcaccgatcagctcgaaaggcactacacgcatcacatatttggcttgtttataactgaacataggtaggacggtgagggccggagagataggaaaataataaacatggaaactcaggttacccgctttattgattacacttgacactttcctctcatgagcttagtgacaaagcacacacacatgctttggtagtttgattgcaattacctcaactaaagatcatatgcaattatgtattgcacaattttcttttttgccacaaattgacgagcaaaagcaataagcaaacccatatgtggttagaggagaggaccagagtgctgtagttgcagaaaaccaacaagctggctggcagaggccgcaaaagcacttttggcgaaaggcctaatgacttcttccactgcaagctacccagcatcattgtcgccttttggcatcgaatgcgatgaatcgtgcataagaaaaccgatcgatccccaacgggatccatcctccatgactcgtttctcttccaagcggtacatcttccctgttgtcaccaatgagggcttttgttttgcgccctgttttccaaagtttttttttctaacttccaacttttccatcacatcaaaactttcctacacacaatcttccaacttttccatcacatcgttccaatttcaaccaaacttccaattttaggtgaaataaacacagccttggtcaaaccaaaccaaaaaaaaaaaatcctactcatggccggtttcgatgtgttgattgatgatagctaaaattgaatttatggcagttgttaatgggcataaacgaataaattgaccatttgaaaattgaacaaaaatgttaacaaaagttatttccagaaaatgttgataaaataagattatgtagaaatcacatcatttgaaagattgaaaatcatgtccatgataatctatcatcttaagtactccctccgtttcaggttataagacgttttgactttggtcaaactgatttaagtttgaccacgtttatagacaaaagtaataacatttttaacccaagacaagtttattatgaaaatatattcaattattaatttatctagtaaggtagcccgcgcatacgcgcgggcatgttgtttaatcttgtgtgaacttttattacaaatgtttatgtgtgcatgatatttttgaaatattttttgactctattttaaacgtatgctcgttaatacctggtttcggcgtattacttgaaattgtatatcttcaaatttattagaaaaaaatatgtcaccataacgaagttagttcatatctatttgtattatgtgtgattcttttttaaaaatttttggagtttccaaactttatataacattttttattttatacgccatagactactttaagtagcattttaattttattatatattactgaaatatattgtctattaaaaatatagctagtgatactacttcatctaattaaagatgacttatattacttatattccctctgtcacataaatcgaaggagttgaattttatcccaaaacaatagaaaaatttatatgtaaccgggacaaagtgattttttttaaaataacaccacattaatctccaaagtaacgtatcatattttggcaaatatctataatatctatagtgtagtgcatgttagttcagtgtccagattggcttcaacacctattgtttctaatcatatgagacgccattggtaatttggagaatacatatgtacatttaaatcagcgttgtgtattcctcaagtgttctttacacctaaaatatgatgtgaaattattatcataacattaattattacatgtcggctccatatttgtgatgtattttgggctatagatatttagtagtttatttatttaaaggaatacaaccggatcacaaattggatatataattttaaaataatttaaaagataaaacgcttaaaagcattgattgggtatttcatatttacatttgcgtaaatttgaagattataatattttatccttaaattgtagaaaattcttttttaaggactgccattttttggctttatcataagtatattttctgttcttccagcaaatgatatgtaagcaatattgttcttttcaatcatatctatatacggagtactttttctggtcaacagttacatatttctcatgtatccgtatataggagaaatgtattattttttaaacaataaatctaatctaatggtgtaaaatgaaacaactaaattgtgttgttttcatttatgcaaatgtagatttaaattagcgttgtgtattcgtcgagacactctagaatatgatgtaaaataaaaaattatcatagcattaaatattatatatatcagcctcgtatgttaagatagaacgaataaaaatcattgatgggatatttcatatttataatataaatttagtttaactacgtatatttatgcaaatttgtagagtaatatatttatctttaaatagtagataatactattcataagaccatcgatcctttccgaatgatacacatttttttgttttattgtttgtataggaaggattttgaaaatagtatttcaatagaccaccgtgcatagatttttctttgttccgatggacagtaggtaagcttcatttctttttttcaagtcgtatgtacgtacggactacttatgtattttttagcttaacagttatataggtctcccgtatacctacatggggtattagtttttaaaataaaatacatctaatataatggtctaaaatattagattcaccaatttaaatgaaaatcgatggtgacatttacttaaatttatattgaggaatagattttatctttaaatagtagaaaggataatcaattttttaatggtcctacgtatgttttgttcgctttattgttttttatagtactaagtctgtgcgtaatttttttctttcgataaacagtaggtaagattcattgttttttagtcttacgaatgaacatacttgtgtttttgttttctttttccggtgaacaataagataaacggtaataagattcattgttttttaagtctcacgtacgtacatacctacggagtacttgtgtgtttttttttctttttccggtgaacaggaaggtattagtttcctcttaaataaaatacatctaatctaatctaatgggctaaattatcaggtccaccgatttaagtgaaaattgacggtgagattaggtattgccacgtggcggtatatgagcgtttgcagaagtgtcatgtggtggcttgagagcgtttataggaagtttaatagacttttagtatataatagatagatagatgacactaatttagtattataaatattaatatttttatctataaatttagtcaaacttaaaacagtttgactttgatcaaaatcaaaacaccgtctcaatccatatttatggatacataggccccattctttttttattaatttacagatttcacctcggtttctgtttacacgttttccaaacaaccgttgaatggtatatttcgttcgaaaactgctgatacagaagatgttttaaaatatcagataaattcatttttaggtttgaagtaattaaaacttttgatacagaggtggctaatagcttttcctattttgtgtgtacgtactaaatctttgtgtcatcggcaggtccaaacggggccatattcttgcttacgaaagcaagcaagcagcgtgcggttttccggccgagcggcaaggggatagccatgaaaaagaagaggagattgagttgagttggagctaggcgcccgagcttttagctatctgcctagctttgtttgtgctttgcttgattgccgcgcgcaggaggaggtagaggtagtagaagccgccagcgcgcgcgcgcgcgggggcgcatgtgcgcgcgtcgcgtcgcgtcgcgcgtcgctcggggacaaatcacgtggacggggtggggcgggcggctgcgacgtcgtgcgcggcgcggcgtggcgtggcgcggaggcttcgcgccgttcgttcgcggtctctgagttaaatgtgcgggtcgcggcacatcagatgctgcctgctctgctcgccgccgcccacacacaccggccgtcacggtgttgtccctcccagctcccagatgtggcctgaaatctgaacgtttgaatgtcttaatcgctcgaaacgagtaaataataaatgcgtgaacattcaattgtgggattttctaagggtagagattttctaagggagtatggcatggtttagttcccaactttttcttcaaactttcaactttttcatcacatcgaaactttcctgcatacaaatttctaacttttctgttatatcgtttcaatttcaatcaaactttcaattttgacatgaaattaaacacaccctatgtgtgtcctatgtgtggagaggtgtgtgtatttgtctttccatccaatcgtaacaaagaaacaaaacaatagggtcttttttttttgtctaagtaaaaagactagtgcaaacaaaacaaccacggatcaaaatgtacatttgtggcgtaaggttcattcttctatgctttttcaaagtagtgtgttgttgaaacttttcttttgcagtagtgttactttcagtgctttattttcttctctctcttaggatgaaaacaatcggaaacggtatttatttttctattattacagaaacggtactgatacggtcggagctctctatttttacaactttaatacgacacaaacaaaaattagaaaaaccaaattttactatcatagacacttagaaagaatatttttcattatcttttatgaaaacggtatatatacggtgagaaaatttatgtaccgttttttcatcccttctctctctccttttgcacagataataaaaagtaaattcctggcaaccactggttgtttgggctaatcggtgctttgttggtcaatgtaagatcaccattgctcttgctccaatttcgtcctgtagtgggctttttcaacgagcccaacccatagaacccggcctggatcacgaaagaatctaggcccatctaagcactagcaaactgcaaacagctgccagcgatcactcgagagcgctcatggcaggttgacgttcgctgcatcggcgacaaattaagcagctacccgacatgccgacacgaactaatctgcaattggaattttggaagaatactggcaccactgatggactcaaccaatgtagtttgtaaatcttcaattcttttttcgtaatttttagaaagatttacaatggattaagaagacaaacctagtgctcaagccctaattacctagactcgtctctgccctgactaccaccgcgtaaactaatcacaaagaatcagagctcgaaaagatgcagagaattgaagtccatgcaagagatgaaaggagaggacaccttctctattctcacgatatgaattcacattatttcccaatcatattcatgtacatcgcatacagattaggcactcttatgaaatttggagtacaactcagaacaaaagaatcgaccaaaacacagctaaaaacacaagagcaattgctactgaaaggctactgatcacagtgtctcttccatgacccaaaaacatactgaaaggcgctactgatcgcctcatctcatggcctcaaaactagggagtaatatattgctccagctctctccctctccagcttcgtcagcagccgcagcgacttgccggcgacggtcggtctcgggccgccgtcgttgctcttcgacttggtgggatgcggcggcggcggcggcgcggcagcgtttgtgacggcggcggtgggcgtgatcaccttaacttggtccctggatacgcgcacggggcggaagggatcgtggggcgggaacccgacgttgtagacgacgtcgaggaagccgtcgtcctcgtcggcgtcggacacgacgacggcgccgagccggagcacgaggtggcggttgagccccgcgccgatcttgccgacccgggtgcgcacgctcaccggcgtgcccttcttgatgatcggctcgtcgacgccggcggcgccggccaggaatggtgaggatgcccgtgaaaacttcttggcgacacgcccagtgatcggcgcgaggtgatccggcggcgtcctcctgctctcgatgtcgcggagaagcctcttcatgccggccgattgcaccgtcatggatggcatggtgctggaattgtttgatcgagcgagagaaaatcaggtgagatgggatgagagtcgagacgagaaggcggcaaaattatataggcggttgttgaatatgaaacggagtctacacgcgcagtcggagtcggagatcgacgcgttcacaggcgcagtcggagtcggagatcgacgtgttttcatttcccgccatctttcaaaattttgtattcgtaatgttggacgtgtgtggcggaaattgggctgggcgggttgaggagaagaggcccaggctgacatttgtacagcagggtaactgggcttggtttgaaagaggaataagttcatccgaggtcccttaacttatcaacgaaccgattttcgtccttcaaccgaaaaaccagatacaacgggtccctcagctgtcaaaactaatgcacatgaggtccctcggcagttttggctgatgtggcacctatgttattaatttgacttagtcttcatctgatatggcatggacgtgacgcttatgtggcaatgtgacccgaaaaaataaaacctcatgggacccacatgttagtttcacacataaactaatcaaaaatggtggggcccacatggccccacatgtcattctcagccccctcttcctcctttatcccgatctccctctcttttctcttcactctctctgccctctcatctcccaatgcttgatgcctcactgtcgtcgccgtccatatgctcccgcaggccgtagctcattggcgtccggcccaaagagatgagagagcaaaatagacttatttctaaccatataagacatggcccaaagagttgagggactcaaaataaacttattccaaggacgagcacgatgcaatgatcgtgccttcggatcgacacggcatgacccgagtcttattgagtcatgtctgggccgtaggcgcagtggctgcacaaagcaccatatggcatgtcgactgggcgtgccttgatgtaatgccccgctttcagcgagacgttaaaaactagtttaataaaatcctaattgcgaaaattccgttctttgagtgagagtctaagtcgtgccatggatctcaattcatatcccttgttccctctcgtcgacatcaaaatcctccaccccaagatttcaattccgattcaacttccgaagtcaaataccgaattcaatcgcatcctttgaatcctcaccaaatacttgtccctgttttcgcaaatatcaaattctcattttgaatctctctcttgacatctccttgactccaccttgtgttcctagaccaaatatcaaagttaaatccaattccaaacttcttttccttccaaaccagttctcacagcagaagttcaaaatccgtccctctacttttgtgggccgaattccctccctcggcccatctcctctctcagcccgtttccccctccccttcccacgtgcgccgcacgtgagccgctcgggagagctccctccctccctctctctctttgttctctctccctctctttgatcttccggctgccgcgattcgattttcgccgccgcccgtggtatcccgcgcgctcccctgccgtggccgaccggaaggacatcggtgtcactccctctggtcatcgcctgcgccgacgaccgtcctgtccccgctccactccacactgcccaccgtcgtcaccatggggttgctggcgtcacctcggcttccatgtcccgggctgcccgcgtgcgtccaaggccgaaagcccgagagaatgcgcctctctcacgcgctctcccttctccctctgctcgcccaaatcggcaaggagcaaagctcctttccttccccttttcgcttttcccctgaccacagccgccaccatcacctgccacccctttggccgctagcgccggaaccagccaccgctccttgaccgccctcgatgtcggttccctctcccaaaccgcctctcctcgtgcctataaagctcgagccatccttctctatctctcccattttcgctccccaccgccaccgcgccattgccacctcagcgtcaagtttgccgccgggtgccgccgctcgacaaacgcactccgtctccttgtcctccgtcgaccgaacaacggtcgtcgccgcctcatcgcgaccctgtccgtgccgccccggtgccgtgatcatgacccacgcccccgtgcgccaccgactcccactcaccaccggatcaccggagcgaaattcgtggccgttggtgaaccctcgtccccttccccttatcgcgttaaacgttgtcaccaccctcgctttctctcttctccatcgtcctaccaccctcgatgctgcgtgtaccatgcgtcgtcatcggcctttctctctctaaccaactcgtcgtaaccctcccggagttccttgcgccatctctttgcttccccaacagtgccatctcggtgctgtgccggcccgccgtcgcgactgccatgaccacaactccatccccatcgacgccgttcc

SEQ ID NO: 19200 - DNA, 5333 bp, Oryza sativa
  unsure (1)..(5333): unsure at all n locations
ccgccagtcgcccctcttgctcccgcgccgtgccgccctttctgcccccgcgggagcatccccgaagaccattgggccccgtgccacttttaatcgcgtcgcaatcgtgtaatggttcgtctaagcccgatcccgcactctcttttccctccttgcgctcggccacatcacccatttggcgagcctcgccgtcgtcgccggccgccgtcacacctctcctctcaaatccaagccgtggaatgagttccccttgacctcctctagctgccggtgatagacgcccttcccggctcgccgccgttcgccggcgcccttcggttgccgtgcgccgtccgatctgggcaagcccgggctccctctctcttgcgcttgcatggcagtccacatgggctcgaccaagtcggcgcatgccccgtcagcttctttctctccctccctcgcccgtgggctcggcccaccagccggcctcctcctcggcctatcaatacaatcaaagtccaattttactccctcctccaagtccagtgaccccaatcatgagctaaagtccataattgttccctccaaattgctcctccctcaccctttgattggccccacatgtcaatgagcgataaaagaatattcttttccatagaattcaataaatcatttctcctattccagaaattccatttaagcttccaaaattcatatctattgatccgtagctccgattgactccgttccacttccaataattccgtaaatttgagatctatataatggcactattaattagtctaaatagggtctttcttttggtcttgagcaaggcaagtcaccctttgaccaattgctcccttaattccaaaataattattattttgtttgcaacctgcattattagaaatacttaactcgcttggcctcggtctgcgtgccaaaccgatggacctacccagtagtcgcactaattcctgtaggccgttctaccctgattccttgtcgctccacctttgtggtacttcggtatccgtgctctctgagcgcgtataccaactattccacatacaccgttgtttgtcgataattgaggaaatgggttcgagaagccttgaaaacccgacatgtggtgtcagtgtgtttgaaaataaaataaattgtgaaaactcgcgatacaggggttgtgcctgtgtggcgttgtcccgtatttgcatataaggaccaattcatgtgggaaattcatccgagcatataacaagtgcgaccacacgggtagaatgagacgctcttggttgagtaaatagcaaaccagggaagccttgatgccaagagacaagtggattcaccggggtggtgtcgaggagaaccactgggcttcctggcacggtatggtctaggacctaacctgttgttggtttgggacccctctcgttggcatatggcgactctgtatcggttttcgaaatgccttgtcatgaaagccttaaggtctcccgacgtggctgatctccacgggctgggtgatccgagttagtaatgttgtgtgggtaaagtgtaccccatctgcagaggttaactaactgttcgagcagccgtgcccacggtcatgtgctgatttgaggtgtttcccgttgcgtagttttgtttgcatgtgctttctgaaaagttgttgtggatgggaatcgttaccagaatcaacctatgtggcagatggatgacctgaatggtcagaaacggatctatatgattcagatgtctacgggcattatagactaggcttcccgagtggaagcagattgttgtgctgctgggcaacatgactctgggagtccgagaaaatgaaaaggctctaggagccgattaataagagaaatggctctgggagccaagaagtaatgatacgacccgggaggtcagtacattaccatttgagttgttgaaaagcatctcttaagtcgaatcgagacgcaagtctcttttcgacccaaacctgaaaagaaataaatcacctaatgatttcaaataaaaaatttgcataacaaccttgcctctcttccaagctgaagttgaagaagaagtaaagtgaagattagggttacgtcttggttcccagccatcgcctgtggtgttgggtgttagtccattggttccactgctgctactgttgttggtgtttgcctcgtatgtcgtcggttctattctcgggctgtcctgagctataatctaagttaaggaaaataagtcctctatttattttaagaattacaattattcatatttgtcaccgtgggtaccagcgctattgtcgtgggattgctattgagatcgcggtttcgtaggaagcggttcgcgccgtttttcctacggcatgctcctgttaggtgccgttgtacggcggtgccggatcgggatgtgacacttgattgtacccggacggggtccatttggtcatctatacctcaatgttcagaccgcaagcaaattacccactcccattttgcttcagttacctcatgaatccgctgctgacggccgccgccgccgtcgtcttgtgcttcctcctccatggcgcggccgcctccggcgacccgttccctccacggttcaactccatcttcagcttcgggagctcctactccgacaccggcaacttcgtcctccagtccgccggcctcccgtccatccccttcaaccactccccctacggcgacaccttcttccgccgccccaccggccgcccctccgacggccgccttcccatcgacttcatcggtacgtgttctacgcagttgccgtcgccgtcgccgccgttgttgattaatttctcgttgctgtgtgattgatgctgttttggcaatggcgcgcggcagcggaggcgctagggctcccactcgtgccgccgttcctggcgaaggaggcgaacgacttcggcggcggcggcggcgccaacttcgccatcgtcggcggcacggcgctggacgtcgggttcttcatccggcgcaacaacgcgagcgtgccgccgttccagagctccctccgcgtgcagatcgggtggctccggagcctcctgaggcgcgccggcaacgccaccgcgacggagcgcctcgcgacggcgctgttcgtcgtcggcgagttcggaggcagcgactacaggtacctcctctccggcggcaagagcctcgagcaggccaagtccttcgtgccggaggtcgtgcgagccatctgccgaggcgtcgaggtaactaaaacagtaaaaacacaaacaccattgcccaatgtccattgcatttgctcgcatttgtcgccgccggcgccgactaagactacgagtgtgtctgtgtgtgtgcagaggctagtggaggaaggagcgaggtacgtggtggtgacagggacgccgccggcggggtgcatgccngatggagctgaccaagtacgcggcagccaacgcgtcgtcggcggcggcggcgtatgatcgtcggacggggtgcctccggcggctcaacgggctggctcagtaccacaactggctgctccgggaggctgtggagcgcatgcgcggcaagtatccgacgacaaagctcgtctacgccgacttctacaagccggtggcgagcctcgtccggcgaccggcaaagttcggtaagtcgccgcgccgagattttttttcctgctttaattacccagtttcatattgtaagtcgtttgactttttttctagtcaaacttctttaaatttgatcaaatttatagaaaaatatactaacatttttaatacaaaacaaacatattatcaaaatatattcaatattaaatttattaaacctaatttaatgttgtaaatattgctattttttctataaacttggtaaaatctaaataattttcactaagaaaaaagtcaaacaacttatagtatgaaacggatggagtattttctactagaaggaaaaacaaaaaggaaaattgtaattatttgtttcgagtacaaatcggatgcactgacatggttacacccacacacatggacatatcctagctagcacaaatctaaagagactgaaggcctaacataaagacgcgaatattagagaatgaccttatattagataattagaaggggtgagacttcgaatccaggtcgtctagtctaccatcttgtggaagtggccgaaagacccctgtacgtttctcattgaaggcctaacatcgtgtagcgggtacatactttgtcaagcccaaaataatttgaacctttaacaaaatttgaacaaatttgaccaaatcagaaaaaaaatatataatacttccctcgaaataatttcaaaattttcggtcaggaattttaaaccatggtcagccgtaccacctgaaacttgaattgggtcgttagattgcaccacaggtaatctgattagctgagctcggaaaacaaatcctaataggctcaaattttgatgaattgtaatttgatttatcttttatagatcgacatcgatcagccatcgtcgtagctatagctcataaatgcgagtgtgcgacagtagccatgtacacacgtaaagagatataagagcaggtacaatagcaggctataaactagctgcaaacatattttaaggagataaataaggagagagaagagtagcgggctacaaatttatagccagctgtagcacggactccaagacacagtgtgtatatgacaagtgggaccatatattaatggtgtagtatgtaactattgtatgaataagctattagattggctatagataaattggagctagtagttggctatactattaaacttgctctaatgcctgattagtgaagtcaaattggttgatgaaacctaaagcgatagaacaattaactgcgctagcttgagtacttgagcacttccaagagctttgcaacttacgaaattttagaatctttaggtacgttaagccatgaactatgtcgggaaggcaaagccgaagaagttacaagattattgtggcttgtggatcgagaaactagctataaagtctacaatcacagtatctttttatgaaaacaatctggcatgcagctgtaattttgttgggtgtcacacaaaataatctaccagccagcttgggtcaactctgctagcatataaaattacaaaacacttgtagaaacccaatgaaccctgttaggtttgttgacataagggctggtttggttttaggcctaaattagacttatcaatatttggcaaatttaatagtgtttagtatctatttggtttgaagccaaattttgacatgcctaagaaaataggccatttcaatagtgaacttaggctattttagcttcaatcc

SEQ ID NO: 19201 - DNA, 857 bp, Oryza sativa
cactctcgtgccctccccagcagatttactccaaaatttctaccccatttgatcagctcttatgggtttgattgtttgagaagatgactatggatggcaagatgggctcctgtgtcttctagctcgggattggaggagctataggttgtggcctgtggctagagaagatgatgagcggtaggtggatgccaataaatgagaatatctgcttgtgtactactgtgcagcttggatatggagcgtcatccgagcccgcgcaagagtttaaatttcacgcctacgttttggctcttgtcaatggcgtgacctattgttttgcataggccagccaatatttggatccaaaccaaaattatactttgtactgttaatgtggcccaaacattggtaaggccattttaggctatgaaccaaaccggccctaaataataggatccaatgtgttttttgaactgtcatataagggcaagtacaaaggtagagaccggtgtagtctctacgttaattagagactatcacgttacaatagttaatacaatatggtctctaaccattaatgcaccaaaatactttcttactagtcatctttcctttattactcaatgcaacaaaaaaaattcctaataaatgctaagagtcgactctatgccgctgtcatacgtagcaaccatctttctctttccttcttcctctctcttctacatcactaaatatgctcgcatgacaataaagagagaccgctaataaagaccattgtacattccctaatagcaatgtttgtcaatcaaggaagaagtacctgataggtgggatttcattctttgtaagaactgtcacataccacctaccgtgaacct

SEQ ID NO: 19202 - DNA, 699 bp, Oryza sativa
caagaactgcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaatagatttaacaaaagaagtgaaacatttgtacactgagaactgtgtaagtcattgatgaaaggaattaaaacacaa

SEQ ID NO: 19203 - DNA, 4272 bp, Oryza sativa
tgttgttccttttgtctttcacattatgaacttaaatatagatacaaacttatagcaagtagttaaaatcagcaagagtgtcagttaatccatacaggaggcaacagtctagttagcatcaggcatgtgcttggatcaactgataacaacatttctttcacaggagtattgatgacattgaaaatgccattgaagaggcaaatgaacacacagaaaatatgaggcagatacaggaggcacttgcaacaccaattggcgcttctgctgatttcgacgaggtactgttcatctatctctttcccctctggcgtcaattaaaacgtgtgcaagatggtattatctaactcgaaataggcatgccaccaagacacaaaatacataattgcacacgatgccaattttccgaagatgtttgactctcatattttctattttgaaggatgaactagaagcagagctggaagatctggaggaggaagagctcgaccatgagctgcctgaaccacctcagagtacacgcatggaaccatcagcgagagttacaacttcatcttaaccagccaatgatttggctgaactgaccaaacttcaagcagagatggcgctttaatcacagtttggagggatttgtttgtattttgctgacatcctgtttgtgtagtgtactcggaaataacatgttgtaaattcagtttgttgtagaaaaaaacccttccttttataatttgttcttttctgttaccttgcttcctaaacgcacgattttttttttgcctggtaccccataaatgagttgaaatcgaaaccctatgcctgtgaatgagggaagaggaagaagcagaggttcagtaacaaccacacaaaatgccccgattggactggcttccaaagtcttattaattttgtgttgaaaaattagtttccagtttcattcgtagttttctgtatagttgagatatttttgctattattctttgaccacttgctggaattggtgtcagcgtcacactgtcactcatacttgtcccgggtaacaaggaaaaaaagaagaagaggaaaaccttagtcattgtgctgagtgctgactatgttacttgtttcattgggtcattcagatcaagtttccttttgcatacaccaccatcacgaaggcaagaaatgctagtactccgtattcaatatcaacaatagacagtagtagtatctttaggcctctctgtttaggcttataagctaacttataagtcgaaaagtctaagcctaaacaaacaagcagcttttccgtttagcttttttgaaaccataagccactctaatactattaagccaaaagctaggttggagaagcttttttggcttatgtgaggtagatgtatgactcaactactaaacttaggacattaaatccaccggcttataaatcatataaaccaataagctgacttaaaagtctaggccaataaacctaagcctaaataaagagggccttaagctagaaacagaaccaaacacgtaccaaaaatgtcattttcagcttcatcttcacatttgaggtgctccacctgagtgtatggggctcgcatctgatgctggctgcaactgaagcagcatatgggcagcatatccaacgtcctaatcaatcaacaaaagttccatccgatgatcttagctacacagcacattggttagaatttcctgccatcgagttaattaatcatccttcaacacgaaaaagcacaacatcatttggtcggtcgggcggttagctgaaccaatccataaacccccatcctcatgctaatgtcgtgttagtgtgttgttattgtcgtttttattttcgacgccatacgtggattagtacagagtacagacaacagctccctccctgacgcgtgggccaaacctggcaacttcttcttctgctatgccacgtcacaccgccatgtgggaccacgctgattgactcattggtcccacgtggcagcgaatccccctcatctctctcgcggagctcggagagacaagagagagaaccagaggcttctcttctcccgcatctcccaccctgatctcctcgcgtcgcgccctcccctcacctcgaatggcgatacctcctccacccacgcgccccaatccctaaccctagatccctcctcccacgccctctcgcgcacgaccaatctccctcttccttcctgttgtgtctctctcgcactgtccaatctcccaattcattatggaggcgggggcggggagcagcagcgccaagctggtggcggcgtgcgtcatcggcgggatcgtgctgggggcatccgtggtcgcgctccacctcgccggccccgtcgccattcccgccctgccgcccgtcgacgcgctccgccgccggttccgccgcggacgacggcgccccgtgcgcgtctacatggatggctgcttcgacatgatgcactacggccactgcaacgcgctgcgccaggcgcgcgccctcggggacgagctcatcgtcggcgttgtcagcgaccacgagatcaccgccaacaagggcccgccggtcacgcccctccacgagaggttcactccaaaccctttgtcattctctttttaaaaaaaattcttgaatgatgcgcgatgtaatcctaccaaactgttacctgatactggttgtgtgctttaataatgatttaggcaaatcagcctataggtagtgaattttcctctacatatcttgcagtgttctgtgggcattacaagttcttaggggtaactgttgtgggttgttccttatgggcgatcttttacttgggttaatggtttagtcgagaagctgttgcatcaaacttcctatcttctgtttcaatttcagctgcacactgattctgtcctaatcatggggaatatgttactgcttttactatttcataacttaatttgtatcgcacactgatttgtttcagtttcgactctttagttgcgttcaatgtactgttgcacaatacaagttactagtggagcacttttataaggatatccttagattagtttttgaagctgcgacgttttccccccacacatcatatatgtgtctgtcggtcttaattcgagcactagtccagtaattctatctggaaacttgaaattgctaagggaaatgttgtgacatgtgggttgtagttagtcgtcggaccaagtttctgataactttggtggtggatgagctgcttatgtttctctaattcatttgagtacggattcaatatctgagcagtaacgaaaaagattagctctatttcttttgggtgcctgaaggagaaactcagaaaaaaaaaggtttgctctgctgaaagtactaaacaatgaatttttggtctgtacattcaaacaaatccaaaaaacttattaattcctaccgataaaccatactagacttgcaggtttggttctgctcagtttgccttaagtacctgctaagtgattccttgctttcctttgtcttgttgataatcacaagctgctcacatatgacatggtatgtgtggcattttagatgttaggtgctgcaacctttttttcctcatttaatcatcatcatggtggtttagcaacactataaatttgttatttttgctggttttcttttgttgtttactgactttcattgtgtctggttttccagtttaggagttactgcacatattgttttttttttctttctatttttagttgtgttaccaattttacgtgtgaccccatgtcatatggaattttaggcatttttgttcttttagacttgcagttttgtttctttgattgtattatgtattatcatatacccatattttccacttcaaaaaaaaccattttgtcttgaatgatttttttatgtttctttttctgatatacaggttgataatggtccgtgctgtaaaatgggtacacgatgttattccagatgcaccttacgccataactgaggatttcatgaataaattattcaatgagtataatatagattatatcatccatggcgatgatccttgtctgctcccagatggtactgatgcatatgctcttgccaaaaaggttggtcgatttaaacagattaaaagaaccgaaggagtgtcaacgacagacattgttggtactgattctgttcttttctgttttaatcattaaagtttttactcatagtgaaatttaacctaaaacttccatcgcaagggaatatatggttcttgttatgtactacaactttacaagttatttctttggctc

SEQ ID NO: 19204 - DNA, 8311 bp, Oryza sativa
gttcagtcacgggcatggccagaaaattgatgatagtggatctggaagtggaactaggatatctcattttcttcctacatctcggagaatagttcagttctcaaatagcagggtacagctctttacattctttcacagaggatcattttctgaactgctcatgtaaaactttgaatgtcattttttttgagatatcatattttttgaaggcatgaattaaacattgacagcataaaaatgcctcatagatgttttttttttttgcctttaaacagtagagcgcgagttatttggctttcaggatcctgttaccattttactaatacttttgccatttgaaagacatttgttgtttggttgcattctttatctagtaaacattgagttgaatgacctgacgacaaatggattatttcacaacttagatttgttctgaggttatattagtaaagaatataagttatatccttgaacttccaacaagaactaacatgctgctaagctcaactattaattaatcattgcattagtcgtttatcatttatttcaagctgtttacatttgatactattcactagataaaactacttgctgagtacggccacttattctttctgttgactgtcagctttacctatgcagggtccaggtccagattctcggatagtgtacatagatggtgcatttgatctattccatgctggacatgttgaggtaaacgcaatgtcaaatgtctgtctcagcatgtagagcaacttggctatgcatttgttggttgtatggttttacctgtggttttccttttccttttctttttcttattgcaagggtgcaaactgaaatgatctctctaagacatagtgatttggacttcctgtgtatttatagtttcttctacttagatattgcgcctcgctcgagagcttggagatttcctgcttgtgggtattcacacagaccagactataaggtaataatgatggttttttttttccactgtctcaatttttccaagttacaatgcttggtactgtttttcagttttgcatcttagtttatagtcaggttgtatttgtattgaagcatagcatctctactcaattccgtcgtcataacattctgtttttgggggcacttggtgtttaccgtatttgccagttcaacaagaggaccacatcgcccaatcatgaacctccatgagagaagtttgagtgttttggcttgccgttatgttgatgaagtgatcattggtgctccatgggatgtttcgaaagatatggttagttttctgttctactttatcatgatgctctcttactgtagtaggaattgcttgatgcaactgctagtaatagttcattgaacatggcacaactatgcatgcacagttcaaagattgaacatgatatttatgctacgccagcaaaagccttgctcacagctattattgattttagatacagattaacagatatggtcggatttgtgcttatccatgattttctgcagatgcacgattgcacgtagcattaattttatgtcacagtcaaataaactaaaagtttaggagctggcttggttccaaaagtttaatttgatgtagtctaagtttccgttagatatgttgttaagaaccagattatgtatttgtatgcaatattatcattgaaattgaccatctgaaattcataccctttaactgttacttatgattatcagggtatgtgtctttgcagtgtggctggaggtagctaatttcctttttctgtgcagattaccacatttaatatttcgttggttgttcatgggacaattgctgagaatatggactttatgaaggttacttactcaatacattttcttagaatataaagatgtatagcattgatcattaacaactgttacttgtgcacctatcaggatgatttaaatccatatgctgttccaagggctatgggcatctaccgtagactggagagccctttagacatcactactagtactatcataaggaggatagttgctaaccatgaagcctaccaggtatgttatgtaacatggtatattggtgctacgtcaaattggcaggtgggagtctggtttttctgtttggtgcatgcagcatgtagtaaaatacataatcccagtcaaataaatgcgatttgcctgttgtctacttcatattaatgatgtgtgtacatgatttattataaaccgatgtttgtgataatgtgttagtgttttcttgaagccctttgcatatgcgcattaaatatttgtctgtttctctgggaccaattttttcatgctataactacgctcagcaacatgttgtttggtgtggggacttggtgtagtttgcatttatttattctggtccattgatgtgctgaggttttgttcatttttagtctgtggttttgcttttgcagaaacggaacgagaagaaagaagccagtgagaagaagtactacgacagtaaaagctttgtcaatggagagtaacttaggaacaggtcttgcattaatgctattgcccagaagtttagttcacaaccttctggcacaaatgcagcggttagatgatccacaattttacagtcttgtggtaactattctcatgttgctgatatagctcaggaaacttcagatgcaaccctgatgatggtgctgacttgggtgatgctggagaccctattttcctgtatatggggctttgtggctgccaataccagctgtgttattttgagatgggtagtttttttttttttgtttttttgttcaggattgttgtagagtatgaatgttaagcttgattaactattcctgatgctttatttcggagttgccaggtatatgtggcatcatcttatgagagtccttttctcatatattttggtacacttctgttatgatctggaactgagcaactgatatttgtgtgggtcggtgacagcaactgtgtctggaatctggatgttttttcaaggctgggttggtgacacgttgggatctttattatgatacacattgatgtgtgaatcactggaccttgacaaaatggttgcaagcagtggctggctgccaaatggtcgcaatctgctggttcagtgtggtatacgttaatcgccatggaaagggatgtgctacctgtgatctccaaacagtagcacactgatgagcagccggggcacgaggctctggggcagcctgtgcctgctctcctgtaagcaacttacactgtttctggccgctgattacttgatttgcctgccaatatatgttggcttggtttggcttggctttgattttggactgtgacacatgtctagtagcttttgtgtgtttatcactctatcttgctcacatgtgaatggacctgcagagctatggtaaatagaacagtactacgtgttatgaacacgcgtgacttgatggactcgagtgtctgttctgtttggtacaccatttcatttttttttcttggaggagacatgcactttctagctccagttgtacagagtttaggttttatcctttgctagagatgagatccaatctgttttcatatgaatttttctactatgttccaagctgagtagctgagaatgtagcttgcccctgtgatgaattggaattttggaatactgaactgtatatggagtggagttgaaacttgaacttgaggtagagcgtgacatgaaaagagaaaatgaagaaatgtgcaagtgttttgatggtgtcgccatgcgaatgcgatcctgtggggcaaggtgaagagatcgagctgctgcataatccaacgaccgcatctgacgactgtcgcagagcccatggtcacttattatttcagaaatgtcatctcgtctcatctcacacctggaatcctgtactactgtttggtttggtttcatttcatggggccggacctggactggaatgcaaatggaatcctcaatcactcactttgctgttttttcccttccggtcccatgcttaattagcatgtagaaatagacaggatgatgctgctggggccaagttgtcattgaggaaaccgttgagaatcaggttggcatggctacctcatccatggatcattgtctgtctagtgtgtaggttaaatgggggcctttaccacatcagaaatgatcatacactatgatatcaattcatggaccagcttcacacccgtgagcttctgaatgggtatggtcacattcgatatgttttggaagaagattattttttctaatgttattactatctgtaaaatttgtaagattgaatacagttgatttgattttttagaagtacaagaacatcagtgctgaaaagagttgaagcactatctcatgtagcatttatcttttcacatcttggatttttattttgattttttcagatgtagaacatataatccctatgagttgatttttagaaatgttcagaaaattctgtaatttttcaccacggcactgtcaagctccactagtgtaccaactcatggaatctatctgtgtcatttctatattactaaccatgtttataaacaattttacagttgatcaggccatcaaaggatccctctttgcatgcatgcacaactgaactgaactgaacaaaaataaaataaaatgcaggtcagctttagttaggctaagagcaagtttaatagtatgctataagccaattataagtttatgtggaggacagagaatttgaaaaatagagagagttggcctcatgtaagagctagcactcacatacttcaagataaatacatttaatgtataggtgagagatagagagaaggagaaaaatagagataaccttataactaatctactgtatatgttaactctaatataagttataaactcatagttggctctattattaaacttgctctaaacatgcacctcataactcacaaaattggagggcctaaaagcctccagcgaagagctttttggcgtggatcgatcagattagttaattatgatatcacatcagttaattacttcactaataattaacgtatcccaagaactctcaaaacttgcaaccatgtgcggacacgcacttgcaggcctaattaattccttaatcgcgtacttgtcgctactaatccatcacaaggaggtacgtagccgctaccgtccaatcgcttcacacgtatcatgacccttctcattacatgttgacatgtagctaactagctatgcatgcatctagggatgatttatctacaataatcgctgacaatctgtctgatcggcttgagagatggattcccacatgtttaatcatgaggtaactactagttccttttttatataggagtagaaagcttaaaatcactcccttcaatcacaagtgacgcttttacattgataaggtttctaaaatgcaacttgatttgcatacaattgtattgtagaaaattttacgaaaaaatagcatatctaaatgttgaagcagatatatgtgtttcttataggtggtgacaactacaacatgctatggctgcactgccgatcgactgccgcctatggtccgtgagctgtaaaaagtggctaaccaccggaaaatggtactccattagttgaacgttcaaactcgataatgccggccgttggctgcactactaggttcaataacgataggcatttctttactcggtcatctttttatttcttttatctcgcatggccagcttaaccttttgctctggatcatactctggattactactgtattttaagcctgacagttaaaggccatgagctactaaaagtagtgacagttttggtgctaaagtttattcatagtgtgatcttgtgccaagtgccatgaccagggttgaaaatttcggaccgaaatttcggtcatttcggtcccctccgatacgatattacttcggccgaaatttttcattttttcatttttttatgaattttgataatatttgttcaaattcaactaaattttgttcaaaattttcgaaatttcagaatttcggtgaggtccgatcaaattggccaaaagaaagagaagaaaatgaagatgatatatactgcagcctgcaaccacttggcttagcttgatcagtccccagttgctgctgcctgctgctggtgtttggtggtaggctcggcctgcagctacacacccgtgtgatatggttgtgtgcacatgctgctggacatgcattgcatatttgcatggacagatattagccgatgcccaccatcttatctttttctgtctgtggtccttcctcttataatgctccttctacaagctagcatgaagcacatttcctcaatctcccattttcatgccaacttgttctttttttattgttattttgataagatttttgtgtgtgcaaagataggcagcatgctcttatggcacattttagaacataggattctcaaaacagggaataaaaaaaatgcatagtatagcgcttcaaatcttatgaatggcaaaatacaggaaaaggaaaattacatgaatagtcgtttagatggagcgcatgagatcaatagagataggcacaaaggaagattttcatgaggttgaatctcatgttaggaatcctctaaaattccaatgatcttgcctatttctaaggaattttatagtatctgtgggagctagtaattcttttgttccaaaggaccatattagaaaatttttcgtagaattaatttcttaaacaactcctttaaaaaaatcctttaatccaaaggagccttattttatattctctattttgtgtaaaattagacaatctactttgttggtagtagaagtagagttttagttttgttcaagtgtgtatttgcaaaaaacacacactggcatgagagatttgcttaactctagtactggacctaaatcttgcttttgggtttaagggcgtgccagttagtttgatcctgcaatcaacaagaaacaagaaaacgaagttaaatcctcaaacgatagccgatcggctaatggccgatgacgtctcgtttataacctagccgatggtacgtaaggtagatcggcaatgaaatataaagcaaaagaaagttagatctatccgatcggctgtagatattaacaatatataatatgtatatcgaaatatgtttaaactaagtgattgggatagatcggacagcttgccgagacagtataaatcacttatgtctaaaagtacttcaatataaagattatatatgtttatagcatagccgatgttgtagatctaacatgtatcggctaatactccgatacaactttatactacgatatcaatgcaagtgaaatatattaaacagatatcaatcgattgctaagataacttaacagattaacaacaagctcaatatattttactatagtgagatcttaatataaagagcagatttagcatatcaaatacataaaataatgaataagataactaaatcaggtaagataggctgaaactccgatgctatctctaatagcaatcataaaacaagttagatattataattctaaatattacttaataggtcggacccaaccgatgcagcattaagcataaggagatgtataagatctatacaagtcgatgaaagcctttcaagatggtagataaactatataatctaattcaacgttggtatctaaccctatcggctaccttctagaaagagatgttagctgatttgaggctagataacaatattagtctagattatatagaatatatgataaatcaacaacttatataaacaagactagagtatcatagagatggaagcactaatcccgagaacacaagccatcataacaagttttaccttgtcgtcggagatcgaaccgatgcagcctaacttgaaagcaagaactcgtcgaaagtaaactaaaacgaaagggtggcgatgcgccgagattgttattaaactgattgttaattaattacatgggtttgggctacttttatacccaaagtacataatatgtccctgtcggacacgacacctatctctattacaactcaaaatgcaaacaagtccctaaggtggactcttaccgacttgaaacataaggaatttacataaaataatctaattaatagatacaattgccttctttggactcaatccatgcatggctatcctcatgaggcatatcaacccaatccaacaatgactccaatatcatattgtcggaatcggcttcatcggctaccctgtccgactcgactctgccgatgtagatcgtagctgattcggactttagtcgatgtgcactctgtt

SEQ ID NO: 19205 - DNA, 17300 bp, Oryza sativa
agtggcgacctcacccgcgacgatgtcaacttccgctggtccttttgctgcaccatcggctgaattccccgaggtaagtccccatcggctagatcccttgttcttgcagtagattagttctttcttcgctcaatctgcctttttcctcttttcttctatagaacctttctcatcagatcgcaatcccaagtttagttcatcccaatcagtactttcttggtccgatcgacaatttggatccaactgagttcattaatgccgaaaccaataggatcccctttagactagccaatccaaacttaagtctttgaaaaaatacctttaagtcatggccatcaacttagaagagttagccggcttggtataaaagggtatcggctagcaagggttctcactgggaggaaattgggatagcccaagccctagctctgactgcagccaatatggctaaggatgaacctctgatgtcggcagcttcttatttctggtccaatgccatgaatggctttctgtttaaacagggaccaatgaccccaactttgctagacataaccatgataactggtttagacatcacttcatcggttaatccagtcggcttgaataccaaaaacaagtttgacttcaaaaccaggagcataggtggttggtcagggtttgtctcatcaaacatggggaatggagctgttactccaagagaacacacagcattccttctgatgtggctagaaaagtacttgttctgtggtccaagctgtggcccaactgtaaactggcaacacatagccgagtccctagtagaaaaaaaaggatttccattaggaaaatatctattaggttatttataccaaacactgaactcaacatcggctagaattgcttctggatcagcaatcgacataggtggcccttggtggcttcttcaaatctggttgaatttgcatactatgaaagttgtcgatagaccagccctgacagaagcagatttcccaagattcgaaccaatcaccgatgaagatagggaagaaataaccacatgccgatgcatgtcttttggagaggcagcatcaactaatgctggatccaaactgtcagccgatcctttcagagattggtttgcaagcttctacaatgggttccccagggattcaatagtttggtttgcatatgccgattctgatagctttgaacttccctcggacttcagatttgatgacattaattctgagaagtttgataagtctagagaagttttcactactgctatcagcccttgcatactctcagttggcatacatcagggtagaaacatccaagtttcttacgaattctatcaccccatgagtgctgccagacaacttggattgggacagctgccaattggtttgtattttgccgacaagatccagcatagaggggaaattacattggcattaatgatggatcggctgctaagcatccaaggacctccccttggaagtattgataatattgagctagctttgctcaggagcacaacatttgaccgatggtgggttgaatggaagaaacatttatttcatcaatcggtttccatgtatctcactaacatattccctgatgttatccctcaagtaagaatttctacttttatcaatttccttaactatctgctgatataaaaatttatccaatttatttctttgattgcagaccacagaatcttcacctcctcatcatagtgaaagtggtttggagatcaattatgctgcaggccttcttcctaatggtggtggactggctcctcctgtcatcggcttccatgccccccaagacaacaagtttgcttcaaggacagatgagagagcctatcccaatggataccggaaagaagaaaagaaccaagccatcggttgtagatccatcggctaccaagaagaagaaaacaaataagcaaaaaactttagcaaccgatgatctaccaactgttgatccagatgtcgacaaatttctggatgatgaagccatggaagaagacattgatgcagctgctgccgaagtcagtgacactagagaacaaacacctcctgccgataccccagctccacaaagaattcctccggcaccacctcaactagctcggcatcccagggtaagtattctaatcaaaacttgatgcttgcaagaatttcatatcccaatttcatcataacacttgtctctgcagaagaagaaatcggctgccagaaagaaaccaatactgcctccatcggtaacttatattttctcatttcctttttattcatataagccgattcctaataacacttttctttttagcctcctcattctccaactcctgttcagcctgaatcaagtgaacacaccccatcggctgtaggaagtcatcatgtagaagatgcagcagctccaactcctgctgtccctgtaagtacttatcttgatcttatatcggctgtttaaacattcgaacactttaaccgaatctgcatttttctttcttgcaggttttagccgatatgttctcttttgacataagacaattctgggatgaagaagaagaagacacctcaagcaaagccttagctcctctagccgatgatgttaagagaactcttatggaaatatcaaatcggctagagaattccttggatgtcttggtagtcgattgtggatcaatcagggcctggttccacgaaattcaaaatatgatcccagaagacttagccactacgctaactccagctttttatcttgaacaacatcaattcaagttggagaaagcaagacaaaggatagccaataggcgagaaagaaaagatatagaggcaaccatccaagtcaatcggcaatctgtcaatgaggagaaagccaacctagatcagctatcttttggcccttgtcgggaccccaattacgatccctctgtgtgtaatgtgctagtcccagatcaacgctagcacacacagtaacaaaagataatatcacaatcacatcacgattatattaataaataggaaacaaatataatttttacattggtcttatgaccagattttataatttctttgccacgcagggtcaaacagagataaacagaggaaaaagaggcgagaggcaccaacgacacaccacaggcaatcgactggggcacgcaacctattcgacgttcttagcaacagaacttctagaaacaactgaccttctctgaaatttggtgagacaacaagggtgagcacataaagtactcgcaagtgtacgggaatatgcaatatatgatacaaggcttcaaaggacggttagggttcatttgcataaaggcatttgcaaatttaaatataataaatagatataaatttaatttaagcaacatttgcaatcacaacatttttaaccaaccaaccaacccaaaaaggatactgtgtccacacaagaccaaaaggttctttgtccacacaggacaacacatctatattcattaattcctgcacacaactctttcccaaaattaaaactttcacaaatctacccctcatgtgaagtcaccgagcatgtccataaccgaggacgcggctattcgaatagattgacactctgcagaggttgtacaactttacccacaagatacagttcggtgccgctaaacaccaaagtgtaacaaagcgtttcccctacctcgccctaacaccggcttcccccatgggcggtcctccctacaccacacaggtgaaagttcccatggtacaaaccaaaaacctatcatctagccacctgggccgccggtgccaaagctaagcagtgtactaagctaggtccttcccatgaaaacatgtggttgcatggtaaggctcagatcaatggcgcacgaagtgaagtccttaactgaccagggcgacttgcttaaactaaggacctcaagcacacaacaaaaatggagcacacagctctggagcacaccgctcaatcgaccacacaggtcaatgataagcacgcacacagatggcttacctcccaggttcacacagatccaccatcgccccggtctaaaacattttccaccagttcattactacacacggtgcaacacatgccaccaagaagatagcacacagccacacaatttatataaaaacagtgataagtagatcattagtcaatattatattttgcttgtaaactagtgtgagtagggctaagcaaatctaagtacctgagtccatacccatatatgactcacatgaaaactagggtgacatggcatgaaaggtaatcaacaataattcaaaggcatggaataattaacaagtaggttataactacccacacaataatttgtgaaacaaatcatgcatataatttaaaacaatataattttgcaagttaggatcaacatgttcaagggtacacttgcctttacccacaggatcttcagacgaaatcttcacctgcagcagcaacctcttcggcaacggcgtctacacgattgcaaaaaggagaaaacaaataaacaaaagaaaaaggcagaaaaataacatcaaatgaagtaactaaataaatcaggaagtagagctcaatttcagaataacataggagaaagaatgggttgaatctgaatttggacggaggagataggaccaacgaaagattgaatttagagaacattttcatggagaagtaaatgaatgtttctggaaagtttatttgggatttctggaataaaggaattagttttggtggactaacgggtgtggcccatcctgttgagattatgggcatataaggatttaatttattccataaataaatcatgacattacagatgaaaactagcatgaacgcatcattagatctacacatgtaaactacgcagaataacatgaacagatcaaatatgcgcaacatattaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacatcgtgcacgcgcgccgcctgccctgccctgccaggccaggccaggccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacaagagtatatgcatcttcacttggatagggtatatatatttgtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagttctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatagcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccctccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattaacacgtaccgaggtgacgaaaagaccggctgcttggtcgaaacttttcgcaggtgtctacgaaggcacgaaacacgcgagcaaagaggaaggcgagccgtcgcgaacgaacagggagcagtcgcgcgaagcgctttccaaaaaccttattggcggctttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacacatccatcagtgggatgatcaacggagaatttgttatagggagtagagtggtggactgattacgtagatggccgagatttatttgtagggagggatgacttggattgatttgggtattaggaggtttggtctaaccatgaggtgtgcaacatggtgccgtggagcgagcacataataggcgtggtgatgataaagcactggatggtggacggatagctagaggggcttcaggagtcggtttggagtcagggacatcgaggtggagctcaccgggatgctcgatggtcgctcgtggtaggttggcgcggggggaggaaacaacagattttgtcacagcggtgcagctgctcaccaaccacgatggtgacatggctgtgcacgagaaggaaagagaggtggcaacaatggctcaaactcctagggacagtggcagcgaagcgagggaggatagtgcttgggcatcagcgtctcagcatacgtgaataaaaagaaaaagggccagcactagtaggaataagaagagagacaaggcgcgtggcggaggaagattatagaggcagtacagggaacaagatagtagaaacggttgcaacaacgacgggtagttgacgatgtggtgttggcgaggatgacagaagtggtaactccagtccttcgcttgtttggaacaatgatgatgcagccaaccgcttggtcggcgtgggaagaaacagagttgtgttccatatcgatagtggtatcggaagatagaaatttggtggaaaagctgaacggattttcaagaacatttttctgaaatattcggaattccaacgatgtataattttgtggattaacaagtagggtccatgagtcattctcagagggaagttatagttatgggcacactgcaggcacagcgaccacgggccatccactagtagtttggtggcgccgagaacaagaggagacaccgggctcatggcggaggacggtgatgatgcagcattgtgatggaaccgcgatgaccatggaaaaggggacagcaacaacgctttggcaaccgtccataaggagaagatagcagcagcggcatgagcccctagaaataggcgctgccaacaggacagggaggatttggccaaagtcgacctcgcggcaacatgtgtttttcccgactttaggaggcagcgaagcaaggaagaggagtagcagcacaacggcgtcttggcgttggtgaagcaacggtgttgcattatggagtgttctgactgacaacgatggcacaactacgagtgggcgatggcatggaagaaagcagcggcgctgatgttcattcacccgaggcggcattggtggatgtgatggtatagcatcacatatagatgaccaaaaggcccgcccggcacggcccggcccatgcacagccaggcacggcccaccagccatcgggccggcacggcccgatcggcacttcatgccgggctgtgccgggccggcccgaaggcacggatggtccatcgtgcctttttttaaataagtctattttccgtccctcctctttgggctgtgacatatatatagtgaaaataagtctatttccgtccctcctctttgggctgacatatatatatagctaaaataagtctatttgacgtccctattcttttgaccgtggtatataatatgtctatttttactccctattgtttatgtgtcgggcctggactgcggcccatcatgccgtgctagcctggtcgtgctgggccagcccaacgtgccggtggaggggcccaggcacggcccggtggttgggccgggccagcacgggcccaacccctgacgggccgtgccgtgcttgggccgggccaaaacaccgtgccgtgggccgggccgtcgggcctcgggccttttggccatctatagcatcacaacagcaagatgaagagtcccagtgtgcacgaataaaataaaataaaaattggaggggcagcgctgctgtatagggaagccagagcagagagcatctcagcatgcgcgagcaaaagaaaaggattgcagaggtgttgttaaatatatatagaggagaaaaggggaaaagtacgagcagccataagatggagagatggtgaaaacagagctaaccgatcgacggtgatagtgatttagtttttgataaataaaggaggaaatgattataaaaagtggaggcagtgcaggtccttaccaaccacgatagtggagacatggcagcaacaatatgtgctagacgacgaggcagtggcgtctttatgtgcacacgacagcaacccgacatggaagaacagaagagcagcagagtgatggcctctcaacctgtgcaaacaccggatgatgaataggaaggaggaaacgaccaatggacttggatgcggtgcaagtgcttaccatgacagagaagtggcagcatgatgctcgtatgatgacggcacaaactctagagatggtggtgtgatggaatgggaacgacaatgatgaggtgaagacgacagcgcagaggagcatagcagcggcgcatcggcggttgaggaagctcccgacgaggtggtcatgtcctcgatcatgctttcacatggatagcacatggtgtggctgtttgcaagcgctaccgtggctgaactcaaccgggctgcgatgacagagcctgcaaaatctcccaaggcgatggcagtgaagcggtttggcagggcgctgacctatccatgtaaaagaaatagaagagggcatggcactggcaattatacaggacacgggaggtggacggtaaaaagtggaggagccatatgtgctggaaaaatggatctagctcatcatggtgattcaatttttgtcattgatggaaaaaaatgatttaggagaggaaggaattagtgagtagattggaagaagaagaaaagaaacggctaatcatcctcagtggtatctgtggaggaggaaggtaaactagctgggagatgagaggtcaccggaaatttgggaaacggattcagatcatcaaggtagtttcattttttggcattaaacagtaagattgatgagggagatgatagatctgtgatgggaattggaggatacgttgctgctttcatggagaaaaaaacgtcagattgaagacgaagcagaaacggcgtggccgtgcgtgggcagtggggaggatggcggcttgggttgggctgggtttggcctgctcatctgattggggtttttctaggctcctgcccatgcacaccgagaggaattgattggatcgacagaaacagaaccacaggagaagaagaaaggaagggaggaaaaaggaaaagaaaaaatagaaaggaaggaaaaaaaataaagatgggaattttctggaaaattcaaacattggaggattttgggatgtttggaatttttttttctggattggacactttggaaaattccaggaattgagctccacttccaagacccaaagataaccaaataactccaattaacaaacgataaaataaatggcggcgttattaatttatttagtcaaattaaaccctttttcatttatgaaattttcattaagctattttaggcgaataaacacaaatgctaaatttcaaaattaagaaaattagaagacacgaaaaacgggacgtgacagccctggtccaattcaatccaacatagatcagctggaatctcgaaggattgagctcttggctcaacttgaggaatgtaatgctgagcttgccttagagaagcagaagctagccgatttgcccaaggttgttgaagaacagaagtccaagctgaaagcttccattaagcatctagctgaaatgactaagtccttgaaggtgatccctgaaaccgatgctcaagacgcccaagcaattgaagaagtgatgcagattaggcaaagggctatatcggctatccagagatatattgctgagtaatcggcttgtaataggactgaaacacttttgtaatcggctttgaacttctggtgatgcctatgtaatatatcttctcctatgaacttgtgccgattaatataattttttgcttctaaagtccatatttttgatttgaagtccatattttttatatgcatatgcccccttaattttacaatgttgaacaaacattgagaaaattaaaaattttaactaagggcgatataacaaatatcggccatcacacatcggcacaatccaaccgattatgataagaaaaaaaaaacttagagcgatacaacacatattggctatcacacatcggctacacataacagattatgataaaaataaaaagtctaagggcgatattaatcatatcggccatctaaaggcgatgtcacaacatcggctgtcatgcatcggcacaacttaaccgaatcatgaattgatccaaacacttggataatatttcttcaaatacttcccattgagagctcgactgaaaacttctccatcaagtccttgcaacatgtaagctcctttacaaacagacttatagatttgaaacggtccttcccaattcggcaaccacttgctgaatttgttgtcacgggtcctaatcggcaagatcaacttccaaactaactcgccttctaaaaaagattttggcacaaccttcttgttataatgatgagcaatcctttccttatctcttgttaccttttccaaagcacgcaatcttgattgtactaattcttccgactcatccaccataagattatgataatcatcggctgacagctcatcttgtaattcaatccttcttgagccgattttaatttcccatggcatgtccataaaccagcttataaggaggaacttgaatcgaaccatgacaagccatctgataagcccataatgcctcagccaatcggttatgccattgctttggataatcggcaatctttctttttatcaacttaatcaaacttttattagatgcttctgcttgcccattagcttgcgcataatatggggaagaatttaacaacttaattcccatgctttctgcaaattggacaaactcatctgacacaaagatagatccttgattggttgtgatagtctgaggaacgccaaatcgatatatgatatgcactttgacaaactgaattgcatccctagaatcaactttcttcaaaggaattgcctgaacccactttgtgaaataatcggttgctaccaatatatatttatgtcatttgctagatggtggattaatccagccgatcatatcaattccccaacctctgaaagggccatggcttgatgataggattcatagccgatgctggtgttgtttgaattgttccaaacttctaacaatcttgacaacccttgtaatatctaaaacaatcctccaacattgtcggccaaaaatacccaactcgccgaagtaaccacttcatcttgtgagccgattgatgagtaccacagatgccctcatgcatttctcccatgacaacttttgcttgatcaatactcaaacacttgagcaacaccccatcaatcgtccgataatataattcatcctccagcaaaacatatcttaaagctttgtacctcaatttccttgaagccgattgagaaggaatttttaagtaattataaacatcatacctccaatcatcgactgtaattgtggcaacctctatatcaacatccttgaccatcggcttataacccgatgctccttgagccaaatcattagcctcaatattttgttctcgagaaacatgtttcaatgtcaccagccgaaaaccacccatcaactctcggcatttctcattgtagatcatcaatgtatcactcttgcactcatattctccagctaattgactaatgactagcaaagaatcttccatgatttcaatagcattggcttcaacttccttcaaaagttgcaatcccttgagcactgcctcatactcaacttgattattggtagcataaggtttaatcgtgtaagcaaactcaaaacatgccccccttggttatataataaccaagccgataccacaaccatgagtgcaaatagatccatcaaagaataatgtccaacgcactatatcaaccaagccgattg

SEQ ID NO: 19206 - DNA, 1793 bp, Oryza sativa
attcccaagcaaaacaatctctgtattcttttaatagctctatcaacttggttctaaattcagatgacaaattcttacttatatatgtcggccttggtctatcttctggaccaatatcaacttcttccaaatcatcggccgagatgaaaccttatccgagcttgccatcgagatcatctactgtatccttggtatagaaatttgaaccctccacgacgccctcaaagcaacaattggggctctccatctccaattggctatatatcacaatcggataccttagaaaatctcctttccaaacctttccagacaaacaatcggtactatctatctcccaaacagacaaatcggcattagcaatgctaactgacctgtcggctggtacaacttctatcttgtcaccttgccattggatcaaactctggtgcatggttgagggaatacaacaatttgcatgaatccaatctcttccaagcaacagactataggagcccttcccatcgatgacaaaaaatgttgtaggaacagttttgttctacatttaaaactcccttggtctctgaaggattaccaccaaaatctttgagaaccatgttagtcttaatgagatcatccgaattcttgcccaatttcgtaaatgtagcatatggcattagattcacagcagccccaccatcaaccaacatcttggacatcggcttgccattaacaaatcccttgagatacaatggcttaagttgccgattttctgtcccctctggcttctcaaagatagcctgttctggtgacaaaaccaacagagccaaagattcttcaactacatctgcatcggcatgggcttgactaattccaaattcagctggtaacacaaaaaccatattaaccgatgtagatgcaacagattttcctttagccaacctctttactttgtcagcctcaatctcatcggctgataccaccttgctcttcacacaccactcttgctttggcttagccttcttcaaccgatgattaatttcctcttgtacctcttggaattgctccctattcctcatcctttgaactcttctcttctggttcttggtgaaaataccagaaggacaccattgcttcttggttccatcttcatcttcagaatcttgaaaataatcttgatgaattggacctaatctctgatgaacaggcaacttcttctgaagcaatcaattttccctaggataggatcggcttgaacttgcagcatgtcccctgttagaattgctgcatcctggggatcaaaattgttatcatcccttcgttctagcaaaatctgaaaaattcgcaactccaatggggatcaaaactgttatcatcttcatagtacctttcttcctgccgatcatgctttctttgatacttgttgataatcctaacataattgagctgtttagaccgataattcttgctatcggctgttttcccacttgtacgaaccatgttcataggaaaaggattaccatcaaccttcatcggcttctaggaatcatcaaatttgatcttgccgttttcaatggccgactgaatctgctgtctaaataccttgcattcattggtactatgagacccagtattatgccacttgcaatatttcttcttccccaattcctcaaccgatggtaacacattattggctggaagttgaattttttctcccgaagtagcaaatcaaagatcttatcagctttggtgatatcaaatcatatttctcctcctttgcagaatttttcacccattgacaagtaataaccttctta

SEQ ID NO: 19207 - DNA, 2514 bp, Oryza sativa
gaaagctagatcggctaactgagaatctaacaaaaccaagctgtaacacctgttcctcatatctctaaatctttgaatataatcctgaacagattcatcatgcttctgcctgattgatgtcacatcagttaacttcatctcatgaaccccactgtagaagtaactgtgaaattgtttctccaaatcggccaaactattgataaaattgtatggcaaattagagaaccatgtgaaagccgatccagacaaagacaaaggaaacaacctaaccctcagagcatcattagccgatgcctcaccacattgagccaaaaatcggctgacatgttcataagtcgacacattatcttgtcctgagaacttggagaaatctgggaccttgtatcgatgtggcagtggaattcaagtccagtacgataatatcatgcaagtctaggttgcacaggcaaaaatgtacgataatatcatagccacactacgtggagctggtgcagctgaaggcacacatgccactgtctccgacgtgcaagcaactggcccatccacgacaagcggtgcaaactaggccgtgacggcagctaccgattccatcgaggcatgcaggtcaccaaggaggctgcaacgctcactgctgccacttaccgcatgtagccctcgaaggaggtaatccctttactgcaccataattttatacgcaactatcacaaagctctctgatgacacagcaaatgcattaccacgtgcattatcacattgtttaattaccttacatgcatttgttttttcagcacatgcatctatgtttatcttgtcaacattgcaattagtgggggtactctatatttataattattcctacatttattacatactaccagggacaccgaaagacaggcgacaccactaaggcggtcccccaggacagctacagcatcaccacctacaacaaagtcacttgttaccagccccaagagcactgatgaacacaaggataggagtacgtcgccaccaaaagctatgagaaggtcaccaaggtcctcgccggctagcaatgtgcacccatcatccccacagcaggcggacacgcaacaatcggggttggcattggaaaagggcacgcttgaatggcaaagccgacctgccatcagcgcaatgcaaggcatgcagaccgacggaggaacactgccataggaccaaggcggatgctcgattgatgcgactgcaggcattatacatgcaagtagcagccccgagcggtcgagccatgatccatcggcggcagccaatcctgccctgtcagcatctgcacaagaatacactgaagagggagcgcaaccgctcacaggtatggccatgttgcatgcatgttattcctgccatatatattcaccgagatgacctcacattccatcgcatgcaggctgccatgcaggcacagtaggccaaggcaatgatgaccagcaaaccattgatcctgctggagtgctggagaacacaaccccacagcctacccaggttacaagccctacttgtttctacacctgaatttgccctagtaatccatttactctaccctgatcccagcaaccatcacagcctgaacaaactactcagtaattgcattacccagacatgtttgctttcttgcaataatacatccgtagtactattagtaattgaattaccttgcacaattccagtgaccattttctctaccctgatgtacttgccctagttatccatttactctactttaatcccagcaacatcacagcctgaacaaactacttagtaattgcattattcagtcatgtttgcttgccagcaacaatacatctgtagtaatattagtaattgaattaccatgcactattccagtgaccgctgtagtccaaataaatattttggtaattgcactactctgactagaattacctgcttggcttgaagcaggtagtggtgtttcaagatacaggtgacattgggcagcacatcccctcgtcagaacctatacgctgtcctcgcaggtcggccaggtttgtttcaccgctcaagattggacacacacgccccctcccggatagcgcgaaagttgttgctcttcgcgaacgcattttgagtgacccggccaggtttgggaggtaaattttcctgttactagtgtacaattccacaactcttattttttaattgcgttatacattgggtcacgtgatacaattgtgtacaatgtagcgccaacatcattgaagttggcatatctgctgctaccgccagcgatattgcgtccttgttcactgatggttcaatgacaaaaggcctcttcatcgatgctttcataaatttgattctgcatgatgagcaggagtttagcccgatgtcagctggggaccgaatcttcctgccaaccagtgtatctgtaagttgtgatttgtattagcgtacatcaacacctaaattcgcacgtatgcatgcattttgttttccctttacactcatacacaccatgtgctc

SEQ ID NO: 19208 - DNA, 11386 bp, Oryza sativa
  unsure (1)..(11386): unsure at all n locations
aatggtatgttctacgtgtaggttatagtacctgttatacaccacagccactggactctgtactgcgtctaccgttaaccatgggcgcatagatgtctttgactccaacaattaccctgctttgaatacggagtacaaggatcaccatggtgacctagggagtcgtgttgtgaaacggctcagcgataggctctatgcagcagccaggactgccttcaagaggtttgggaaccagaagctggtcaggaacaaatgcccagtcatgctaaagcccaatgattgcgcattttttgtcatgaggtacatggagctatatgaaggcgatgactcccccctgatacaagtcgctgaatcggtaaaactgctacaaccatttacgttgccggggaaaacctttagccaccttatttaccctgctgaatctgttctcattttgtgcaggaggagtacaacgacttgcgttcgcagatgctgtacaacatggtcttccactccaacaatgttgctgcgcctctgccaccggaactagaagagctatgacccagcagcccctgcgcagactcaagtgaatgatcaatgcgtgtccctgtgatgttgccttgtggtcttctgttttttgaacaacaatgctattcatgtgatcccaagtacttgtaatggaacaacatactgttgctcaactagttgcattttgctttgtgtggtagccttagttccttcaaacttgctgttatgcattactgacatttacagtggaaggcccagtaatcgatttacttcatgcacctcatcatatcatttgtgattttaccctgtaaatcaattacttgagacacaatccatcattctgtcaacaacaagtttaaacagctaacgatgataataattgctttactatagattttagacgcatcataacaactcatgtaacctaattacaacaatctctctgccgagcacttcagttcttttttaatgcgtggaaattgaccagtaattcgttaactgtgttatgccattcagtgtgcatgtctcattaccatccttggcacacgtagtaaatggattaccatccttggtgcacgtagtaaatggattaccacactactgtcatcactttcatcacccctatcggttctttgcaaccaaacacgataataattcaattaccagaagatctcccccacacccaataacctggagtaatccaattacaacagccccacatgcgctttcatttgttttgcatgtgtccactgatatgcaaacccacaaagtgtataattccacaagccacacccacacattacacacagcacccaaaacgtattcaacgtcctgttttcaacaactgtgaaaccatctacacggcacacatttatattctgaaacctgctattatcaagctggcacttaaactaacatgtactacataacaaacatttgatgttaggttggtggcttaacaatgctatttgcacgttacacaaattatggcacatacgtcaatatggacagtgtggagcgtacacatcataggtcggcgccacctccagaatcatcctcgccatcaatcatctcttcatcctcgtcaaccccataatccatttcctcttcaagcctcctcctaacattggctgaaacccccgctatacgcttaccgctgccccttggtcggcccctcttccctttacccctattcaacaccttctgtagcttgtcgaagttgttgggggttctttgggcaggtagtgctgtaatgaccatcctttttatgacaccacccacagaccctgttgcaaaccttcttgccctttgtgccgaggaccatcccctgtcctggttcggcggccataccctttgttcgcgacttaggaggtgcagttcggcttatctggctagcgaggtcatttctttccccctctccttgcattgttgtttgatcaacagcaatggatgatccagaactggacgggatgctttcgacatgtattctcaaactcttcaggcctttcagcgcctcatcatatgcgtcctatgatttgctcccagcttttgcaacagccatagcctcggtcatcagtacttttgttctgtaactctcttgcacaccgtccgaaccaattgtcttttggtcccttctatcgaagggcatgtcgcttttcgcttgcatagtgtacctacggagaatgtacttggccgggatggtctcaacctgcacgtggacaaatgccctaagcaagtgagggcagaaaattcttgttacaaaaacatgagcaagccaaaattagtgcgctcaaataaatagtctatctccactcgataactaaacataggacagatgtacagttccaccaaacctgtatgctcccaaagcatgcactcgcactcatactgcccatcatcaacatttgcaattactcggaactcccgctggcaccagttatattttagcgatctctttgtgtgcgagatgatccatgtgtcactggatgcttcacttgacctaattttgaatgacttgctatcgcccaacaccccctcaaatttcttgaatactgccctagtatatagtctcgccaactgcacctcgaacggccaacaatttgcaaagctgatttcggcctacatgaatcacatttaacactgttaatcactgcattttctatagttagtgacacgctgatagtttatgcgcacatatattgtttctttccatgcaagccgactcctctgctgcctccttctccttcctttatgtgaatacatcgagcattctacgcgcgaaccagtgtagcgctgtctggtggtcaacaaacttacgctttaccaatctgtttgtgctctcgctctgctgcgtcgatgtcatccgaccacaatagtcttccgaaagtaagctgggatccatttctcctggatttcgtacagccgctccattgttcccacaccatgtagttcatatttatcaataaattctgcccaggccccttcaaactccatcggggtatatgtttggtcaatacaaatctccatgtcaccctctaaatcttcatgacgggcgaatataatcgcgagggcatctgcatatttgtgaagtatgtgccacctgcacagtctatgtatgatgttcttgaaaacaagaggtatggcagctgccattgctacatcctggtctgcaaaaatattttactcatttaccacacaagttcaccatcatagtaaagtgcaaatatcattgcatactagtaaccacacaacattgcactttttgcttaatacattacctgttagtatgcatcatagttccggccaatccgccatgcaagtcttgaaagtattgaacaaccactcgaatgactccttcttctcatccctaagcaacgcacacccaaacaacgtgttttggagatggtggtttgaacctacaaacattgccaatggcatttcatatatgtttgttttgtatgttgtatcgaatgtgacaacatccccaaaatctgcatacgccgcctagcaacttgcatggctccaaaataaattcttcagaatgccatcttcgtcaagctgggcatcccaataaaactgagggttatctttcttgcactccttaaagaattccagtagcttgtttatgtcgtctgcattctcagctctcacattagcggctttcctgtttagtaaccaaattacaaaggacaatttatttcaacacggtgccacgatgtatggatgtttaatgcaattcaatcggcaaatgacatatgcaggatacaaatctattctcaagattgcgtgaagtgaatgggatgttctcttgtccaccatgcatgtcagcaagcactccaattaggctgttctgcgccaccctgttttcttgcatggtgttcacaaactccattatcgtgtcatccgtgtgcttatgggatctcatgtgctttaccgctgctagagagggcgtgagcgggtggttatgctcaagcacaacaacatcgtacacaacagacgacacctcaccatcaaccatcacatttttcaccttcatgtatgccttgcaaccagttttctttgtcctatggtttcgctcacgttcaaattcatcgcctttataaaatttatggtgcccctccctggagcaacatatttctcttatagtcttcttagttctactcttccttatgtcaaacccagcatggtaagcatatttctcatagaaatcatatacactgtcatagtctttgaacaccatattttgtttcggcaccatgtcatcatccagcccactaaactgcatttagtaaaactattactacccacccgtactgcatgcataaatgccatagagcatagatctgttcatccacaaaaatttgtccttacaaacaacatattaactactacttacatgggtgtacactgctggccgtgttggagtagaaatctcatgctcacgcagagatggtggcatacagttcgcatcccggccagtacagacgactgcccctcctcacactagctcattgtggtgactacctaacacacgctgtggcgatgcagatgttggcggcaattcaccaaaacgagcaccgctggagttcatcgttggaggtgtcactatgacgcttcaattggtcttcccaccgcatggaaccgcacccctccaaaattgtgaagttgccaaagaataaacccacccacacgcagtggcaacaaccgaccagatcgccaacacgaaacaatcttgtcataacttccgtagtaaatcaccataatacgataattcatttaccgacgaaaacgcctacttacaatgtggcagtaacccaattactgcattatgcgaaccacctcatcccgaaacaacagtaacacatttacaacaaactcggtcactaactatggcaaacaatttaactaccccgataaatcgattaccatatgcctagctgtgaaaaggagcccaattaacctaccaacgtaataagtaatccatttaccaccagaagggaatgggacacgtgtcggtaattgagttaggttagaaccccgtttttcagagtaaatcgattactatcgattttttacacgcagcggtaaatcaattacaacaaactccttcacacaatttatctatacagtaaatcaattaccacaagactggttgctagaaggggtccctatatccgacactaattgatttacacgcagaggcgtatctttaacaactacccggattcaaatagatctaatctacatggcacgaacgtgggcaaccgaacacggtttttgcggacactgggcttgacatgcggtgctcgaaacaatgttccgtgcgcaagtgcgctgaatagcgctaccgcataatatattgaatttcaataaggaaatttacagaattattgtttacatcttgtaacaaagaaattcataggcatatcttttaaaaagaaaaaagtacacattttcagcagcaagctctgctagataattgtgcaatatatctattcctatatcatcttcgcaaattccttcgctacttccttagatcttgaagtgggattcaagtgtcagaattcagccactgataatttgaatctacataagaaatttattattacacttcacaattgcaatgaaataatattggccatatattacttcagcatataaaatgctactatgaacatacatgaaacaacatagccatattgtccattgtctggcagtacttcacacgggtcttaccggttatcgttttgcttgaaacaatgatttgtaaccactttactaaactagttcaaagacaaacaaaagttgctcacagatctagcattaaagtgaggccaattgccacctgaaaaatagattaggagtactaatgttcatcaagattatcaatgatcctgttaagaatataattatctgatagtttcatcctctatatataagaaactggagaattctaattggtttttggacagatcattttattactaagcttcatgttctttctcctctgttctgtcaaccaaaaacagagtagcactaacctttgataccattggaaacccagtgtggtagtgtcccagtcatcttaaatatattcttgcaaacctgcttgagaggggaagaaagacgatgtagcaccaaagaatcaaataatgtattgaagcaagaagcattagtatttaagtccatctaaagtaaactatctaacgccatgtttgtggagtgttgactgtacacatcatgctttcatgattcctccaaacgtgcctacacaccacaataatttcctccatactacagtagaacatctatagtattttattttactgtatcagcaatagtgtaatacaagattttggaaaaacacagtgctcaggactacccaagtgcaatttatcacagtttgctgttgaaaatggaggaaaatagttcgaatggcacatttcttaacattgaaagctacagttgactgagatatacaaatcggatatcagtatccgccaccaccatatagaagaataaatgattactactcctacaatggaacgaatacattgggtaacatatcaaactttggagccacacaccatagaacaaaaacataatatgctatatatgcactggatatgtcaacagttaaacatcaaatatttttgcaacaggaacttcccaatatgcatgtgagcatgcacttctaaaagatcttactactcttgccaatgacagtacaacttctatcaatcatctgtgaaggaaaataaaaagtaattatgaccttttcctatatagcatttctccaataaattggaaaatacctatagaataattatgactaaccagagaaggctgcagccataattaccttgcaccaaatgatgtgctctgtgagttcttctcctgtgggtccatctttacaatcttgtgagcagtcacatatagtgatatagagttgctttgcctcattctctacacttaaagctgcagtgttagtttcttgtctcagaacatcattagaaaataatatgtctgttttacttaacaagtcatggaagaaaatagatgacatgcagaatagtagcttaagatttcgttcccagaatttaaagatatagctcatgttattttgaactttcatgcacaaaccacaacatgctgatccaaaatattcttcaaagctagtgttttatcaaacaagtcaacattttttttgcaataagaaatcaactcgtattatattggttttgctcttttggccctctgttgtgacctttaagtaatgatcagacataactctggattttatcgaacaaatcggtccatatatactgcctgcttgtcggagtcaacaacttaatccccttgaaaaaactggctagctgcataaaaagctgttctgttgatggtgatcacccaatgcgtgcatgaagctgaaagcaataagcactactaattcacagatttagggttttttttttgtggatgatcatgttggcaataagaattttgcaatttcacgtgatcagataaagtatgagaggtgtgaagaaaacatcaataatctgtctaaggacaaaattttccttttacggagctggcatgcaactgtacacagtgaagcttctcaaacacatgatgtgcatatctgtgacagagaacaagccatccactcttactgaagaagaatttagtcaaacagtacataaaccacaaaaagggttcctttgggttcttgtgatgtgctcaccatgcgtacacaagaaggatgcaacaatcatacgtgtctcgaccaggggcggatccaggattttcagtcaccggtgtcattaggtaaaacatattttattatagcctagcttgatatagttctagatccttaatcgatgactggatttgaagtgtatatgttaaactataatggtttaaatttttatagtatttcataaaagattgggaacaaaataattcatcccaatattatcaacataatcataaatctaaatcatatatttatgaagcttagttatctataatgttctacacgtgttctaacattagtgaattactagtacaacatagaaatagatatcactgattgataacaattcgagcaacttaccatgtcttctaagtattaaaaaacatttttgcaaaatttaatgcatacatgtaagctttttatctgttgcgcactatttctataccttattattctacattgttatctattaaacctaaaaagaagtaatgacacatttcaccgggttaaattactaattgtttaacatatcagaacaaagtaaagtaaccaagcaagttagttctaacaatcacttagcaaaactatgagaagttgattaattaactaaaggaaaatagggtgtttgcacgtgtaatgctaacaatagcataactgttttgctttcataaaacaacgcatgtttttattacctgctaattgcatgagctgtagtgaattggtcaatctaccggtgtcagtgaactttcatcgatggtgtcattggctaaaaacaaatagcatcgtgtaggatttgcaaaagggcgtcggtgtcagctgacactggtaggaacaccgtagatccgcccctggtctcgactctccagcaatcagatgtgtctcgatcttgcatcctgcaaataccatgaagaaagggatgggtgagacaggctagatagatggccagttctggggagagccagcgtgtgcggctgagcactttactccttctcccccttcctccgttgccgccggcgtctatagtccctcgacatcgctcacggttcacctgacgagatcgatgtcgctccaccgatgaaaactcccctttctcccctgccacctgccaccatgggggctgcgacgagccgtcccctttctcatcaccgagatctgagtagttgagaataccagattgcagtagatgggaagcataaacctcggttgctcgggtgatgactgatgaattgtgggttcctcctggagttaagaaggtgatggggtagttggtgttggggcttattattaggggtgaaaacggagcggatattatccgatccgatccgctccgaatccgtccgatgtgaggatatggtaaggatttttagatattcggccggatgcagatgcggatgtggatatggtatcaacgatatccgacggatgcggattatccgatattttaatcggattatccgatgtactgtttggcggataatccgcaactttcaggccacacaacaactctatttagcccattttacatcggacggcccatctagcccatctagtgtaacctaatccaatcctcccctaaatctctctctctgtgactcatctcttagtcccttctcctgctcccacacgcgctgccgcatggcaccattaccataggtgcgccgcgccgccgttgcagcatgttggcgccaccgccgccgctcctccttctagtccgccgacagtgtgttgtgtgttgtgtgctgtaagcagtgtgctgtatggaactagtgtattgtgtgctgtatgcagtgtgctactgtgttgtgtggctgtgtgctgtatgcctagatagctgtatgcctcattgcctcatgcgtgtcgtattgatgagtgaactactgatctactgaactgaacactatatttttaaattttaagcaacacagtgaactgctgaactgaacacttatattatgtttttgatggatgtgttatattaagcaaaattatattattgatgtgttttggttggtttttcctagagagctgaaatcatgttcatatgttgttttgccatcgtattgcggctaattgtattgccgccctcttgttgtacggattgaatacaaacttaacatccgacaactttttgtccgtttccgaaccgagtccgcaccgactccgcaccgaatccgacgtccgaaataatccgctccgcatccgcatccgcacgtcatccgcacccgctccgcatccgcttaaaaaaaggtttaggatatggtatagctattatctgtccgaatccgctccgttttcacccctacttattatatcgtgagctgaaaatgtggagataaattagccggttcgttagatgtgaaattttggcggcagtctctagacggaaaatcgagattggcgggaagtattttcatgtaaattgctcataaaaaatagtacggtatttctttttcaaaaaactacgagagcccataagttaaaaaaattggtccacatgtaagtattaaattaaggtaattttgattttgtttatatatataacatgagatttaattctacattcttgtttttgagatggaagtttgatcacaattcttttataaaatataaatttatagaaatataataagtttatgagattaagaaattactttcaaaacaaaaatgtacatgtatcatttgttatgtgtgcaaactatcattttcatttatatttaaagttataataatttagttggaacttgtctaaaacattatatattttcttgatcaaacgtattaaatggtaaacacatccattaatttaattctatgttatttgactttaccatgctctactgtctcaattggttcctcgtctattggtctatttgagtctggctatcttcggttcctcgtctattggtctatttgagtctggctatcttcataaatagcttgaagtgcgagtacaaacatctcatcactacttacttcctatgcttttcacaatcaaacatagctgtctctattagacactagccatccaagtcagccttatgtcttcagcgtcctacgtgtaagctagggaaaccacgtggctacaaacatagcatttaatggaagatgatttttacaggttaaatgaagcttgtttgtggttcgcatattttggcttaaatttcattatcaaagtgccctctaaattctttagaaaattaataaaattgctgctgatacgaagttaattgtccatcccatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19209 - DNA, 641 bp, Oryza sativa
  unsure (1)..(641): unsure at all n locations
nnnnnnnnnnnnnnnnnnnnnnnnnnnnnnacgcttacgtacgccaagtacggcgtatggaacgccattttgacgggatagagcttcggcatgtgcccagacgggataacatgattgccgacgaactctcacggctcgagtcttcgcgagcccagaccccaccgggcgcctttgaagaaaggcttacccagccgtcggcgcgacctaaccccttaggggagacgggtgtgcctgaccggcccccgaggcccgtcggagtccaggcctcgggacccgaagggagcgctccaagctcccttagattgattgcttgcatctccgagatccaagcatacctcacagataagactctacctgaggaccgcgaagggagtgaacgcgtccaacgcatttccaaacgctacgtgctggtagaagggaccctctatcggcgcgcggctaacggaatcctcctgaagtgcattcctcaggaacaaggcgttgagcttcttgccgatatccatgaaggcgagtgcggagcccattccgcctcgcgcaccttggttggcaaggcttttcgtcaaggattctattggccgannnnnnnnnnnnnnnnnnnnnnnnnnnnnnnnnnnnnnnnnnnnnnnnnnnnnnnnnnnnnn

SEQ ID NO: 19210 - DNA, 16653 bp, Oryza sativa
cgaaggcataaatattgataccacttcagcagggactaggctggaacaatagcgatcaccctaatatgaagtttgtttttccttttcataaggcaatgatttttttcctcaaacatactttactattttttttaaagttattatatgtctactgagaggtagactgaacttcatagtgataaagactaagaacaagagtacatcagaagtgtcaccatcaacaatgtagcttataagcttattatttccttgtaagttttaacaggaaagtgctttataaaattgactagaggaatcccagattcaaccaagtatattcttctagatgcagcgcaactaacagtcaagatatacaactggctagcaagtttggccatgtcaaaactgaacttaagatattgctttttcattcagtattgtcttctagagatccattttaagaacacacagaaacacagtcaatcacattcattgctgccttcaacataagatggtcagggtagcttcatgagattggtttgcctatttacttgggcaatgcatggtcatgaggttttgcttccatatatttccaaggtggtcagttgttaaaataaacccttcttttttactaaagcttttcttcggggatactaaaactaattagctatctcttcaaactgtgcagccataaactcccaaccccgtcatgctaacattagatagcttgataatagtcccacagctgataaatttctgcggagacaacacagaatacaaagtaatcgagaatagaaaaggaataaaagaaaagggatgaacaacctcatggagacgatccaaagtggggagcgcagaggaggcagcctccttcttcttgctcttaggctttgatagcagtttcttcagcatcttcttgtcacacccacctctggattcttactgtcagatgatgatggcctatgttaggaaggaagaggtggatgattaatggctaaatctgtatggtcgttccagtagggtgaaagaccaagaggagtcgaggggaaagtaaaggaaatggaggttagagtcagattcgttgagaattgtaggaagaaacagcagggatagctttaagcctttaagcatgtgaaggaagataaaagtggacctgtgcgcttacgaaaaagaaataaggacagtttcaatgagatcactgtcttgagatacttgctccatgtttgacagtttgcctatgtgtgaccactttttgttcaataggtttttatttctggaaagatactttcaatgctaaaatcaagccttgttgttacaagtataaacaattgtaattatcaacttgcttcctaaaaacactaaggtcttaaaagcatgtgttgtacactaaagactaccgcagatgaaagggaggaggtatcagtcaagataaaatatcaaattcactatgtgaaatttgtatatattttgttgaataaatttcaagcaaattactttgactgtgactattctactgccaaaagaggggtataaatacaacacaagaaacactttcaactttctgatgacagagaactgtagtaggttatgttggattaggtgtgccttgcatatcttggcaaatccctgggctccacgttcatgtggttagttgaatgtactctacaaagcttgttgtgacaacagcctgcacctctctgagactgaagtctgaacctaatactcatcccatcatttttcttacttgaaacaaattaagctcttaagacaattttgtaaataatgcgcttctctttttaggacaagtagttgatctgccattattcgtcttaacaaatgatgatgggatgatacaagatgctgttggtgtctttttaccaaagtgggggggtgaactgcagcttgataaacttcacatacaactaaaaggcaaacaaagaagtagtcttgctccatgagttatttttcttgaaaggattgaattgatgccaaatggagtaaaattccaactcctacatggctaataataggctaatagcatagaagaaaaggtcttagcgaaatctggtcagaaccatcaccgtgtacggtacagctacgaaagaacagaaacgtacatgtatgctttagaaaattcaattctccacattacataccaacgaaagctacggatccacttgctcaaggactctcaaatccccccagacgagtgcaaacctgaaaagaaacgcgtaggctcacttggtatgcgaacaaacgaacagcaaatgcagcagcagcatctctccccgaccttaagaatattgggaaaagaaggggaagaaaaactccttacccccaggcctgagcggagcataccaaccttacctaccaggctaccatcgcccgcattgacgacgccgagccgtgcggccgcaccctgcaccgcccccggaagctcaccgccgtttgtggaagtggaactcaaccctgaaagaggcaaactgcttccggtccgtgacactgccggcaacgatggtgatgccaccagacaaatcaaacggcccaaaatttccgaggaggagtaggcctttgtgggccttcttgtaagagagacccattagaactattttatatatatataatataatgaaaatatattacatctctggccttctactcatggatacacagccaacaaatctatctatctatctatctatctatctatctattatattattaaaacagccttgaaagaaggcaccacgttcgctgtggaggctagaaatttccacattaatcggagaaaaaaaaagagtccaagtagaaacacaatttaaaaataactgaaattcgaaattaaaaaataagcaatattgaaagaagagtccatataagagcccaatacgagattattcaaaattcagaataaaattaaaataaaatccaaaattagaaaagaaaaggagagtccaaataggaatacaatttagaaataactggaattcagaaataaaaacaaggaatattgagaaaaaagtccatataagaacccaatacgagattaattaatattcggaataaaataaaaataaaatccaaaattagcaaagagaaaagaaaagttcaagtaggaatacaatttaaaattaactacaatttggaattaaaaataaaaaatattgaaagaagaatccatataaaaacccaatacgagattaattaaaattcagaataaaaaataaaataatattcaaaattagaaaaactaaaagagagtttaagtaggaatacaattttgaaacaactaaaattcaaaaataaaaaaataagaatatttaaagaacattatacggtattaattaattaaaatttgaaaaaaaaataaattctaaaattagaaaaagaaaaaaagatttcagttatgaatacaatttataaataactaaatttagtgacaaaaaactattgaaagaaaataccatctaaaacacatgacgagataaattaagtaacatgtctacaaaggagtagagtgttggcggttgatacgacatataaaaactgttaataaaacaccaaatagaatcctaatgacgattaaaaggagggacgatgggcaggccatgaagcaaacaggcaaggcggttgccgggacttctagaaaataaaaaaaaaataaaccccaatgataatcatattcgatttttaaaatcttaatgacaataaaaaggagaagcagcagccgccgacggttggcgggacttctagaaaataaaaaaaaatgaattccaacgatagttatgttcgatttttagaatcctaatgataataaagactaggtggcggatgggccgtagaggagtatagtggcatcgtttgatgggacttctaaaaattataaaaaatgaaaccctacaagacagtgaactataaaaactataaggtccaatttttaaaggttcgaaacttctaaaaagtaaaaaaaaaatccaatgataataatattcgattttaaaatcttaatgacaataaagaagggagacagcgggcgagccataaaagagtacaatggtaaagccgctgacggtttggcgggacttctagaaagtaaaaaatgaacccgaatgataattatgttcgatttttaaaatttcaatgacaataaagagaaaagacagtggacgggccgtagaggagtataatggcggcgtttgatgagacttttaggaattataaaaacgaaacccaatgagacaataaactctaaaaactataagatccaatttttaaaaggttccaaggagaataaatgataatagtagatcgagcaagcaaataaaaaaggatatgacataagtaagggtagtaactggtgtgacttttcaaaaactatttaattagaaattcggggatgagaagatttgttctttcaaagtcttaagacaataagatagctatttaaataattttaagtaaaatcatacgaaaaaatatatgattttgtttgggtgctagtcgcgcaattacgcgggccacccagctagtttcagtagaaagaaagaaaacacatccaacaagtttcagaagttaaaaaaaaagaattaaaaaagatgtgatgggacaaacccccaacttccactaataaaagtatcaactgaaataacgttttcaaaatcacatagattctagcataaaatttcgtaggtactacaccatccaaactggaataaaagctccgtggctaccaattccaagagtgcaacaccagtacgcatagcatcatgttgttcctgtgaaagcatcatacaccaagagtgaagtcgattggaacacataaagataacctacataatggtagataatttcttatggttaaaaattatcgttacgacaacgtcagattgaccaacatagcgcactagttccaaataaaatcattattttgtggccctaggcactccccttaggttgtgttcttttgaaggggttggtaacctccatacataaaacggagtgatagattaacacatgattaattaagtattaactataaagaacttgaaaatgtattaatatgaatttttaaagcaactttcatatagaaagtttttgcaaaaaattgtattgtttaatattttgaaaaacgtgcacgtggaaaatgagggatgtgagtaagaaacttacgggaaagaacacaaccgtagccaattacccaaaatattttttgcgttgcggggagagggatattaaaggcaaaggatacatcgccaagcaaaacatgcaacatgacagtaaaaaaaagatgttggagtaaaaaataaacaacattacttgttcccctccattttctctatgtgagattatctttcgttaagattattttttgtgaagcaacaacgtaaacactttgatttttagtggtaccttgtacctcccattgtggtcctttgataggcatgcaacccatctaaacctctacatgcagaaatccaaaaatagcacactcctctttcccttccctcacatcgaacgagtgatcgatggtgtatcttatcactcctcccctcacctcaccttacctgagaacaccacccattgccggagttgataccaaacaaggaattcatcaatggcaacgcatacggtgacggatccactagaggagctatggaatcacacaatgtcgatggacaagacgcacctgatgtgcttctacccgagcaagatcaccatgggtggcgtctggacgggcgacaacccgctcgacttctccatacctctcctcctcttccagatcctcctcatcacctccaccacccgcgccgccaccctcctcctctcccctctccgcctccccacctacatctcccagatcctcgctagcttcctccttggcccctccatccttggccacctccctcacttctccaacctcgtcttccctgtccgtagcctcttcgtccttgagtccatggccctcctcggcctcgtctactacaccttcatcgtcggcgtcgagatcgaggtcctcgccatcacccgtgccggcatccatagcttcggcttcgctgtcggctgcgcgctcccgcccttcctcgtcggcgccctcaccggctacgtcgcgctcagcactgacgacaaacgcaagggtgacactttcctgaacaagctctccttccccatcttcctcggctccaccttctcctccaccgccttctccgtcctcgcccgcaacatcgccgagctcaagctcgccggcaccgacgtcggccagctcacgctctccgcatcactcatcaacgacaccttcgcctggaccggcctcaccgtcgccacggtgctcggccactcgcgctgcaccatcacgcagaccacgtggacgctcacgtcgggcgtcgtcatcttcggcgccagctacctcctgctccgccccatgctcctgcggctggcgaggcgcgccgccgagggggaggcggtcggcgaggaccgcgagtgctggattctgatcggcgtcatggttgcggcgctggtggcggacgcagggggcacgcacgccatattcggcgccttcgtgttcggcctcgccgtgcccaacgggccggtcggggtggcgctggtggagaaggtggaggacttcgtggtgggtgctctgctcccgctcttcttcgccctcagcggcctccgcaccgacaccgccaagatcaccaacatgcattctgccgtgctgctcatggtcgctgccatggtcgctgcggtcttgaaggtcgccgccgcaatcggcgtcgccggtgtgtttggcatgccactcagtgacggcacgtccatcgggctgctgctcaacaccaaggggatcatcgagctcgtcatcctcaacattgcaaggaacaaaggggtaatccattttaattaatcgatcgccatgcagtgcattgcatgtcgtgattaattaagggtaggtagcttcttgtgttgtgtagatcatgagtgaccagtcgttcacggtgctggtgttcgtgtcggcgctgatcacggcgatggtgagccctttcctggggatggtggtgaagccggcgcggcgcctcgtgttctacaagcggcgcacggtcgcgtgggctcacccggaatcagagctccgcgtgctggcctgcgtccacgtgccgcgcgacgtgcccgcgctactgacgctcctcgatgtggtgacgccgtcgagccggtcgcccgtgggcgtcctcgccctccacctcatcgagttcgtcggccgctcctcggcgctcctcctcatcaatgcctctgcgccgtcgtcgtcctcctacgacgcctccgtccacgggcgcagccacacggagatgcagttcaagcacatctcccacgccttcatggcgtacgaggagcagtcggtgggcgtgtcggcgcgcaccatggccgccgtctcgccgtacgagtccatgcacgaggacatcacctccgccgcggagaaccagcactcggcgctcatcctgctcccgttccacaagtaccggtcggtggacggcggcctggaggtgtcccacccggcgatacagccgctcaactgcaacgtgcagagcttctcgccgtgcacggtgggcatcctcgtggaccgtggcctcgccgcggtgccgggtggcgggtaccgcgtggtggcgctcttcttcggcgggagcgacgaccgggaggtggcggcgcttgcgacgcgcatggtgaggaacccgaccatcgacctgacattgctccggttcgtccagaagggaggaagcttcactgcaagcgagttcgacgcgctgaaagagcggaaggccgacgaggggtgcctgcgtgacttcctagagagggcgaacgagggcggcggcgcgacggtggagtacagggagcgcggcgtgttcaacgcgagcgagatggtgggggagatacagagcgtggaggccatggggaacaaggacctgttcgtcgtcgggaaggtgcccggggggtccgggctgacggcggggatggcggagtggagcgagtcgccggagctggggccgatcggcgacctgctggcgtccaaggacttccagacgacggcgtcggtgctggtgctgcaggcgtacgggaggccggtggcagtggtgggagctggagcgggagccatgtcggtggattttggcggcgacagcgtggcgatggcggagaggacagccagtgggcgtaggccatgggcacgaccgggtgtatgatcatcgatcatcggagaatttttctttctagaattggtgaccgttgagatagatgtaggaatagctgataatatggtgtggataattgcatattatggtataaaatttatacatagtgcaaagcttaaacatagttcttggaaaaataaagctaaataaccatatactagcatgttgttaatcaagcagtcatcactgcggtgcaacattttgttatttagagggcctgaggatgagaacaacgcagggaggtttggaaatatcagaagaaactcaggatcagtttcactttcaaaaatatttgtaaagtactacagtagtacgaaaatgacatttcacgtgtataatggtatgcacagcatatcgtaggcctactaatttcaggcccaataaaattggagttcaaaacaaaaaggaacagtggcagatatgggtccagatacgcactgggcttaactcaaattcttcagaataagtttacttttactcccttcactaatggctgaatctgtttcgcatataccgggcccccaactattaaaaccggtgcattttatctcccttggtggttttagagagcggtttcgctgacgtggcacctacttgacggtattgaccgggtcttcattccacgtggcgttgatgtgacgcttatgtggcattaaaatcaaaaaagaatgtgcatgacttatttgccattcacaaaaataatattgtggtacccactgacatgtagggcccacatgtcatcttctctcattcccttcttcctcctccccctctctcttatctctctctcccccggcctttctcttcacctggccagagcggcggtggggatggcggtgagttgtggcggcaatggtggtggggacggcagccgccgcgggtgggggaagagagagcttgcctctgcggccgccacacggacgacgtgggcagagtcgtggctgcgacatgccttgaggggggagcacacggggatggagcggaggtagagcgagtgtccactcgagcgagcggcgccatgcacgcagctgagggggaggaggcggcggtggcaatggtggtggggacggcagccgccgcgggtgggggaagagagagcttgcctctgcggccgccacacggacgacgtgggcagagtcgtggctgcgacatgccttgaggggggagcacacggggatggagcggaggtagagcgagtgtccactcgagcgagcggcgccgtgcacgcagctgagggggaggaggcggcggtgtatcggcgcgagggcatagggggagcacgcagccagcctgcacaccatggcggcgacaaccgctgatccagctgtagaagaagggcggtgggaggcgcggctccacccaatgcggacgtggcgcgcggtaggagatgcgggcggtgacactgaggaggacgttgtcagggaggtccccccaccttacccaatccatggcggccaccatcggatgccgccgtcttcgctccctgccacacccgctctccgcttgcccccgccgcccttcctctatccccgacatgctgctccccccaaccggtggcaaccacccaaagctccccactgccgtccccaccatcggatgccgctcctgaggtttcgaaagcataactggtaaaaacagttgtttggccacccacggaaaataaaaatataaacttgaaaaggagtttcgaaataagctaacaatcagacaatgagaggagcatgcatctcaagaatatcatctctaagtactagagcgacacgtttgtctttttgaaggaaaatctgagaggtcgtatatattcattccaggtcggtcggtccactaatcagaccagcatcatcaccagcttgtactttgctatacatgcgaatgaaaggaaccagtcaggtgtggcaacctttatattcgtgactggatatcatgagatatgatgcttcatcgatcgatcgacggcaggttccagatcgaaaagaagaagcagcaaatgcatgtgttccttttttttaaaaaaaaatcgattttatggggggtataaattaccggtacccaaaaaatatcacaacaaatttctgaaccttatatagcaggtggcttacaaggttaattatatggttagcttaattgcatgggttggtacatatatatttcttgctggactctatgcccagagcttaatctaatggttacgattaattaatatacacacgcatatatagacttattaagaacattttactatgcattatatattttttaaatagacgggttgtatacaagcctctcatagtagctagtgctaattaactagttggtatgtactgcgaaatagcttggttggataccaaatttagtcctacgaatcatttgataactttaatatagcacggtacatatttggattaaggtcaacctttgccccaagtcaataataattttagtagtgccataacatatctaagattttgcactactaaaattttacgagggcactaacccaaacaggcactaacattatttacaatgacatggaggatacatatatgtatagctattgctagctactaacaattagtactagtaattcctaaatattataatatttatacattggaaaggtagttgtcctaaaagtcatatttaagactaattaattgtccaatccccaactgatcaattaatctatgatgcacaagagtagctactagctagctagatcgttcttggcaggaagagtttacatgggtggagacatgaagcacgcagtgtcacatggtggcaggcaggtacaagtactatggtacacagagcgcaagacgatcgatattattccaaagggcaaagcaagtatacaaggggaaagctgcagaggagagctcataccaaggtggtgtggactagcaacggacaaggggaacacgatgcatgtacgccaagcgtcgctggcatgcgactcacatcagatcagtggatcgagaattaactacccatctactgctgcctgcctgcctaaccagcaacaacataaccctctcgtgaccatctcatatacagtaaatccattaacatacacacaggcatatgcgttcatggttaaacatggtatatataagaaaccacatgtatttaatttgtaatgtttaatacttaattaatactgtgttgtgtgccaatacccccgagcaattggtgcaagcacgctctaaattctagccctcttgtagcggcgtcctagtttctacaagttggccacgtcggagtgtctaggggagaggtgtttcatcttctctctcaccttctctccctaaatcgtgaagtcttggatagagttgggttttgtgttgattgtataggtcgggttttgggtgatctcggcagtgttctgttgttggtctagcggcggtcgatcacgcttagcagcggccggtccggtgctagccttctcctggatctgtgtgttgacgctgtcgctgtgtgggtggtggtataattttttttcctggttatgaccttataaaggattgtaatcttgtaattttttcctgctctatcaataaaacttcgcaccgtttagtgcgagtcgttcaaaagaaaaagtcattgaagtataatctcggttactattttatactattgagaataagtttacaaaacctaataagtttattatgagatctcaaacgtacttaagatcggatgaattgtatatttaattgtttatacaagaacaacaaatacaattaataatatatgggcaccatatcgatctagcttggctatcctgggtagtcgatatgtgtcataagggcaagcacgtggcaccactcaccctttttagccgactgtgcagtttaggtgtgattataagttactccctccgtttctaaatatttaataccgttgatttttttagcacatatttaaccgttcgtcttatttaaaaactttggtgaaatatgtaaaactatatgtatatataaaagtatatttaataatgaatcaaatgatagaaaaataattaataattacttaaatttttttgaataagatgaacggttaaacatatttaaaaaaatcaacaacgtcaaatatttagaaacggagggagtataaatatctattttcgtagcagcgagattactagttccagtatttcactaagtggagatagataatattttttaagaacagaagaggtagggatgggtcgaaataaataggggcatttgaaaatttataattggtatttttaattttgtaacaatttaactcgaatggatgacaattctagcggtattttttaattttctatgatattttcgtaataacgatttaaacgagtggtaaatttataattgtccaaaataaataataaagtgatcatgatggtgccaatgatcaatctcgagtcaggccagggctaggacgactggaggatgtaagctatagggttgaggtgacgctctgttggggcgtgaatgaccgatacacctgtagtatgtatatatgcgtgcgtgtgtcacagcttgcacagtagcagtgtcgcgcgactgccactgcacgctctggatggacttggttctgaccggccggttgatcgattgggtgcatatttactatgcattggtcattgcacgatggccagtctacagtacgataactgatcgatgtaagaagccaggcacacgcatgcacgtctgtgtgttactactgtacaagtgtagatggctatgtcaaagaatattgccacgtccatatataagcctagctacgtacctagctatatgcacgcctacctaattcgttataattgtgtagtaattccacatttatttatcctgtgaactatgtaataattgattatatttttttaagtaaatgtcaaataattgattttcattttccaaaaagaaaaatatggattatgactatgaactccaacatgcctatccaccactacctgcatgtgtttcgacagtcaggatttatgcacgcctgccggaacaggatttatgcactacgtacacagtagagtgactcatgagctgttaatttgctccaattaacaagcaaattgctagcaaaattagctaaattcgtgccgaagagttgtgttgtacttaattgttactggtgtatcacgggacatgcatgaaacgccagaagttacactatagcaaacagcactcccgatgttagtttccttcaagaaatgaaacattatatcgatcgatccatccatcgaaaattcgaaatgatggatatgcaaagtgtggtcgcaggtacatgcacgtgatagttaagttgtagtatacatatatatagtccatatatagtttgaacttttactgcttgtcgcccgaaataatcggcattctgtcgacgaccagcgccctgcagggcggtgcacgctattcagatcgacattatatatataatatattcatgtcattttctcacgaccctgccagtaattaacgtccgttgatccacggcctcttatcgattcagctataattaaacttcactgtcgatcatatacttattcaatccagtatagtagcagcacatatgcatcattctcaatcgatcaattagccattaattgtcctaagcatgcagtagatagatatatatcgatccagatatgaatgatatgtggaaattttgtagtaataagaaacggcgtatatttattttttttcaaacggtcagaccgttgccggcgttttatataaaaaaagaagttgttttattttgaggagaaaacgcgtgaccaaaccttacagtgcatagttaattaaggaaaactataagaaaaccacaactactagaccaaattaatagaaaatgacaaatctaaactacaaggctacgaaaaacagaaaaagccaggttcaaccaacgctattcaccataagccttgcaaaatagtagcgagctggaagatcaagcaaggctccctacacgggcaaacgttgtcaatactacaacgttttgaattcattttttaatttgtttttagaaagttttcagtcgattctagttttcatcggatagtagccttaccgtattcgtttccattctagaaaaaatctgaatttatttctgtttccaaaatttccaaaaaaaaaaattctaaccgatattttccatttctaaaaacatgtgtctgaaatcagaaattttctgaaccatttttaaccctaccctaagctagttaagtaaaaaaaagacgagatttggagggacagatgtccctcccgacacttcttttaataaaaaattatgagtgttttgggaattgaagacggaagcttaaggttaaaaccacacggctagttaagtctagctgcttgtattgcatgcatgcatcaaaacttacgacttacgagagctaaacaacaaagtaaaatgcatgggggatattgttaatcacatgtcgcaaacgtgcaggagatgacgaaggtccatgcatgcatgcccggccagctgctgcatactccctccgtccaaaaaataaacaaacccttatttccgtgtctctaacaacaatgaaaatataaattataaaaaaatttcatataagacggacaattaaaattggacacgaaaatccagagtttgtcttcttttttttttacggatggagtattagctattcgctaattgatcaaaattaattattaaatatatatccgcaccgcacatcgatcgatctggtgtacgtctgctacatctgcatgtgctagcagcattatttgttgatgtatgcaagcgtcgcattcgtatcacaaatttcgcatggaatcttgaattcttgatgcattatactccctccgttttaaaatgtttgatgccgttgaccttttatcatatatttgatcgttcatcttattcacaaaatttaagtaattattaattcttttcctatcatttgattcattgttaaatatatttttatgtagacatataattttacatatctcacaaaagtttttgaataagacgaacggtcaaacatgtgttaaaaagccaacggtgtcaaaacatttcgaaacggagggagtatattgttgcttgtcaagcatatatgcatgcattgatatgcataccctccgatatggatactctcgtgatcaagtcgtttgtttcgtagcaactagcaactccagtttgtatgtttggtctgatatatatgatcgtacatgtatgctgattgctggatctgatcccatttgcccctttcaagccttttccatgtactgtaccagtactgtacccccagcctggctgtttccaccccttgatcgtttcctatccacaattccacacaccaatcgcctggcttgaatattatgcattttcatcgactctggttgctgctcccccaaaactagttactagctactcctatatactctctcatgtttttacttaagctttgtatttgattgctatacatataccttttccgctggtgtttcccccttgtttggttggtgccatgttctagcaaagctttttgatgaatttgtttaaaaaatatgctacataccttttccaattatgttataatgaaacataaaaatgcaatgatctaaaaataatagttccaatgataaatcttctaatatcattttcatgtgatgaagatttagttttactgtatgtaaaatgtccacgcatgttttaattaaaaaaatacgggaaacgagaaaaaattattagcatatgattaattaagtattaattattataaatttaaaaaataaatttatatggttttttaaaacagcttctctatagaaaatttttataataaacatatcatttaataaattaaaaaacatgttaacagaaaacgagaaaattgaagttcatattcagctatagtaatccacagtagcgcatctcatagacgtccaccccgtcgtggcccttttcctctccggcctcttaatctcccactcccttcatctcttaatatgaacttcaccttgaactgattctgtcgctaggctatccacctctctcccctccttccctactccctattcttatatgaaaaagacattacccccatccttttcaacgtacgtaaaaaagttacctataattaaaattatatatagtaaatattaaatattttctttgatgattgttataagtggcaagtaaaaaaaaaccttttttttaagaacagagttcctgatgctaaggccatgtacaacgcgtgaccctagcttgtggtctcaaacctctacgtcggatgcgcgcacccatggcagtggggaccgtggctctgcaagccgatcccgcgcttgcagaagaaccgcccgaagcgccgcgcctgggctcgggaagggcgaagccacggtccaaggccacgcgttggcggagccggagccccgtgcgtcgcctcgaccaatccccagatccgccg

SEQ ID NO: 19211 - DNA, 532 bp, Oryza sativa
atcactccaacctctgcatccgtcctcacataaccttccggctggatgtgtctcctccccttctcttctcttctaaggacgcttgtcatttggtttgggcccgtcctaatccaggttgatctcatcctgagatccttaacttaattacatctgcaaagacccctatccaaataagagcactgtcttagtccgcctgggctgctatcacacatgccgcagactgggtgtctaaaagaacaaagatttatttctcccagttctagaggctgcaagtcccacattaaggtggcagcatggtcagattctggagtgggcccttttccaggttgcaggctgctagctttacactgtattatcacagggtgaacagcaggatctccgatgagcagaatgaggctcagagagggtgggcgacttgcctatggtcacacagcaaacagctggaatttaagccctgctcacgagtagcccctgagctcaaactctctgtgactctgcgactccctggaagacccacccgttggagacccac

SEQ ID NO: 19212 - DNA, 342 bp, Oryza sativa
  unsure (1)..(342): unsure at all n locations
nnnnnnnnnnnnnnnnnnnnnnnnnnnnnnnnnnnnnnnnnnnnnnnnnnnnnnnnngcgtgaagcgcaacttcctactggagactctggataacgaactgccggaaggcaccatcaggttctcttccaagatcgtctcgattgaggaagacggcaatgtcaagctcctacatttgtccgatggctcaacgataagagcaaaggtgtgtgagatcaacaatggctagatgcaaccttgattgttcatcatcacttgtacctctcttcttctcactaagagcagccatggcctgatgcattactgtgctttttctgaaggtgctgataggctgcgacggcgtg

SEQ ID NO: 19213 - DNA, 447 bp, Oryza sativa
atcaagacgagcttggagattatcctttgactttccttctaaattttagaagtgtaccataaatattgtcgcacacatttttttctatgtgcatcacatcaagattatgccgaagaagattgccatcccagtaagataatgtgaatagactacttactgccttataagtttttgacttcttaaaatcaccaatagcatttatttcatccaatactggacgcctatagtaagttataggctctgcactaatctctgtggttccatcaaaagaatttctatcaaaacgaaattcatgattaggtggcaaaaatctacgatgacccataaaacaagattttttcccatgtgccaaacgtttggaccatacatttggaccacaaggcgggcatgcaaattctctatgcaccatatgtgaagcaagcattcctaaagctggcaagtcattta

SEQ ID NO: 19214 - DNA, 639 bp, Oryza sativa
aaataaatagagaatttaaatataggttcaacatgctcaaaggaattgtgtttgggatctgtgtgacttgcctcgcaaacaagcgtcttcaaatcgtcttcaggaactcctccaacgaactaacaatccttccaaatgactaaaaactgaacctagagcacaaaacgaggaaaaacactaacaaaaaccaaataaacattacagttacatcaatgattgggaaatgggtatgttgacggttcttaaatcataacatttgaccatcaatacctgcatataataaaataaaacatggtatccaacttaccggtgttgatgtaaaaacaccaggcctgagagatctgcttaactccagtgcatgtccaaaagcttgcctttaggttcgtgagcgtgccagttgatttgatcctgcaatcaacaagaaagaaagatagaaaccgcggttaaatccataaatgacaaccgatcggctaattgccgatgacatatcatttatctttgagccgatgtcatatatatattgatcggcggtcgtaaataaataataaagaattaaatctactcgatcggctgtagatattagcaatatataatccttatgtcgatatatactgaaatcaagtgattaggatagatcgg

SEQ ID NO: 19215 - DNA, 6729 bp, Oryza sativa
cagataggaaaaatagttttaacgaaggataatgtctggattatcccatgaattatcgtggtcgtttgaattgcccttaaattcaagtgctagacattttgcactcccaactattctaacctgttaaataatgccattgactcaacccagagtggttttcgttcctacgtgacacatacgcgcgcatgcagcctagttagcaaagttttcttttaaaaaaaaatgttgggccctcctatcagattttctcctcccattatctctttcccctcttcccatgatcgtgagtggcatcgacacccaccccccatcttcctctattgcacggtcgagacctccgcaggtgatgatgacgctggtctagagaggcacagtggtgacctcaccaggcgatggtgatgccattggcggctacccttggtctaggtcgggcagtggagcttcgtgagtaggagagcctcgagttcgcatacatctgccatcgccctgaagtccatgctagtcagcttcaagtctgagctctgagtttcgctgtcggacccaccggcaccggcaccaccaccttcctaaagtttgttgttctagccgatgccctccacaggcgagctcggctccatcgccagctgccttaacttctagcatctctccctcactggccgctgcctccagcctccccaaggtgagctcgaactctgctgcagcaccatacccaagcgacctccctcttcgttgttggtcgtggctaccctcttcttcgccaccggcagccacctcaaacatccctgagaagagatcaatcaccgtttaggcgcactccccaagcgaggttccattgcgctgttgttccgctgagaacgacctccaacactctcaccgagcgagctcgatgccaatgactccctccagcgctcctgagcaagagagatagggaggtagagaaggatgagattgttgatacgtggggcccataattattttaaattttttgtgctgactggatagccacatgtgcttgtttctctttgaatccgtccaaaatagtgcagcggttagttcatccgatttaaatagtggagggtgtaaaatgtatggtatttgtattcaagaaatagttaggacaaccgcgatagttcatatggtactttggatgtttttataataactaatactcctactcctttcattccaaaataaatatacttatgcgtgtttctcaaaatgtataaaattcctatatatattctgtaagggaggtagtacctaatcttatactccctccatcctaaaatgtttgacgccgatgacttttttaaatatgcttgatccttcgtcttattcaaaaagtttaggtaattattaattcttttcctatcttttgattcattgttaaatatactttaatgtatatatagagttttacatatttcacaaaagtttttgaataagacgaacagtcaaatatgtttaaaaaagtcaccggcgtcaaacgtttagggaaggagggagtatgtagtataaagtatattgacattgagtatgtgtgctacatggaatgcagctcgggtcgcagaacaaagctgacatgccatgttcggttgagagttacatcaacgagcacaaggtcacagccgatgtcgccatcgccaagattaatgaattggtagaagatgagtggaaaacaactaaccaggctcgcattgaccaccgtgatgtgctccctgtggtgcagcgccttatcaatataaccatggccattccattgtattacagcgatggaattgatggattcacgttcggcgagggcattcaggaggttcttgagaaactctacgtcaagcccattcccttatagacacaaattaatttgttgatggagcaatccatctctgcccatattgtgccatataatttatattcctttttttgtgtgtgattctatactttgtattaactctcaaggttggcaccgatgaaatctcttcatcagtgcaaggacttgagatattatctatatggacaaataatttttgttttatgcttcacaatgaactcgatcttgtgttgttagtattactggatgatgtacggtatgatcgatatgatgtttgacctcaagaagatagtcatattgtcttcttaattttgtgctttctagctatccctccatggtgatgtttataattaatcttattgttaacccatcatacatatatgtaactaatctcctcatgctccgtctggtattttgcatctattgaggcaagattgtaatatgatgccctaatcaataaagctctctattcgcgcaaaaaaaattaatctcctcatgatcgtccactccacctcctctacctccacttcctctccatcactcctcttcctcatctcaactccgttgatggtgggcgcgggagcgggagcggcggggagctctgctgcggtggaccctcctcctcctcctcctccacccctcctctcctttcctctcctctttgtcggggatgggcaggagtgacctgcgccggagggatctggtggtgggcgggagcaggagcggcagcggtggggaactcggtggcggtggctgatccggcggtggggacagcggcggcaacggatacggctctctgccacccaagcggaaaccgacggcgctcaacgcgtggcaccggcgtgcggatcctagtggtgattgctagggtttcaaattttgtttggaattaatttttttggcgggccgatttttcattttgcagttggacaggttgagcacccgcagcggttgctctacacgcaggcaaaaatacagatttttgcatacacctgggtgcagcgggtcacccacccgtccgtgaaaatcgattttgatcgtaagcaaaattcgtttatgtgtgtggtagcgaaagtagaccttggagcctttggcacttgaagtcttcatatactgttcatgagctcctacattaatagatggccaaaatgggccgctcggcttggcccggcccgtccctggcgtgacccaggcacggcccgaggccagtcgggccggcatggcccaaccaactcgccgtacagggccatgccatacaccaacggcctaggcacgactcaatgaggctctcgggccatgccatgccaacccgaagacacgattagcccaccgtgctcgtccttgaataagtatattttgcctccctcatctctttggaatgggacttatatggatagaataagtctatcttacctccctcaactctttgggctgtggctgatactgctgaaaataagtctatttggcctcccttatctttttgggcctactgatcgttttgccgttccgtgcatccctagcgccactgctgcgccccatggcaaaaacactccatacaaaccactgctgcgccacatggcaaaaacattatcggtttgcgacctactttgcgatgacagcggtgatggctaggtgacgacagtattggcgatgacaatggtaatagtttggcgagcaactcagattttcttttttttttccgaaactggcatcactaccggttgacaaccctctagtgatattgccggtggcagtgatgctgtgatgggcatttctgtagtgatgagactttagcgaataaagtgagagtaattgtaaatagtacgactgttttattaactgtaatttttgtgacatcttacataaagaattaaatttattggcaattagttattttgtaattagttacatcacaaataagaatgaacttttcaggtgtttgtctcatccaattgaaatgtttgtcacactcaagctatagtcaaactttggctgttcaggacatttgtttattcatgagccatattatggcaagcgaaacttctatattcctatgcttaatagatatcatatacccaacttacaaaagatactatatatcatccaaatcatacaaaccactgctgcgccacatggcaaaaacactggaacattatcaatccatacaaacttttatttgcataataaacatgtgattgatacaccaagctatctatatttgtgacaataaaactccatcaaactcccagcagatgacaatctctctgactaattaattgcctgatctccacgatgacagcggaggagtttcagagttcttccaggtgttcagaaaagtaccatgatacctgtcaccttgcacaacgtcagctgaagcatacgactcaagttcagacatctcgtcaggtgtgagcttcactgacagtgctcccacattctggtcgaagttgtggatctttgtggttcctggtatgggacagacatcgctcccttggtgatgaacccaggccagtgcgagctgcgacgatgtgcatccctttctcgctgccatggcattaaccttctcgaatatcgccgcgttcttctcgaggttctctggctggaatctaggtaggctctgaagagaagagtggaaaatgcatattatatttgtgaaaaacaggcacggatcaatgtcgatctatgtattgattggacaaacaaagaatcgatatttaagattttatttagatcgtaattaattgttgatggctgtcgtggttgatctcatgggcagtataatcaccttgcggaaatcgtcgtcaggaagttcatcgaccagtttagctccactggagaagaaccctctccctagcgggctgtacgccacaattccaatgccaagttctctgaaattttcggaacaagaagaaataatgcagtttagaaacacatccatagacatgttctgcttcaatacaagcaggtattatatggtgtggggtgctctctgaaattgtgggaatttccgaactttttggcacgaaattatttgaaaaaatttaacaaattttgattgaatttgaataatttttaactaaataaaaaaaagaaaaatgccaagaatttcgggctagatatttgcgtgctagagaggggcaaaatttccaaaatttcagatcgaaattgcaatccctgcagaccgaaatattcccggttttctagaaaataataatagtagtagtagtactgctccatgattcttacatatataatatatttacctgcaagttggaacaatgtcttcttcgacatcccttgaccacagtgaccactcgatctgaactgcggtgatcggatgaaccacgtgagccctccttatcgtcgacgcagaggcctcagataatccaatgtatttgatcttgccttcttcaaccagcttcttcagctcacccatctgcatgtatataaaagtcagaaatgtaggcttggtgagtgctgaattaatacttatcttcgaagttggaattggtatggaaagtacggtttatttttgttgaatttttcccatcgggtcagctcttcagttgagtcaaaaagataaagagtgtgtgacttctcaacaccaacaggagtacaatctttctatccatatctattaataaacggttttgctaaaaatacttactggccgttttttcagtaatgaactttcaattctatggccaagcaaacgtttgggggggggggtgttggatgggactaaaagtttgtaagtccccgtcacatggacactaattagaagtattaaacatagactattgacaaaattaacctattccataatcttggactgattcgaaacacatccatagactgcagtttagaaacacatccatggacatgtcatccattctccttcaatacaagcaggtattatatagtctcgggtgctctctgaaattgtgggaatttccgaaaatagtaatagggtatgattctcttagtagtttaaaatccaaggtaaaaaaagtataaaacgataaataaaaaggagcagacggtttaaaactaaggttttaaaattttattttatttgcggcctataatatctatattttatttattaacttcggtcaaaattaatatctttccatttctccatgagctatttagtcagcaactatcatgatatgatttatttattattaaaaacacagcgttctaccatcaccttggcgtacgtacgtctccgcatcatatgactatctatataaattcaaagcaataacagtaaattaaaatgcgtgtgctacgtgccaacgtaatcagaagatctctccgcattctggtcagttcttcatcaattaatttactcaaaaagataaagagtgtgtgacttttcaagacaaacatgagtaagatctatatatttatctatttttaaaatattaacttaatttggtcagtaataatccagtatatatcatgatataatttattttttaattaaaagaagcgttattccatcatttccatgtgtccacatcacatgatgactgtataattgaaaactgtatcctgactagaatttctgtatgacaaaaggaaatagttaaaattgtgttgctaagtgcctatatttttttcagaatattcactggattattatatgaaaagttatttgttctattctttgagaaaagtacattttcgcaaaaagctttcaataacattgcttagatcacttggttttattaatttgtaagtttatttttagtaagacatgtaacttattatgcatataattaatcaaataaataatccacaccaacaatccgcttaggccccgtttagatggcaaatttcttttttggtttcgggtgtcacatcggatataccgaaaacacatttaaagt

SEQ ID NO: 19216 - DNA, 2055 bp, Oryza sativa
atccgcttaggcccggtttagatggcaaatttcttttttgttttcgggtgtcacatcggatatacggaaacacatttaaagtattaaacatcgtctaataacaaaacaaattaccgattccgttagaaaactgcgagacaaattttttaagcctaattaattcgtcattagcaaatgtttactgtagcaccacattatcaaatcatggcataattaggcttaaaagttttgtcccgcaatttacacacaaactgtatatttggtttttttatccacatttaatactttatgcatgtgtccaaacattcgatgtgatgggtaaaaagtttttgttttagaaactaaacatgaccttacaccgttctaatttcaaccaaatttccaatttaagcgtaaactaaacacaaccttagtaaagtatatgtttaaatcctaccctctacaatacaatacataggatctaggatctcgtgatcagctgctctcaccgtgatctcaacgggcaccgtggagtcgattcgatgctggtagtagaggtcgatgcagccgacgccgagccgccggaggctgccctcgcacgccggccgcacgtacgccgggtcgccgcgcacctcccacgccggcgtgatgccgaacttggtggccacctgcacctgcacctcctcctccgtcgccgccgccgccgccaccgccttgccgacgagcacctcgttggtgtgcggcccgtagacgtcggaggtgtcgaggaaggtgacgcccgcggcgacggcgtggcggacgagcgccaccatgtcggcctccggcttccgctccccgtacaccgccgacatgcccatgcagcccagcccccgcgccgacacctccatcccctgcgaccccagcttcattcgccgcaccaccgctgccgccggagctgtcgctgctgctgccgccatggccggccgatcgattcttgggagaggattgagcggctggtgaagtgagacagctttgctcttccattttcgcgccgttatttatagcgagttttatgggtgctccgtggcgtcagcgagtatgtcacctggtgcctctggattactactcaagaaactaatgagacagtgggcagtggcttggtgtgatagtataaaattatgatagaatatatattggcttggtgtggattactactcaagaaacgtttactaattttagctggtctgaaaatatttttgtttgcttttttatttgaattactactaggactttgcctaacagcgtgattttcattaaaagaaaaaagtattttacaaaaaataattacaaggagagcactgaaaagattacaaaggttataatcaataaaaaactattttctttagaggatctttcattttgcacatatgctgcagaagaactttcttgaacaaaattctccagccttcaaaggaaggtcgctcattccgaaaaatctttccatttctttgcttcaaaatatgctagacagcaataataaaacttccaagaaacctttttgtctgaaacgcaaatgcgctaacaccactatttaaaataaattgagattagaatctcaaagaatgctgagatgccgccaacatccctggctgaaaggatagaagaagaaatgaaattattgttgttgttatcaaggaattctattatcccttgataagcttacattaagaaggtattttcaatatcagaatatattgttgtggaaccagctcgctcacccggatataattcttagatttaaaacgtacgggtgctcgcatttaagtctattttattcttttagtggggtagggtgttcatggtgtgcacacgttatcagcacctccgtctgtaccgtgtttgtcaaaaagaaaatatatatatagcactaaaaaaatagtacattttctgtacattttcgagcctgcaaggtcactgtttctaatatttcttgtgtgcttccgcatcaatcatatatataagaatacctcccttgacaatgagatatattaatttttaataattattaccagtaattaagcggagatagattcacta

SEQ ID NO: 19217 - DNA, 2350 bp, Oryza sativa
aggatcccccaaatgcgctaacaccactatttaaaataaattgagattagaatctcaaagaatgctgagatgccgccaacatccctggctgaaaggatagaagaagaaatgaaattattgttgttgttatcaaggaattctattatcccttgataagcttacattaagaaggtattttcaatatcagaatatattgttgtggaaccagctcgctcacccggatataattcttagatttaaaacgtacgggtgctcgcatttaagtctattttattcttttagtggggtagggtgttcatggtgtgcacacgttatcagcacctccgtctgtaccgtgtttgtcaaaaagaaaatatatatatagcactaaaaaaatagtacattttctgtacattttcgagcctgcaaggtcactgtttctaatatttcttgtgtgcttccgcatcaatcatatatataagaatacctcccttgacaatgagatatattaatttttaataattattaccagtaattaagcggagatagattcactactacaaaacatcaaataggtgtcaccactataggtaccggtagtgctaaaaccagcacctatagggccttttaccacctccacgggtagaaatcgcaaaaaaggcacctttaagtaattataggtgttagtgctaaataaaaaccgacacctcttatattttgtgtcggtttttttaaaaaaaccgacacctataatagcaccccaaaaatcgagccgagccggaaccaagccggcgggccccaccatgacgagcgacatgtggagataaggtctcgctctcttcttcgcctcttcttctcgctctcttctctcccttctctgtctcgctctcttctctcctctctctccctcccttctctgtgccggcagctggccggcggaggccgcaccggcgactgtgccctcccctccgctagatctggcgggaggggaggcggcgacggcaggagggatggcgtcagcgcgggcggggtcgacggcgggcgggcggtgtccggatccggcattggcggccggcggggtgcctcgaggagcggaggtgtccggcggagggctcgaggaggagaggcggcggcaggcaaagggctcgtggaggtggcggcaggcggagggctcgccggcggggaggagcccttctccccgccagatctggccggtggggaggcggcgacaggggcggcgggctcgcggaggagacgtgtcggcgggcgacggggcgatggctagaagacgaccgaccgacggcgcgacgacgacttcatcaggcagagtggggttgcggcggcatgacgatattcttcaacaaggcaagccaccaagccaagcaaaccctctttgaatgttgtgggatttttttattgcataaatttgtgttgcaggctgaatccatctttgaacgttgtgggatgaatgttgtggatccaaatttgctctgtgtgggaggagttcttgcagatgtgggaggatggactgctcggcttgatgcgtcagcttgatcgagccgacacatttcggcatcgagccggcttttttgcatcgtcgaacgtaaaaggggatgagtctgcgggtcgggcggccgatcggtttggagaaaaatcgggcgctgacgtcagcgcccgagttacgtgcaaaactattgtaaactgatttttctcttaaattacttatccaaatcataatccgattgcacctttaaattcgttgcaattaaatcttcgaaacaagactatattccgacaaaaatttttttgcttattattgaattatttttaaatgttgcacgatgttccaccaggtatatcagaattgtttcactaaatagatcgaaaatgtttcactcgtttaaatcgggtgttgtttcaccttatgtaaaattaatgttttagttcaccgcaacatttgatccatacatagtgaaacattataagtacactaggtgaaacatatttcggtggaacaaaaaataaaccgaattcccttaatagggggtttacaaaatatgtgggttttttttgttgcaatggagtatttcaattcactacaacattaggtctatacatagtgaaacattgtgagtacactaggtgaaacatttttggtggaacaaaaaacaaaccaaattcccttaatagagggtttccaaaatatatgggtgatttgttgcaaaagaatattttaattcactgcaacattaaatctatacatagtgaaacattataagtacactaggtgaaacatttattgtggaacaaggggagggacaagtgggtgggtccagtggggtgcacgcgtggggggagggggagcgcacgt

SEQ ID NO: 19218 - DNA, 1589 bp, Oryza sativa
  unsure (1)..(1589): unsure at all n locations
ctactcgacgacttccggtgtggggaggtctaatccgaccggaatatatcccccgacgagatcgggaccatcgccgccgagaaggagacgccgactccacccggcgtgcagctgctgacacgagtgcgacgcccatccaagaaatgccaagcccgacttggtggcagatcaatctgtatttgcttcgttcttgtgtccggttaggactggaatttggcaaacggaatacgtgcatgcatgacaaccgtgccgaccaatcaggactcaggagatatccatccacaggcctacatgttgacgtacgtacatatgctgatcggtttccaaaacctattcggtatatgcacatcaacacatgtctacacagcacgactgcataatattcaaacaaatcaacaaaggtatttagcaagattaatttaaaggtacgcagatacatccggcatgtatctacaaaggtacgcagtattttatatacaatttaccgtacctacttttcagatcatacagcattgtcagatttatattatatttatctagagcatgttttttatacaatatctattgcgcgagtgtccccgatgttaaatcgactacggtttaatgctgggggctcgctctatttttttccgtataaatcatgcttgtttacggtttacataatgcctgatatttaattaatctgctcgttatatcctgataatactagaagatccacgcagtttttgagtacatactcgatatcatctgctatatatcttgctttctaaaaaatatttttcaggaacaattgagcactcgagtaggttgtggtcgagtacactccattatcgagaatattctcgacaaatgcggagttatcgcacccaacctaccaacaaagaccgacgacctatctcatagcaccagccatggctggactactcgagaaaaggttgttaacggataattcctcgctaacgtcgtcggcttgatcacccgacatgattgcgaacggacatccggatatgctataagttgggtacgtgagtcatgctggccacatgagatacacttgcaataaaccaactctagcacttccattggtgttcgagagaagattccgctcgctcactggttctcgcaccagtacgcagcaatctcccacaccgcaacgtccattggtgttcgagagatcattccgctcgctcactggttctcgcaccagtacgcagcaatctatcacaccgcaacgtccattggtgtttgagagatgattccgctcgctcactggttctcgcaccagtacgcagcaatctctcacaccgcaacttctattggtgttcgagagataattccgctcgctcactggttctcgcaccagtacgcagcaatctctcacaccgcaacttccattggtgttcgagagataattctgctcgctcactggttctcgcaccagtacgcagcaatctctcacaccgcaatgtccattggtgttcgagagataattccgctcgctcactggttctcgcatcagtacgcagcaatctnnnnnnnnnnnnnnnnnnnnnnnnnnnnnnnnnnnnnnnnnnnnnnnnnnnnnnnnn

SEQ ID NO: 19219 - DNA, 3041 bp, Oryza sativa
ctctaaactcaccgagaacggtcagatgagctcgataacagttactccaatgtctgcgcgcggttgagaatatgaattcgttcatttgcattgaagtcgggagctactgtcatggttatggataccacatacctaatagtagttgactaaatctcggcaggatccaccacataccatgtcctatacggaaactaacttcagatatggagggagttccggataaggaaagacaaccagagttcaacatggaaacgacaagaactactcggattgtatccatattggtttccctagttctacttggacaaggggacacctatgggtataaatataaggcccccgaggaggagagggggaaccaccctgagaggagaccatggaagacacccatgacaattaacatacacccactagaagccacaacatacaagccaacatacgccgagacacgccgccggatatcgacttcagggataggcatggctattcccctacggtgtctccggatactatcaggagatacgaaagcgctatctctgatctcgccgggcacggacttgaggaggaagactaccctgttgtcgactacgagtcagaccatcagaccgacatgtcgaaaacagttagataggctgcccacatattgtactggtgtgattatggtgaataaaagcaataccggcttcggccaataggatgtagggttattacctgacaacttagggacccgaacctgtataaaaatccttgtctccatctgttttacctcagtctcgcatatatcctagcaccgacgatccccatactatccaaataccgtactcgagacatcaaacgtcgacatcatccactttagatctcgtgctctaccccttttcttattaccgaattttagaatcgacgggtcattacaaattattcgatgcaatcctgatatcgtttcaggtaaaagaacctgcccccaacccgtttctgctaccctgcgcatgatgctgtggtgcatcatcagcccatgcgagaccctacacctttgcctgtttggtccgcaatgcaacccatctcgtctctgttgacgacaccacgcgcacgccgtcttcgccacccacgcgcacactggacaccgcctaaaaccgaagggccttgccagatccggcgacggcggtgccggatctgccgccacctagccaggagacctcgccgcaaccactcaccgacaccggcaaacgccacctcccccgcgccaaagaggaagcgccgccatggagaaggccccatcaccgccatcccagctcaccaatcgactttgccggcggcagcgaggtagggggaggggtgagagggttgtgcccgtggtggcagtagggttcgccccacttgtcgcctgtgcgtgggcgacgcgtgggagcgtgttgtgagcacactagttgcgatcacatctacactaggccccgttcgtttcttctgtaagggtaggataaaattttggattctcgtaacacgcttttcaaactgctgaacggaacatttcatgcgaaagctttctctatgaaagttgcgctaaaatatcagattaatccatttttcaagtttgtaataattaaaactaaattaatcacatgttattaccacctagttttgcatgaaacacttaatctttatcttcatcttcatcttcagaagattcaaacaccacctctctagcatactgatcgaaataattttattttatttgtttgtccaatatcctctttctttcatctccttttttcttagagtttgtgtggaggttgccccttgcatgagaggtgactgaccttctctttccgatcctatgtggcattttaaggggcaacacatcaagcattatagtacttggccgaatggtggagtttggacacggtgctcgttagctcggtctatggccttgcctctgtctctccattctcgggcagcacgccgatggaacgggatgactggacatgtcaggggctttgcttcctgtccagaaagagtaatggaggagatgatttagtctgggcacggagatttggacagaacggcttcgtctactcgcaggctcgcagcggagccatactcgtgcaacgattggggagaatggtgtgaggtggacgatgggtacggagacacggtgtctaggcccaccagcagcgactgctattagctaggcttcgtggagaaggctcggcttggaaagctgtatggtgttgttctctactccaaaagaagacgcacgccacgtgttcgacaaaaagtctacaaggagtgggagagaagaggaaaaggcgagaaggctgagtttttcctgggtggatatataaggctttcaggtggggcatgaggtgccaaggcccactgaaagtgagaggagttgaagagaaagcaccaaaatgagagagttgaagtcctaaatttgaatcacttggtgcctttgtctgccaaattggagtaaaaaattggtaaaaattactgtgtgcagagctagtgatgatgaacactctggtacaaaggcacaagtagaagagttatggttttacagtggtaaagttcactgtaaagtttagaagagggctaggtgatacgttttaattctagattatggctagtttgactgaataatttgaggtatcaaatgagtttataaaataatgccaaattagctgagggtatttcataatgtatagtagttgtgtgatttttccaggatttttgcacacatagatcaattacgaaaattattccaacctagtttcaatgcatatgaatgaaatgacggatgcatgaaaaatccaaaaaggagcaaaataatctcaaaagatagaagggaacccatttcactaatgatatcatgtattccaggttttacatttttgggtctattacatattgcaataatgtttgttcaaatatataaatgtaaatcttacatagaagcctacacttttgttttataaatatataaggtagccacggtcatattataactagtgatgtcctcatgagcattaaaatctgtgatcact

SEQ ID NO: 19220 - DNA, 6077 bp, Oryza sativa
  unsure (1)..(6077): unsure at all n locations
aaaaaaaagacctccaataaggaaccgtacatgagaccaccaatattggtgtatctgtggccaatatggaggaggatcccacagtcttgaaaccagagtaggccgagcaagagacgcggtagcattagcataggcgccagctgtggagcaggggcggagctagagtatactagggggtgcccaggaacccggtcaagaaaattttttaagctatactcatctattttcaccatgtatgcaccccctcaatacaaacttaggcacccgcgtcagtttaaattcgatctaaagtaaaataatttaagtggcatcaccctccatttcattctagctccgccccttccgtggagaacacagaaactgatggtgatggccggatacatatgaattaaatagccggtgcaaaattaacttcagcaacaggccagtgatcgatataacacatagtccgtaccaacaatctgatacggagtagaaacttggagtgatcaatcaaacgaaagccgtacgtgcgtaggcgccttggagttcgcatgtattcggagctggaccaaaatgaatgatatataggaaagaaagcatatgttgtccgtgaaaatatatacgtacacgcttaactatatttctgggaggacgacaaatatacaagtacaatgagctctttaattactataggatgtaatttcatggtgcacctagtatttatgggcacaaaaatacacacttataatttctttggcagaaaaaaatattacgcatgagtacataagtaggttcactatgcttttctgctcaggcacataagttattttgaaatcacgaagaccacatgtctctgacagcacatattttaccttgtgctgttatggtcttttggaagatgcattatctgttacactggtatttacgcacagctggaagcaatgtgagtgaccggacacacatttaggctagtgtgtttataaaccagtagtccaggtgcctccctcatgtcaagatccttgtgcaacattccattgggcagcttccaatcaaaatggtagagaaggttagccaaggcaaactccatgttagctagcccaagatttattccagggcatactctgcggccagagccgaaagggagaaactcaaagttgctccctttgaattctatatcgttgttttcaaacctctctggcttgaattcttcggcatcctcccaatacttactatccctgcatattgcccacacattcacgaatgcagatgtacccttgggtacatcatagcccataatcttacatgtctcacggcatttgcgaggggctaagaggggcaatggacaatgcagtctcaaggtctcctttattaccatcttgagatagctcagttggacaaggtcatcttcagtgatggtgttttttccatcgaagatttgccgcatctctgattgcacctttgccattactcttggggaacggatcagctctgccatggcccatattagtgttgttgacgatgtatcggtgccccccgcaaacatatcctggaataatgattttttaatcaattactaatcatcctgaataatttttttatccataccacctaatgcacataatacgtgcctacatatatagcctaaacttaattcattactaagaagtatgccatttgttcgagaatacttaactaaaactacatatatagactgttttcttgaactaaaactttatgatgattgggtatcactactatatgaatgattttcctagacagggacacttttagattgcgtgcgggtggtaactcagcctgcatgggaaaatcggctcattttcacgtgcggtctatttaaaaggaccgcatgggaaaatcttaaatggaccgcacgcgaaaataagtcagttttcccgtgcaggcctattaagagagccgcatgcgaaaatagtactccctctttccctctcacccacttcaaaatttcccctctttctctcctcacccctccctcctctctttttcttatctttatctgcgagacctctcttctctcccacgcctcacccctctctctctctctctcatgcctctcttctctccaacgactttgcgggtccgcgcttcgctgacggcggcagtcggcgttggcgtgcggcgaactcagctccacggcggtgaaggcgcaggatccggcgggcagtggccgtccccacacggaccggcggcggcagccgtccgcacggatccagcggccggccgccctccccccacgcgggaaccactcccctcccctcccctgatccggcggagaggaggggcgtcggcggtggtctgaccggaggggagcgcggatccggcggccggcggcgtggaggccagcggaaggcgggcggtgtggaggcgggcggcgcggaggccagcggtaggtgggctgcgcggaggcgagcttgcgcggaggccgccgccgacgacggggaggaggaggcggcgccgccgattcaaggtttttttttttcagtttttttcccgtgcgggcaacataagcgtccgcacgtgaaaatccaattttcgcagacccctgggtgtgtgcacctgcacgcattacccgcatgaaaaattttgtttgtagtagtgtatatatcctagctaggtatagaggttaattaggatgtaatcatgttccttgtgagagaaaaaatattattataatttgtttatatggtaggttttgtgtctatcttcatctctactattataaaaattaaagatgtttttgtcggtactttggtacgtcgtccgtgtaactactccctccgtttgttgtttgtttaacgtataacgccattgattttttaagatatatttgaccattcgtctcattcgaaattatgtaattatacatctattttactgtaacttgatttatcatcaaatattgtttaagcatgacacaaatattttatatttgcacaaaaaaattaaataagacgaataattagaaaaacggaggtaagtagaacataaagacagtgttgtgaggcttgcttaccatcaaaagcacgactataacctcatttgtgattgggatcggcgagccgccttccttctggagcctgagcaggtcgtccagagagcatgcgcatgacttgctgtcggccgcgcgatcatccgcctcgatttgggccttgcgttctcggatgatctgctctatgatgcgcaccatcttgtcgcggttggcgatcgcggcgcgcggcgccgcggacaccatcgccgcgagcctcgacgacgggaacaggtcggcgacgctgagccccgacgtgaggcgcaccacggcgtgcagcgcggcgaggtactcgccgctgtgctcgcaccggctccccacggagcaccggagcacggtgtcgttgaccatcctggtgaccatctcgctgaggttgacggcggcgccggcggtggcggcggcggacaggtcgcgcatgagccgcgccacctcctcctcgcggacgcggcggaacgagcgcacccgcgacgcggtgaggagctcctgggtgagcagcttgcggagctggcgccaccgctcgccgtacggggacagcacgacgtcccggccgccgaagctgaacgccgcggcggcggcggtcaggtggcggtcggcgaacgcgaggtcgtggctccggaggacctcccgcgccgcctccggcgacgacgcgaccaccgtgcccacctcgccgaaccagagctgcatcagcggggcgccgtgcctccgggccagcctccgcatcgcgctgtggacgctctccctggaggacacgacgtggtggatgctgccgatcagcggcagcgtccatggccccggcggcaggttgagcctcggctttgccgcaaatgatatcatcagcttggagacgacgacaaccaacaggatggatgcgcccatggcgagcaccaccttgtcctccatgtccgtacgatgtgctgtacgcactagcaatagctactactccagtctccagttgccaagtactacagcaggtgtactatatatagcgatgcatgggctccgagatccttcgtccaccaagtgtcggttaatgttatttctctcttctctcatcaaaccatatcatcctaattatttatagcttttagataatagatctatggttcaaattgtctattctttcttctctcataacaccatgcaatctgaattatttttggctcaaaatttataagtattaatttgtttgggttttaataattatattgcatcttatttgtacacattacataatttaatttcccgcagcaacgcggtggggtatatattcagctagttattttaacatccaattacaacactcccattgcacactaaaaattttaacaattttgtattttgtagtgaattaaatatatctccgacgctactacagcaaattaatatttttgcggatggtccataacccatttacataggtattttacgatcccacccgcaaccttgggcgtgtgaaaaattttctattacacgggatttccagttttttattttttttaatcacaagtacataattttagatgtgaaatatgcgcacgggcggtatatagaattcgaacccagggcctctcactcagtgccatagtttccttgctatgccatagtcactaacgaaaggactatgaccggggacgactatgcatggcatagaatattccaacccatggactgtatatatggcatagctttccttactatggcatagaattccaacacgggactatggcatatagctttcgttactatggcatagaattccaacccaggatctttggtgactatcccatagatgctattcatttgacttcatccttcataaaacttgtaacatatattttttactccaagggccatcaaattaaaaagttatcaactataaacttgcagcgtcgagctctacagagcatgtctccatttgagctcattttaaaaattcaaaaattcattttatcaaaatagtgaaagtttgtaacgaatttatagccacataaacaatctggaatgaaaaaacgttacactacaaaattgaatatggacactatctacaattcacatataaagtttcagaaaaagtacgaattacccccctgaactatcgaggtcgaccaaattacacccccgaactcgaaaaccggacattctacaccccccaactattgaaacaggacaaataacccccccggctcaatccgcggtggttttggtcctacgtggcatatgcgtggcagtccagtcagtaattttattaaaaaaattagtgggacccactgtcagttccccacccctctctatctctctcctctatctcaaccccccctctctctcaaatccctccgctcaccatctcactagcacggcggctgagtcgaaggctaagacgaaggcggaggggatgaccggcggcgggtggtgttggtatttcttacgaccacagagaaatccgcaagcgcacggaataccgctgtagcacttcatcttcggttgaccccaaaaggatatcaaactcagggaacgtatgtaatctacctaagcgtaagacgatccaaggacaacaactgatgataggtagactaggctagagaggactttctatgtggtttaattatctaagctaagcaaaggtaattccctatctgttgcttcgggaaccgacccccgctggtctaccagcgtggttcctgctatagctctttgatgtatccgaacgtggaggattactaggacgggattcagggctgtcaccacatgccgcctacctctgacaaatccgtggcatacacaacaaacaaaggtaatctctaacttagacaccacgtctaagttattaattactactctaatacttgcgcaagaacttccttctctatccggagtcctagtactagagtacttagtataaatactaaacaattaatccgcaaagatggaaacatatcttacttaaaccaaggccattccataacataagaaagaannnnnnnnnnnnnnnnnnnnnnnnnnnnnnnnnnnnnnnnnnnnnnnnnnnnnnnnn

SEQ ID NO: 19221 - DNA, 972 bp, Oryza sativa
ttttactctggccagaggtgtaccactgtactcacaagacacaacctcaacatcatgtcaaccatgcgtcgcgatacttaacaagtacccgaatagagattgtgacaataccctttgcataacacaattcaaagtagtgcaccgttcttggatcataatcactcccttataaacaaggcatggactccccagtgacccccgtgggcttatctccgccacttcacaatctggtgctccacaatgaaccatactatacaaaaagtaaagccgttgtccacgttggcttgtggttggcaccgttaatgtttaacaactgaaaatcgtgaaccggtccttaattgtcatgagcacgaccatcaaaatcatgcgctcacaacccaccagtatcaagttttagttggcaaattagttaattaaccaatcacgattaaccatcgtgagctatcattaagccatcattaaataatagtgaatcataagttatcccatttatatgagctaatgtctctaagcatggctaagcatcctaaacacttttagctaaaaccatataatgttctagctaatccaattattaatcaaacgacaaagtatagataatcaatatcaaagggctataacaaaggcaataggttattcccacccaatgacattcgaaaataaatgcagtagttgaatagaaacaatagttttaaacgaaatcaacatgctcaaaggattgtttgggatctgtgtgacttgccttgctagccatggaactcttcaaagtcttctcccgcaaaatcggacactccgggaacgtcggaatctaagcataaaagagcaaaatcaccaaaacagcacataaacaatcatgaatagtacatttggatatttttaacatgtagatctcaattttagaaaaaattagagacttaaaccaactaaatccgagttaagatgaattagttatgaatttttaaagattaaatc

SEQ ID NO: 19222 - DNA, 962 bp, Oryza sativa
gcataaagtttacatatgttcagttttgtaacatcgtatattcatagaagaaaatagtaagtagggagatacattatttgtaatcatgttatctcaagtttatctcatttcaatttaaagaataagttggttctaaagaaggggagctactagattgctcaatattgcttccatacaccattacaactacaccattcgagtactttgttcataaagaaagagagcgatatacgctgcaaagggaatagtttcaatgtagcatataaatcctatgttgtgcatccacattaccaggtataaccgtttcattagacgttaatattatttgcgaaagaattcatgatattgcatgacaaaagttttttgtgttcgtgttcatgtacacacgtctatgcgcaagatcatgcactacatgaacaacaacatatggaaaaattgagaacggtttcctttgaagaaggggaggacgatgtgttcatgcctactatagaaacatgaaggcatggagaacaagcaaaaacaattcaattcggccacgttgaacaacagtgacttcaaacggtcaccaattgtgcataagagctttgttttgggcccatgatggaaagctcttggagtcctctttccaatggatccagtcgcatctccaaattccatctaagttggccacaattgcaaaatcaatgtactgtatcacctgggaccccggcctggggtgcgccccaaacttgtggagcatgaccctaggaaccccttagtcgtcgccccacctccttaaataaataggttccccttccgaatttctttggttttgttagattaaaatttagccattactactaaccttgtatttgcgcgtgtcggctagaccgtctaattacttgtcttcggagccccaccttatcgtgatctttaattcctatttacaatttagattgtttttatcttgttcttgcttgttt

SEQ ID NO: 19223 - DNA, 620 bp, Oryza sativa
atcgtggtggtagcgataagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgtgagcctccccggaggctgtcgcctgagggttgcccgagggagtgggcccagttgatgcgccagcagcagttgttgcctcagcctggcgagcccgggcggcctcctcccgagcagcttcctccgcttggcgaatccgggcggcctcccgggcggcctcttcagcttcccgaaggcg

SEQ ID NO: 19224 - DNA, 5065 bp, Oryza sativa
gtcttctgtatgggcgggcatcttaagtgatacacctgggaaaaaccatctctattccaactccttttatattctccactcccatctctctctttctcccactcctacctaccctggccactccccctctctgccccactcctcactccggccacctcctctccctacctaccgcaacagggcatcttaagtgatacacctggaaaaaaccatctctattccaactccttttatattctccactcccatctctctctttctcccactcctacctaccctggccactccccctctctcccccactcctcactccggccacctcctctccctacctcccgcaacaacaggtgtggtcgacggcggtgcccccctccgctctcccttgcgcggagttgatggcgtgctcgagtgggaggtagcgggcgcggcagatggcattgtggtggcaggcacgggctccggcgacaggtgcagatggcggcggcggcgcagatccggcctccacgcgcgcagatccactaccgtcgacgacgacggtggtggccgactagggttaggattagggtcaggttttgatttttagattaatatttgtgattttccattttcacatgagaatggcttaaatgcccgcatgcgggtgagccatatggaaaaattgctatttcacggaccatttcggacagacggctggtcgaaccgcaattgattttgacagtttgaaaaaaatccctttttagtagtgcatgcttaaagtactttaactaataaaataacttacaacaaaataaattattattacgtaaatttttgaataaaacgaataataaacatataaaaagggtcgatggcatcatctatttaaaaaacgaatgtaaaaaacgaatgtagtatatataatctgacacacgaacagcccaagacagatatatacccaatagattcaacgagataattattatcagtgggtgtggttcgagaaatgacactaataaattttctttgtgccgcaatctttaatgcgttaacagtccgagaaaaaaaatgtacgagacgaatagcatatatatacttcctccgtccgtacatagtataagggattttgagtttttttttattgtttcatcactagtcttatttaaaaaatttgtacaaatataaaaaacgaaaagttatgcttaaattactttagataataaagtaagtaaaaaaataaataataattctaaaactttttaaataagacgagtgattaaatagtataaaaaacataaaatattttatattatgagacggagaaagtatatgacaaggtaccacgctatcgctacctactatatatacccagcatgaaaatgtcgtgagtctctctctctctctattggaatctttctactactggtagataaacaagtctttaatacgctggccttctactgatcaagaacaaatgaatcagaatgggacaaggttgccagaaataaaaataagcagattagcagatggtacacatccatatgtaggatggctgctttttcatcacaaacacgactcatgcattctaacatagagaaaccaaaaaattcaaaccacgtgaattccaggccaaaggaacgtacgtatacctgactaacctgcattatattatcctacaagtcattttttgctgaccttaaatattgttttgatcgaagaatagtttcatttatctatatatatttttagtactcctttcgaatgtcgatctaaaaaaaaatgtgcgtgtattgattagtacttgtagtacttatactccctctgtcacaacaatatctaactctgaagaggaacacatgttcagatcattcatctatggaattggattttttttttacacagggaagaagtacatggagtcttaatcctgagtgagcatagggaagtctaatactaattgaacgctactggaatgaacgtcagaacggggcagttgggatagggagatgagggaattcggcagatgaatccacgagtggtatactgttgatcgacgtcagcaagcaccggaatttctgcctgcagggccattctcctccacacaagaccatcatatgtaaatggtctcgaatggaccggcagcagttagcgtgcagctcttggtctctcaaccatcgtactactccctccgttttataatgtaaaaggatcttaagtttgcttatagtgtttgaacattcgtcttattcaaaaaaattttagaattattatttacttttttatgacttactttattatccaaagtactttacgcataacttttcgttttttatatttgcataaactttttgaataaaacgagtggtcaaacactataggcaaaaactcaaaatcccttatattaaggacggagggagctaataactaattagcactgtacttgttttggaagactcagcgtacgtgcttcatgtttatcatctgccagaatctagcggcatctttttccttgcttaccacgagcacgtactgtacgttttattttttaaaaaatcatgtagaagtccttttcaaaatcaaatgaactaatttttaaaatttctaacagttaatatttaattaatcatgcactactagcttccctcttgtttaatttcatttggcaccgacttatcaaatcctacggctctatcaaactaagggtatcaacaatgtattatttaccaactactccctccgtccaaaaaaaacgaatctataattagatgtgacacatctcagtacaacaccctcattttacataccttcagtacaaatctggacagaacaatacatcccttataccaaataataaatattgtagtacataccttctaaaataagttcattttacacattccacctaccaatgtataaccaacacaactagaatacccttactttcttaaaacccaatgccattattccttactaagagtaacaatgcttttttattccttcctatgaggttgtagtgctattactacctgatattagttgcttagtaccttcacaatgtttactaattggtactataagagatgtatttatcgcttactatacccttgtcccaaatatgtatttatcccacggtaccaatacaagaccaaaacgaccataataccgttacttgctgagatgatcaatgtttttttattccttgctagcaggttgtaatgcaattgtcacatatttgtagcttactacctccaaaatgtttactattcggtataagtgttgtatttggtgcttactacaccctcatcccaaaataagttcatgtttcacacatctcacaccaatacaaaacaaaaagaccacaatacaatagttttctcaaatgacaatgaaattcttgctaaaagaattaatgtttttttattccctactagcaggttgtagtcctattgctctatatgtgttgcttagtacctccgtatgtttactatttggtataagggatatatttattgcttattacaccccgctcgtaaaataagtttatttctcacacatcccacacatagcaaccactatctatttaatttatttatctattttttcttctcaaccaatcacaaacttcatccaattatttttgttacttctttaatatccatgcccacctaatatttgaacggagaaagtatctattttgtgacaaagacagtatccttttcaagagttcattctggaagccctatgccttatcctatataaagcagctagctagctagctaaagcaaccatcagactaccacactacaatagtatcagtgaactgctagctgttgccctcccaagggaaatatactagtatgtctacttccatccctctccctttcttcttctctcatggtgttgtgcatgctaggacaggccatcctccaatctggccgccggttgggctcctttctgctggtgccccggcaaaagtctccttccgacgacaaagcaatgcgcatcgacatgctgcacaagttgtgtccacacaatcaatcactcctgcgaaggaggtgtctagctttgagccctctgtgtggggggacttctttatcaactatgacacaaagccactacaggtatacattttttttttcattttcatattgtgtacattttgctctacagcaaaactgtacaactgttctgtagaagaatatcatctggttttctagtcaacataaacatataacctgatctaacaagcatatcaaaagattgctgacaggcctgaaacaaatttcaccaccatgttatcacgtacaaaacccttaggaattaatatatctgttcttgtttacttgtcaccttaaccaccttttgaagtttggaaatatttatcgatcactacacggttacgaaggtgataattctcattttgcatatgttacccatatgcatgtagaagagattacatatcccaccaacatatgggtattttggttgtttcattaaaaaaagttgattacatgggtatgtgtgcatggtcaatagtgagcaataaacaaaaatggtgggactaataccggcacatgtttaacgtcaaacacgctccggctgcctaggccacgcaggcaacttgtttacgaagatccgaattttcccagataggcatcaaaaccacacacaaaaaactggttttcactggctgacacgttaagatgctcgagtgcataagatttttgctcaaaaaacaaaaaaaaatccaaaataataaaattctagaaaccctatcttgatatccaatacaagcatcatcgcaatcaatatgagatgacataattaaggaataaggacggaatgatgcgacataaagagtgactagaggtcgggcagattgatgggcgtatttattttggcttcgccttttcacacgtggtcctattatgaggccaactaggattgtttttatagacaattttgggtattttctatgaaaaatacgattttatcgaccgggtctttaagacgggcacctaaaagaataatcctatttttagacgcgcctcctaggaagcttgcctatgaaaattgactctcacagtag

SEQ ID NO: 19225 - DNA, 1739 bp, Oryza sativa
gtcccaatttgtctttcctaaaaatttggggctgtgaggggctatgtaaaacgtttgagatcggacaaactcacatctaaatcagataaatgcttctttgtggggtatcgtaaggaaacaaaaggatattgtttctataaacgggaagaaggcaaagtgtttgtcgcccaacacggtgttttcttggaaaaagagtttatttcaaaaaaggatagtgagagcatggtgggacttgaagaaatccaggaatcaccggtaaacgcttcaacgtccacacaaccacaacaagttgagcaagatgttgttcaattggttgaacaagttgttgttgaaccagctgtggaagcgccggcttcacgaaggtccgataggatatgacgtacacctgcgagatatgcgttgttaactacaggacaacatgatatattgttgttagacaacgatgaacctactacctatgaggaagcaatggtggcaccagactttaagaaatggcttggagccatgaaatccgaaatacaatgaatggatgacaatcaagtttggaacttggttgatccacctaatggtgtaaaagccattgagtgcaaatgggtctttaagaaaaagacagacgtagatggaaatgttcacatctacaaggcacgattggtggctgtcacaccctaaaaatcctgaatttataaattgttgtttaaatagaattattagaaatgattttaaaagcctagaagaaaagatctaattttaaataataaattccaatataaaagtgggccagataaaattttattaaatacttctatagttccaagatttttcaggaatttatttgagtcaaggaagtatttttaataaatggaattgcatttcatgaataatttaaaaaagaaaaaggttttaaaaatcctcttttcgctttgggccgaaagtcggcccaattctctccctctctctcctcggcctgcttgcacccggcccaaccagcccaccgagtcgagccgccgctcactctcctctctcccgctgacaggtggggccgtgatcttcctcgcgcccgccagccgcgccctagccgcgcaagccggcgccgcccccttccaaaattcgcccgcatctttccatctccgatcaaatcaatagaggggaaatgatcctcgggatcccctcttccttttctcttttggaatcttcggctaatttcgtttggaaatcgttggattcgagctcgattcggattcgttttttcctcctaaccctagaccttccatcgccgttgttggccgccgtgggcctacatcgccgctcctagcccctatataaggacactcgggacctcctcttttcgtcgccaccctcgcctcagctcgccgccgcttgtagcgccgcctccacgacaacccgtgcgccgctgtcgccgccgcgagtccagccgtgcgccgccgccgctctggtcgtcgtcgtcgctcgggaaggccactgttgggttcgccaagtcgtcgccgtcctcgtcctaccctccgtttccaccgaggatcgccggagcaccgccgtcgtcgtcgacccgaacgcctccgcagcttcgacctcgtcgccgtcgctgtccgttgccgtccgccgtcgtccaagccctcagtgagttcgccgcgttgccctctacgtgtaggtgccctccgtttgcgccgtcgcgccatcgttcgccggcgagcgtgagttgccgagccgccgccggtgatgac

SEQ ID NO: 19226 - DNA, 3910 bp, Oryza sativa
  unsure (1)..(3910): unsure at all n locations
nnnnnnnnnnnnnnnnnnnnnnnnnnnnnnnnnnnnnntttgtcgtttgattaataattggattagctagaacattatatggttttagctaaaagtgcataggatgcttagccatgcttagagacattagctcatataaatgggataacttatgattcactatatttaatgatggcttaatgatagctcacgatggttaatcgtgattggttaattaactaatttgccaactaaaacttgataatggtgggttgtgagcgcatgattttgatggtcgtgctcatgacaattaaggaccggttcacgattttcagttgtgaaacattaaccgtgccaaccacaagccagcgtgggcaacggctttactttttgtatagtatggttcattctggagcaccagattgtgaagtggcggagataagcacacgggggtttctggggagtctatgccttgtttataagggagtgattatgatccaggaacggtgcactactttgaattgtgttatgcaaagggtattgtcacaatctctattcgggtacttgttaagtatcgcgacgcatggttgacatgatgttgaggttgtgtcttgtgagtacagtggtacacctctggccagagtaaaactattcgaatagccgtgcccgcagttatgggtgggtctaacaatgtctttcgtgattagtttcatgcctcttaccatattaaatgacgatgataataatttgtttagctcctggtttagaatggtatattcctggtttggaggtagaactgtgcagccgggtttggttgttcagaatggttgggcctatgcaacgggtatgttgtatagcgttggattaatattgtttaattaaatactttgcaattttattaaattctggagtatttattaaatgccatttatgcaaatgagactatattatgccattctttgttattccctgcatttgcatatttgctgcgtggcttgttgggtatgtcatatactcaccttttaattattcatcaaaggaagagttctacagtgatgctgaaggtgtgaaggattaggcgtagccctggtcaagctgcttgtgggatagagtcgtctgcgccgttcatcttatttttccactgcttggatttttattgtttgagaggaactatctacctctgtaatgactttatattcgcttattaattagagtaatgattgcactctattatcaatttgttattgtgtgcctcggctgattcctggacgagggtttacacacatgtaagcgtttggaattttggatagaaattccgggcgtgacaagttggtatcagagcctccttgaccctaggttatgccaaacggttacctatagaagccctctaaaaatattgaaaaagtagaactgttctcctctctttctcttttaattaaaccaagctaatggcatatgcagtttatagtccctttatttgttctcattcaaaatttactcattattttgtgttgttagtactgtacatctattactgtactaatggcccattttttatctttcttttcagcagaaattttacaacctttctttttatcatgttgcaacataatttagcatgttgattttataactctctcttttattttatttttgaaacctgttattcagaagtgcaaaaaaaaatttgtgatcccgttttatactgtttcaacttatcttgcaaagattggtttactttatttatttaccttttactttgattttctaactttattcaaattaatccaaaaacttgtgctattaattggataaatgtcttaactccctcctttcacttgtctttagatgccgcgcttcaagcctgagtacttgttcggtactgagggatttgtccaggaattgcgtacgatgtccttcgccataggatttgggactgcccctttgtatgcccagattcctcacgatcgtgatgaagagaagtgccgtgtcatggtcaccttgaacagtaatcgtgaagacatcccatcggtgatgttcgaggctggagagggaaactatcctcatgcttgtcaggagatggcaaggatcgctacagtgatcagttggccgacactgagtatcgctaccatcctcgccaaccccaaggaagtgaccgtggcagctatcttgaacctgcagggattgagaatgatgctaccacaaggcatttggttgagatgctgtgggccatggatgagtcccgcgctgaggtcgtattagctgctcaagatcgtgaagactggaatcgtggtaagatctgtaagttggaggacaaggtggatcgtttggagaaggaactagccgcattgaagagagaagcaccaccacaaaaggccagggttcgtcttaccacaaggaagagagctctatttgtccctcgctaccagttggtgcctaaggttcatgtggtggaagaagaagaagaagctgccccagtcccagcggatcctcccgtcgttaacgtgagtgatgatgatggagaagattcgaagcacacccattcaaaggtcgagtggggtgctacccaagaggatgaggacgagccttcaatcaactccgatgcccggaagacctagacgtcttgttgagtcgttgccttagttcattgtgttagttatcttgtttaagtttggttgtgtgtgtgggtttcacttgtgatttacatcattggtgggatgtaaatgcatgcgtttgtttgctttcaagtgttaggaagttggtgagttagtaccaagatgtaccaagatctcaaggaaaaattttggtgggcaagtatgaagcgtgagatagcagagtatgtagctgtgtgtgatgtttgtcagcgagtcaaggcagaacatcagaaacccgcaggtttgctgcagcctttaaagataccagaatggaagtgggagaaaatagggatggatttcatcactggtctacccagaatgtcatcgggtcatacctctatttgggtgatagtcgacagacttaccaaagtggctcattacatcccggtgaggaccacatattctggaagccgtttggcggaattgtatatggcaaggattgtgtgtttgcatggtgttcctaagaaaatagtatccgatcgaggtagccagtttacttcaaagtgttggaagaagctttaggaagagatgggttctaagttgaatttcagtaccgcttatcatccgcagacagacggacaaactgaaagggtaaatcagattttggaagacatgttgagagcttgtgctttagacttcggtggaagttgggataagaatctgccttacgcggaattctcgtacaacaacagttaccaagctagtcttcaaatggctccttatgaagcactatatggtcggaagtgccgcactccgctgtcgtgggatcagacgggagaacgtcaggtttttgggaccgatattctgagggaagcagaagagaaggtaaagatcattcaagaaagattgtgtatagcccagtctcgtcataagaattatgctgacaatcgccgcagggatttaagttttgaggaaggagatcatgtgtaccttcgtgtcacgcctcttcggggagttcatcgttttcacaccaaaggaaaattggcaccgcattttgtgggacctaataagattgtcagtagaagaggagaggtcgcctatcagttggagttacctcaatccttggcagatgttcataatgtgtttcatatgtcacagttgaaaaggtgtttaagggtacccactgaagaagccaatcttgagtagatagaaatccaagaggatctgacatatgttgagaaaccaatccgtatcctggagacagatgagagaagaaccaggaatcgagttatccgtttttgcaaggtccaatggagtaatcactcagaagaagaagc

SEQ ID NO: 19227 - DNA, 11594 bp, Oryza sativa
  unsure (1)..(11594): unsure at all n locations
ggctccttatgaagcactatatggtcgaaagtgccgcactccgctgtcgtgggatcagacggaagaacgtcaggtttttgggaccgatattctgagggaagcagaagagaaggtaaagatcattcaagaaagattgtgtatagcccagtctcgtcataagaattatgctgacaatcgccgcagggatttaagttttgaggaaggagatcatgtgtaccttcgtgtcacgcctcttcggggagttcatcgttttcacaccaaaggaaaattggcaccgcattttgtgggacctaataagattgtcagtagaagaggagaggtcgcctatcagttggagttacctcaatccttggcagatgttcataatgtgtttcatatgtcacagttgaaaaggtgtttaagggtacccactgaagaagccaatcttgagtagatagaaatccaagaggatctgacatatgttgagaaaccaatccgtatcctggagacagatgagagaagaaccaggaatcgagttatccgtttttgcaaggtccaatggagtaatcactcagaagaagaagctacttggaaacgagaagatgaattaaagtcagctcataagcatcttttcgccagctcttccgaatctcgagaacgagattctgtttaaggggggtaggtttgtcacactctaaaaatcctgaatttataaattgttgtttaaatggaattattagaaatgatttaaaaagcctagaagaaaagatctaattttaaataataaattccaatataaaagtgggctagataaaattttattaaatacttctatagttcctagatttttctggaatttatttgggccaaggaaatatttttaataaatggaattgcatttcatgaataatttaaaaaagaaaaaggttttaaaaatcttcttttggctttgggccgaaagtcggcccaattctctccctctctctcctcggcctgcttgcgcccggcccaaccagccagtcgagccgagccgccgctcgcgctcctctctcccgctgacaggtggggcccacctgtcagggccatcgtctttctcgcgccgccagccgcgccctagccgcgcaagccgtcgtcgcccccttccaaaattcgcccgcgtctttatatctcggatcaaatcaatagaggggaaatgatcctcgggatcccctcttccttttctcttttggaatcttcggctaatttcgtttggaaatcgttgaattcgagcttgattcgaattcgttttttcctcctaaccctagatcttccatcgccgttgccggcggccgtgggcctccatcgctgctcctagcccctatataaggacccccgggacctcctcttttcgtcgctacgctcgcctcagctcgccggcgcttgtagcaccgcctccgcgacaacccgtgcgccgctgtcgccgctgcgagtccagccatgcgccgccgccgctccggtcgtcgtcgtcgctcaggaaggctgccgtcaggttcgccaagtcgtcgccgtcctcatcccatcctccgtttccaccgaggaccgccggagcactgccgtcgtcgtcgacccgaacgcctccgccgcttcgacctcgtcgccgtcgccgtccgttgccgtccgccgttgtccaagctctcggtgacttcaacgcgtcgccctctacgcgtaggcgccctccgtttgcgccgccgcgccgtcgttcgccggtgagcgtgagttgccgagccgccgccggtgatgacgtcatcgccgtgtcatctgtagacccgtggtggattagatcgatctcggccgttcgttttgtctagattagatctcggccgttcgttccgtagaccgtccccgtgcacctggtccaccatgaacccgagcccgctgacgcaataaatcatttttccttttcaaaaataattctttattccgtcataattcaattaaaatctaaataattgatttaatccgatttaatctttaaaaactcataactaattcatcttagctcggatttagttggttcaagtctctaaatttttctaaaattgagatctacaggttaaaagtatccacatgtactgttcatgattgtttatgtgctgttttggtgattttgctcttttatgcttcgattccgacgttcctggagagtccgattttgcaggagaagactttgaagagttccaaggccaacaaggcaagtcacacatatcccaaacaatcctttgagcatgttgatcccgtttaaagctattgtttctattcaactactgcatttattttcgaatgtcattgggtgggaataacctattgcctttgttatactttgtcgtttgattaataattggattagctagaacattatatagttttagctaaaagtgcataggatgcttagccatgcttagagacattagctcatataaatgggataacttatgattcactattatttaatgatggcttaatgatagctcacgatggttaatcgtgattggttaattaattaatttgccaactaaaacttgataatggtgggttgtgagcgcatggttttgatggtcgtgctcatgacaattaaggaccggttcacgattttcggttgtgaaacattaaccgtgccaaccacaagccagcgtgggcaacggctttactttttatatagtatggttcattctggagcaccagactgtgaagtggcggagataagcacacgggggtttctggggagtctatgccttgtttataagggggtgattatgatccaggaatagtaaactgctttgaattgtgttatgcagagggtattgtcacaatctctattcgggtacttgttaagtatcgcgacgcatggttgacatgatgttgaggttgtgtcttgtgggtacagtggtacacctctgacctgtcacgtcctgataaattcatcccaaaataaaaatcattttataaaaggaataatagaattaattacaattcgaaaagaaattggcaaacactaaaatacgtataagaaaaattcgaatgtggcccagaaaattttgttaaattctccttggtctaaaaggagctctcaaattttacttgaattttcagagcaccggaattatatattaagcaacaacaacaattaactaaaaagaaaaactaaaaataatcctcctccctcctttgggccgagtccagcccaaagtccttcaatcctccctctgttttccctggttctcccgggccgccccttcttnnctccctccctttgggccaactccctccttttcttctcctgggccgcctcggcttggccgggccaagccgagccgcgcctcccacccgtgccgcgcatgtgcgcgcgcgtgcgcgccgttgccgcgcgttgactgcgcgcctctcgcatgggtcccgcctgccaggcgcgtccccgacctccagccgccggcctccttcctctctctctctcccgtgaaccctagcgttgttcctcctccaaatccaccccattcaagccggctttttccaaattaaatagggggaattaatctccattgattcctctttgatttcccccattttcccccttgaacggcgtcccaatcaccgggaacggacgcgccaacaccgaccgccttccattgccgccggccacaaattccgccgttcccacctctcccgtggccggctccctctcctctcctataaaatggaaccccctcgctccattctcttattttagccccctcccatgctctcccgtgtcctcaccacctctccccgccttctccttctctctctccggcgccggtcgacctccagccgcacctcccgccacgaccgtgcgccttccggctacgccgtcaccaccctcggccacgtagcctcctcctcacccccgggctgtcctccgtttagcgtggggagcaccagaggcgctttcccgccggcgtccagtggtgttgccgccactgcaccgtctccggccggctgctgttcgtcgccggtgcgccgatcgacgtcgccatctcctccgtcggcgtcgcagcgttgtcctctcctccggctgctcctctgtttcaccagaatgccgtcacccgtgccggcctatccatcctcctcattgtcgacgtcgcctccggcagcccctcccgccgtgcccgtgcattggccgacgtcgccgtctcctcctccagcgtcgcagcggcaaggtcgcccctggcctcgcctccccatcggcggaacaccgccggtgtccgtcgtcgtcttcaccgttcatcctcgccggctcatcgtctcgctgcgccgccaccgtcgtcggcatcgcagcggcgtgttccatgccgtccttgtctccgtgcagctgctgccggctgccctcgtcgcctcctcgccggttccggtcgtcgtcctcccgtcgttctcggtcgtcgttgcgtttgtccctccgtcaagccgtgctgatcgtcgcccgcgtttcgtcaaggttgctgcagccccatcgtcgttttcgtcctcggctccacgtcgtcaggcctcatgccggccgcgtctcgccttcgtccaaggatcactgccgaagtcgtcccccctttcggccccccattcgtctccgtcgttccgtctgtctccgccgcgcccgttcttcgtcgtcgttcccatgccttgttgcgtggtagtaaggatctctcctctcgctgccctcgttctcatcctatcggtgtcgcccgtgcccgttgtgcggttgtcgaccccggtacccgtgtaccggtgtcggtagtcgttcgcttgtgcgtgtggtgaccgtgttagtgtgcccgcttggtagccgcgtggtttccacgtgtgcagcccgtctggtatctagtggagtccgtttgtcggccactcgcctcggttgacacacgggatctgcttctatcgacccgtggaccgtctctgtgtacccggtccaccgtggtcccttaggtggtccgcatgtcaacggcgcagctttcctgtcttttccaggctagcgcttacacatgttttatagttgtaaaacctaattataataatccacaaatctccatataacagcattaaacttcgaatgaccatgccttggtcatacgaactctgaatcgacccgttcaagtctcctaatgtttgttataacctaaagaaccatgtccttcctttttatgtattgttattgcttctttatagccttgtagctatgcttttgtgcttcgtgtagcttctatcgttccggaggttcccgaagcgtggtttgcgatcgtcgccgaaggttcggaaggccgttctctttgagcaaggcaagtcacatcatcattgagcatattgaatcctagtttataaaattattttgatttaaattaatgcattatcgctttatttcaattcccgcgttatcactgtattatttagccatgcctatttacctttgttatgaccttattattattgctattgttattattaccttgttcaccctaggataaacaaaaccccaactagtgggtactctattcatggttccactagtatgaatttaggtagattcttcgctgattaattatgcaacattaggtggttttataactttagactttgggaattctcatatcatttggacactatggaatggttggattatgatggaattggacatacacctctctttctctttcaaaacccctaaaacctattttccggtggggtttgggtgcatgccagttgtgggaagtagcacccggccaatataaggattaagctcaggcctctattgcaaagcactaccgtacttccacatgtctagtgggtaaggcttagtttgtggctcagtctggttataaacaaaggtacacggatggagatggacgaagtcggggcccgatggacatctctaggacaaatgaaggctacatgagctgcggcccggtagtcgagatgtcatggcacagggccggtgtcctgctgctaggggctcaaccttggttgcccgtctcgggaatcccggccgtagccagggttaggtcggtactcttgtttatggctaggatgggttgggaactatgtcacgtctttcgtccgtatgccgtggtggtatgtggcgcgttgttagacgtgaggaagacgtgtcttgtggataaagatttacacctctgatcagagtataatctattcgaatagccgcgccctcggttatgggcaagcctagcaatgtacccaagttagtggtttacttcttaaaatttgcttaacaactataatgtggaatggttggcctgggttggcttgggacaagctgggacctaggtcgggttgtcagttcggtctgaatcatcgtaggccttgggttaaggcaggttcgtgagggttcacggccttgattaataacagtgtagctctaggatcgtctttataaaatggctttgggcaactaagtgacttttaaatgctgtttactgcaaaacttaacccctatattattaccccttgtacccccttgcattaatcatgcatctcccggtgtggcttgctgagtactgtggttgtactcattcttgctctatcttccctccccttcagtacgagaagctttggagaagaagtcctaagtggactcctagcttataccccagttgagcgcctgtgaagatggagccgtaggcccgctagtccgctgctgtttatttttgattgtcaggccttaagtgtctttgtaataatgtaaatattatcgatataataaagatgtgccttttgtatcatgtttgagtggtgtacctcggcttttcctgggacggggattaatacactagcgtttgggaaaaggtaatttttccgggcgcgacatggccagagtaaaactattcgaatagtcgtgcccgcggttatgggcgggtctaataatgtttagtttcatacctctcaccatattaaatgatgatgataataatttgtttagctcctggtttggaatggtatattcctggtttggaggtagaactgtgtagccgggattggttgttcagaatggttgggcctatgcaacgggtatgttgtatagcgttggattaatactgtttaattaaatactttactattttattaaattctggagtatttattaaatgccatttatgcaaatgagactatattatgccattctttgttattccctgcacttgcatatttgctgcgtgacttgttgagtatgtcatatactcaccttgcaatcattcatcagacgaagagttctacagtgatgctgaaggtgtggaggattaggtgtagccctggtcaagctgcttgtgggatggagtcgtctgcgccgttcatcttatttttccgctgcatggatttttattgtttgagaggaactatctacctctgtaataactttatattcgcttattaattagagtaatgattgcactctattatcaatttgttattgtgtgccttggctgattcttgtacgagggtttacacacatgtaagcgtttggaattttggatagaaattccgcgcgtgacagtggcgaaaggttttagacaaatttaaggtgttgattatgatgaaaccttctcaccagtcgccatgctaaaatctattcggattgttttagcgattgctgcctatttcgatttttgatatggcaaatggatgtcaaaacaactttcattaatggaaatcttgatgaggatgtgtacatgacacaacccaagggatttgttgatccacaataagctaaaaaatatgcaagttgcagaaatccatttatgggttgaagcaagcatctcggagttggaatatttgttttaatgaagtagccaaggtgttgggctttgtcaaaaatgaagaagagccttgtgtatacaagaagattagtgggagcgcacaggtgtttctaatcctatatgtagatgacatattgttgattgggaatgatattcctatgcttggatccgttaagacatcgttggaaaatagtttttcaatgaaggactttggagaagtagcatatattctgggcataaggatctatagagatagatcaaggaggctaattggattaagccagagtacatacattgacaatgtgttgaagaggttcaacatgcaagattctaagaaaggtttcttaccgatgtcacatggcattaatcttggcaagaatcagtgtcctcaaacgactgattagcaaaacaagatgagtgtgaatccatatgcctcggcaattggatccatcatgtatgcctgttatctacacgtccagatgtttcatatgcaattagtgcaacaagccgataccaatcagatccaggtaagagtcactggattgctataaagaatatcctaaagtacttgagaagaactaaggatatgttcctagtctatggaggacaggaactgctcgttgtaaatggttacaccaacacaagcatccaaatcgataaagatgattttagaccgcagtctgaatttgtgttctgcctaaatggaggcgctgtgagctggaagagttccaagcaagatatagtcgctgactctacaacagaagttgaatacattaccgcttctgaagcagcaaaggaggctatttggataaagaaatttgtttctcaattgggtgtgatggccagtgctcccagccctgtgaacctctattgcaataatagtgatgccattgcgcaagcaaaggagcctagatcgcatcaaaattccaaatacattttacggcggtatcacctcattcgcgagatagtgggtagaggagatgtgaagatatgcaaaatacatatggatttaatgttgcagatccattgacaaagccactctctcagcctaagcatgaggcacacactagggcaatgggaatagagacatgcgtgattgactctagtgcaagtgggagactgttggtgatatgccctagaggcaatcatagagatgattgaatcacatactatgtttacatatttatccgacattattccttgaaatagataactcattattggttaatgaatatgtgattctttcatgagactctttatgttgtatgttactatttctaaaggatcccttatcaaatatcatatgtggaacaaatatgtttaaatgatcagtacatgtattaattgatgatcatgtctcatggatcatggtatggagataccaaattaataatgtggacacatattggggaacatgttgttggatagtcccaacatgagacagtgcaagagccatatgttgttggatatggcggtcggagggtattaccgacctttccaactgccataaccgtcattacctgcctatttaaggagctcactctcttcatttcttcacacacttcaagcatgagctttctcatttctctcacgtttagtttagtagtatgaagctagtggagtaggaatagaatagaaatcggagtctggaagtcttcggaagagttcgggtatgactctagtagctctcctttcctcttttgtaagatttgtactttgtttagaatattcgtctttatacattttttttgcattgaaatactttctgagtatacgaatgccaactttgctttatgttcatgttatactgattatactgctagcttatctgggagttgcataggtacgggtataatgtttgctattgcaattattctctgtcatgacgatgatattagagtagtatctggtagtttaggcgtagtgtctagattattgggtatcattatttggggttatatgctgcggatgagaggtgggtcgctgatggtgatagctcactacgggtattcctccgcgcgtgtatatagtcctaagttaatttcatgggaagggtactcctccgtatttagccccggttgtatggttacgacgggctgtcgtaaggaactcgacagttaggggtggcttctcgaagtactagaaaggcatcagaaagagggtattagctagttaatcgtataattagaatgtatgtataatttgtatacaagaagtataggaatagattcttttctattttctttccacttagcttagataatttagtatgagaatgagtagtgctatgcttgtgtgtcaacctatcctttggattatattaacccctgcttagactatgattattacaagtaacatataaattattagtggggatcctctagagtgatcttcccacgagattaaacaaatacgatacccttggaatactcttgggtgaaatgctacaatggtatatacgtgtgcttgcggataaactctgtaaccataatatttctgcagtaatgtagtaagaaataccaacacacggcaataaagtaaaatttaagaaattgtgcaactctaaatttaccatcaccacaagtatatcactagcatacactgtatttgtttttgaccctatcggcattctcattttttttcaataatttctcttcaattgagctgaaagtgtcctccagtaaattactagttattcaagtatcttttagccatgacacgttttaacagtatctaatttcaaattacacaatgtttgagtgtcctgtagtaaattttgccatgacagaatcaacacatagcgaagagaacgaatattttttttttattccttgctagtatattgtactactattttgtgacatttcttgcttagtacagaccttttagtatttattattggaaaaagtatgaattaccccctccctccgaaccacaaaaccagacatattaaacctcaaactattgaaaccggacaaattaccatcctattagattcggagcggtttcaatcctacaaggcgttgacgtggaaatccaatcagcaaaaaaaaaaaacagggctcacaagtcatattaattcccatttaccggcactgttgggcgagcggcggcactacaagaggaacctccctttagcaatacatatatgtattgcaaaaagtgaaaataagcattgctagggtctgtatcaacgcatttaatatgcgttacctatgctgctgttgctagcaccaataacaacacatacacaatcgttggtaacatgtaagaataaacattgctagttagcaacaaagtaaatagttttcagccatacttgtatgcgttggcagtttcggtgatgaacaattatatataatccttgcaatggctataatcaagttgcaccaacacttataagtattgcaatataggcaactattcattccagcatgcctttgcacaattatcttgttgggttagaggcccataaactcaaatgatgtacacatgagaaaaattaagtcattcataaaactaatagtaattaaagagaattttttgtattacatggaaaatcatcctcataagtcatgacattaaattttgttcagaacatcatgcacaaatgtaatctaaactatagaaaaaaaaacatgcatctgaagttgccactatcattgccaccatcttccacattacagtcatcatcatattcacaagggatctttagatgacagttgtccaccttgtagtaaccatattgccccagatcatgatccattaatcttgtcaacctgtaac

SEQ ID NO: 19228 - DNA, 5570 bp, Oryza sativa
attctatagcttatctttatattaggtggctccagaagtgaaaatttaccttataagcattagaattattcttcccttgttgcatgtgatcattctggttcatgtttcctttattctgcacggaatatcaaaatattggcacaaactacaataatctagttatttttataatcaaacactgtcagttccaatcaataaaaaagtgaagactagccttcacacaaataatcttcctctgtttctcaaggtgattttggccataagtttgattgctgtgtaataagataagacataagattgtaatgaacagctacaataaacgttgacagttgcaaacaatattgagatcatataatgctatgtagtgagttcgacataacaaataggaagagaatgaccttatctacagtagattgcttggttggtagttgcaaaaccttgtcctgaacatggatatttgtttaagaatgtcctttttaacttttaattcattttttttctctctctctttcctattagaaatctccagtctgtgtagcttaagctacacaaagtaccattcctagctaccattccaagaaatttagacaaaattccagcttcatctcctactgcctgattgagatcattgcactgaaccacaatcctaagacctttcggaaggttccaaatatctttcagttttgtcttcccacgtgtttcaattgttccattttcatctgttcaatgttaaattgcaaagataaaagtgatgctcaacagtccaggataagaagaataatttcattatttcttaccatcaagatttagtatttacctcgaacattaattttaacatcatcatcagattcttcattgccttctccagcattcatactagcatcgtcatcagtatcttcattgacttctccaacatcgtcatcagtatcttcattaccctcttgaacatcactgcatattgtttctcttcagatggtgtggcaagctgtttaggggcattttcttctgcaatgtgttcctctgacaaatattcctcatggctttgaacaatgcaccgccttctactccttgccatatctgctgcaccaaaacaaaaatagcataaacctatgtattgcagtctgagtaccacttttctctactgctctagaagaataatttcagaattggctaaaactttaggcattttactctactgttgtccaaaaaagtaccactatggtttgtattgatgagaaaggtgctagcctacaggttattagatacctctgttagctaatgaacaattttcaaatagaggtgtcaacacattaaaaattgaacaataaatttactaattccaatttggatttatttgccagtcactaattcctttgtccattttaattggccaacaatttgaaacaagtaattgatagaaagaacaaaatttaatttgacgcaaggagataaaatgcatagatggacagtgaacgatcaaaagcaaaagtggtttattcggctagattgcaacatccaggacagaggaatataaaaagatcacacattggattgcttattggtctgttctagcctaataggctctgtcacctaggattgatcactgcatctgatccaaaacctgcatacagagaacatatatatcaaattagtaatgtagtatagtgctgaaatggaattaggcccgagtgtgatttggcaacacagctgagcagtgaaacgtgtaggaactaggaagggaggcggagatgcaggagcatggcggcagggccgtgggctgcgcgcgcggtgtagacgtaggcgctggggaggcaaaaccgcactagcggtgcagcgcacagccaccgggcatgaggcgtcgccgcgtggccctcagcggccgtgggggagctcgcctactcagggttgttggtcggcggggaggcgtatgtgcagaggatggcagccaacacagattgggagaggtgtggacacgcggagcggctggccagcaaatcaccatggtgccttaccttcagattggtgcctggcttaagcctgaggggaggagcagtgcacagagaagaagagaggggatagagtttcgttggagaagaaaacccacccacgagctctttgttggagaatggagagagaggagatagagtttttcacgggcagttagattttcttggagggataaaatggagggaataaatggcgcgacaacgaaagacgtgagaaaaaaaatattgagaccgaaaatactggagggagagcaaaataatttaagctcatttttttcgaaggaaagatttggaaaataacgtgagactgaaaaaaaaaaagagggaaagaacggagcgagagcaaacgttctgtcggagataaaaataatgttaaattctgactgagtagatttaagctcaatttttcggagggaatgatttggaataagactgaaaaaagagggaaagaatggagggagagcaaaataatttgcgcaaatacacaaaatgttaaattcacatcaagtaaatttaagctcgatttttttagggcagatttaacctccagttatctaatctagttcagctaatttatttttgtgcggatcaataagaactagttataaaacttcataaatgcactagtaaaaattattttctactaatacaaaccgcgtcgttgccgactcggtcctgagagaccggataaaatccaaaagtaacatattgttttcttaaaatagtagttagttaatttatcttagcacgaccgaaaaatcacgtgttttttcattgtagacccggtctagaaagactggatgaaatccagacgtaacatattgctgtcttaataaaaaagtagttagttaatttatcctagtacgaaaaaaaaccactttattttacattgttgactcggcccagaacatatttttgtcttaaaatagtagttattcaatttatcttagcacgaccgaaaaaacgtttttttttgtcaatctggtccggacagaccggatgaaatcaagacgtaacaattttttgtcctaaaataatcattatttaatttatcttagcacgaccgaaaaagcatgcgttttttcgtcatcgacctggtccggacatacctcatgaaaaacagacgtaatatacttttggtcttaaaaatatagttatttaaattatgttagcacgaccaaacaatcacctattttttcattgtcgacccggtccggacagaccggataaattccggatgtaacataattttttgtcttaaaattatagttatttaaattatgttagcactaccaaacaatcacctgttttttcattgtcaatccggtccggacattccgaataaattccggacgtaatatatttttttgtcttaaaattatagttatttaaattatgttagcgctaccgaaaaaacacttgtggtccagacaccgcggattaaatctagacgtaacatattttttgtcttaaaataatagttatttaaattatgttagcaccacaaaaaagccacgtgttatttcgttgtcgacccgattaggatagaccgcgtgaaatttggacgtaacatattttttttcttaatagttatttaaattatgttaggacgagcgaaaaaccacatattctaaaaatatatttttgaatggtttattttaaaatttagaaataaaaaagttcaagaaatttaaaaaaatctgagcagacagaatttaaaaagttttaggaatcgccactagagaagaaatgaaaaaaaatatgcatttgctagtatttgaactggagtcctcaattcagtagaaacagccaagtaccactaggctatgtccacttcacattggagaagtctgttttatttatttattcacgttaggtgccattgacaatgtaaatagttttctcgaggaatttgtataagatggaaatagaataacacaacacagatagatgcaaaaaatatagtcggccattccattttctcatcatataaacaatatgatatcttatatattgaaaaataagatctaaccaccaattctgtatataactaatgtacaacattattacacaaagcatatatgcaaataaaaaaaatgcatccatctggctcaatcacttggacaatccaatgaaatctacgaacgacacagtaaagctattgtggtgaagaagcctcgatcccagtaaatctccatccaaaattactgccataaaaataaagagctcgccaagtgaggatatcaacgatataaggaaatcagtgataatggacagatagacagagaacaaccttcataacctcacctttaattagttaccatgttatcgacagttgttccttctatatctcttcggacccatgtctgaccatcatgtgcattgtcaaatagctccccaagattattgacatgatatggttcacattccacatcattccattcttcgcccagttcaaatacatctctgggtttcatcttccttacaatagaccaccctggatttaaatggtcttcaatgtaaaacacttggtcgacttgatttgcaaatacaaagggctcatgctcaatcttttcaccggtatgaattttatttgagaaattcacaagtatgcagccaaacttatctgttttcactctttttcctttagttacatcgacccattcacatttaaacaacacaactgagaaatttccatagtagtctaactcaattatatcaagtatctttccgtaatacatgatatcaccaaggacagggttggtatcactcgcagacgtgtagctcgatgtttttgcagtcacaacaactccactattttgagtcaccctgtcataacgctttgatctgaacctgtacccacgggtattgaatgctctatgtcgttttgctacctcaattggtccacgtgccaaccatctaatatcctcatcaatgctatcaatacctctttgattctccaactgcaaagatctacaccacaccaaaagatacattagttttactcatatttgaaaagaaaaatctaaattttgatacttacatgatctctgaaccaattaggggattgttcattttgcatgttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaagaaagtctgcgccacatatatgggataagtgagcacagctgtgctcacctaacagcatttattgcagtctggtcaaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttaggggatcctctagagtcg

SEQ ID NO: 19229 - DNA, 1032 bp, Oryza sativa
ttttcccttttggaaggctgaggggaaagaaagttaatcctttgtaactggtccatacacaaatccacaaaaacacaggagtagggtattacgcttcgcagcggcccgaacctgtatacatcgccgtgtctcgtgtgtcttgcgggcgggtgatctttccacatacagagagagagagagagcttgggattgcaccctaagcccctggtcgaaccggcaaaggggggcttgcgcagtctcccggtgaggggcaacgagctccgtcatctggcgcgccaggtaaggggctcagcgtgtgttttctgagctctcatactcttccgtgtgcaccaagtttcccttgttcagcctaatggccgagcaagcaaaggcgcacgacctctctccgagtgtgagcggcgacgacggggagccaaacccgcgccgtcgagctcgtactcccccacctcctccacgccaaagtcccaagcggggggaggcgctcgagagagtcgaaaaatccgcagcatcgccagtcgcgggtggtgcaggagaacggcgagatggggagcgtcgcctcctcgtctacggcgacggcagcacgcctcaaggcgcgcttcaggctgttggcgcgctcctacgtcacccgcctgtcgtccctgacccggagtctccagcccagcgatggctggacgacgtggccaacttggtcatgacggcacagcaacgcctgggtgctggcggacggtccgccaccaccaagacctccggcgccgccactaccggttccgcgtcgtcaagacggagagcgcggcgagcggcggccgctgcacgccattcggctaccactccctcgtcggcgcctccgactcgggaggatcagcatgaagagccggatgcccgcctcgacattgagcgccgacgtagtgatcggcgtactccccgcgcaacggagggtgcctcttcgtccagggtgtcacctcgacatggacgtgaggatcagccctccgtgcccccggttggtggtgttggctgtagagcctttgtggcgag

SEQ ID NO: 19230 - DNA, 568 bp, Oryza sativa
atttggatgcttgtgttggtgtaaccatttacaacgagcagttcctgtcctccatagactaggaacatatccttagttcttctcaagtactttaggatattctttatagcaatccagtgactcttacctggatctgattggtatcggcttgttgcactaattgcatatgaaacatctggacgtgtagataacaggcatacatgatggatccaattgccgaggcatatggattcacactcatcttgttttgctaatcagtcgtttgaggacactgattcttgccaagattaatgccatgtgacatcggtaagaaacctttcttagaatcttgcatgttgaacctcttcaacacattgtcaatgtatgtactctggcttaatccaattagcctccttgatctatctctatagatccttatgcccaaaatatatgctacttctccaaagtccttcattgaaaaactattttccaacgatgtcttaacggatccaagcataggaatatcattcccaatcaacaatatgtcatctacatataggattagaaacacctgtgcgctcccactaat

SEQ ID NO: 19231 - DNA, 716 bp, Oryza sativa
ttttcctactgaagaaacaaaagtagattctttgcctactcatggaagtctcaaactgatctggcttgtcattattccttgatggtaggttatgcttggtagggaaaccttccaaatatcgtgaacaaaatgccatacactcatctgccaaatatgattctgcaattgaaccttttggacgcgctttattgcgaacatacgacttcaatttacccaagtacctgtaatatatatacaagacacaaaattaataagttactactatatcatatgacatatgacaaatattataaattgtatactaatatatttaataaagtacctttcaataaagtacatccatcgatagcaaactggcccagcaatcttacattcagtagctaaatggacaaccaagtgaaccataaccgtgaagaatctaggaggaattatcatttccattctgcataatgtgatttgaattgcttcttccaaacggtcaagctcatcaacatgaagaacttttgaacatattccttgaaagtaagcagataagtcaaacaagacggatgtgacatcatcgggaagaatacccctcaaagcaattggcatcaattgttgcattagaacatggcaatcatgtgtcttgagcccatgaatttttccttcggcatagtttacacatctggatatatttgcagaatagccatcaggaacttttatatcccgaagaactt

SEQ ID NO: 19232 - DNA, 940 bp, Oryza sativa
cacaccgcaacttccattggtgttcgagagataattctgctcgctcactggttcttgcaccagtacatagcaatctctcgcaccttaacttcaagtggtcgagttacgactactacctggtcctcgaccagcgacgtagcatttctcccaccacttccacttcaagtggtcgagttacgactactgcctggttctcgaccagtgatcgaccagcgacgtagcgtctctcccaccacttccacttcaagtgagtcgagttacgactactgcctggttctcgaacagcgacgtagcgtttctcccaccacttccacttcaagtggtcgagttacgactactgcctggttctcgaccagcgatacagcgtttctctcactatttccacttctagtggtcgagttacgactactgcctggtcctcgaccagcgatgtagcgattctcccattacctctacttcaacaaagttggtagcatgtacacaaaatcgccaagtgttttacccagagatcccttatcacgacgacacctagcgttgaaacctatcctactgtccctttacgcagtcttgacaaggcctccgaggaacctaagggatcttcggctggggacgcccagagccgataaggccttgtcggatccttcagagacgaaagaacatgtaagatctggtcgtgtaagagttctcgccgtgcgcattaaccaagccgtgtaatcggaaactaagctttccaacttcacggctaggggctaggatcaatgcttattcaaccaaggcaggtcaagggtccaagagccttctcctccgagaacgattctccgacgacaaggctgggggctagggagagtgtacaactcaaacgactgaccaaagtcgtgaactgagaagacactcttacacaaaacattggtcggtaaatttgattcattttcagtttacc

SEQ ID NO: 19233 - DNA, 729 bp, Oryza sativa
cgatataagtgatgtatttagtgcttactactacaccctcgtcccaaaataagttcatttttcacacatctcacatgcaccaatacaaaacaaaaagacaataatacacttgctttctcaaatgacaatgcaattatttcttgctaaaagaattaatgttttttattccttactagcaggttatagtcttgcttgatatttgttgcttagtgcctccatcatgtttactggttggtataagggatgtatttattgcttattacaccctgctcgcaaaataagtttatttttcacacatcccacacatagcaaccactatctatttattttactacctattttttcttctcaatcaatcacaaacttcatccaatcatttttacctagctacttccttaatatccatgcccacctaatattagaatggagaaagtatctattttgtgatagagagtatccttttaagagttcactgtggaagccctattatttttacttatttctttaatatccatgcccacctaatatttgaacggagaaagtatctattttgtgacaaagagagtatcctttttaagagtacattctagaagccctatgccttatcctatataaagcagctagctagctagctagctaaagcaacgatcagactaccacactacaatagtatcagtgaactgctattgccctcccaagggaaatatactagtatgtcaacttccatcc

SEQ ID NO: 19234 - DNA, 408 bp, Oryza sativa
ttagtgttttcggtatgcctgatatgctatgtacatattattactatcataaatcaattaatactcattgcttctaatgatctaatatatatatcttaaatatacttcaaaacaagcacctaaaacaatcgatcattttaattttcaggtggtggaaagatctttatggatatgtcgagctaagtcatgttagagatcgtgcagtggagtcatatctttggtcctatgcgctattctatgaagaaaacttaacactcacacggatgatccttgccaagataattgtattcattgtccttatggatgacacatatgatgatcatgccaccatcgaggaatgcaggaagctgaatgaagccatacaaaggtacgattaattaataggtcaaaaacaacagaaattaatat

SEQ ID NO: 19235 - DNA, 459 bp, Oryza sativa
tctttttagcccctgcaatgatttgcatatgtgagcaactgacccggtatcaactaccgaagaatcagtagaggaagtagcaagattaatttctataacattaataccttaggtggaaccctttccatcctactgcttctgcttgaactgctctaggtatttcttacagttcctcttccaatggcctgtctccttacaaaagaagcactctgcatccttagcgggccctgtcttttgaaccttggtcttagagttgctagtactcgtgatctcatcagagtttagctttctcttttgaccactcttcttgttattgggcttgcacttatgcataaccatcacatagttagagtttttcttaatgctttcctcggcagtctttagcatcccatgtaattcggccaaggtcctatccatgttgaaattcattatgaacggcttaaagctgggaggaagtga

SEQ ID NO: 19236 - DNA, 910 bp, Oryza sativa
gccgctgggggagacgacagggtcaaggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaaccccttcagttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgctgacatcgatgacggtgatgatgacctaggtttccaagaacctggggccaccattgccactgtcgacgggggagcgtgtgctcacgtttctcgccggagtt

SEQ ID NO: 19237 - DNA, 1650 bp, Oryza sativa
  unsure (1)..(1650): unsure at all n locations
ccgtgcggccgggcgcaaggccggtctggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtggactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttacttttagatctagcggaaacttttgagaacctccgctccgcccgcataaagctgaaccccgataagtgtgtgtttggtatacctgcgggcaagcttctcgggttcttggtctctgcccgaggcattgaggccaaccccgagaagattcgagctattgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacgggggaagctgaacatgccctcactcagttaaaggcatatctcagctctcccccggttctagtcgccccggagccaaatgagcccctgctactttacttagcggcgaccccccaagtagttagtgcagcattggttgtggagcgcgatgaagacaatcctcatttcgtgcacccccactctgtgctaacttggcccgggagcgagcggggaggagaggcccccgagtcggacggtggcctacggcccctgacgaccggagccggccctctgcccgcttgtcagacggtgctaggtgcccccgaccctcaggagggccccaaggccactgcgggaaggccacacttaacgccctttgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaaaacaagtgcgcccccaaaggccacttgaacgaagaaccccccgggggtacggcccctagcagagaggatcagccccaccgaagggtgcagcggcctgtctactttgttagtgaggccctccgggacgctaagacccgataccctcaggcccagaagatgctttacgctattctgatggcctcgaggaaactgcgnnnnnnnnnnnnnnnnnnnnnnnnnnnnnnnnnnnnnnnnnnnnnnnnnnnnnnnnnnn

SEQ ID NO: 19238 - DNA, 918 bp, Oryza sativa
cggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgttgacatccatgagggcgattgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgc

SEQ ID NO: 19239 - DNA, 4025 bp, Oryza sativa
gaggcccctgacgaccggagttggccctttgcccgcttgtccgacgatgccaggagcccccgacccccaggacggccccgaggccactgagggaaggccgcccctttcatcctccgaccccgaggtcatcggcacagaaaacaagtgcgcccccaaaggccacttgaacgaagaaccccccgggggtacggcccctagcagagaggatcagccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtataggacgggtggtaaaatgggcaatcgagctttctgagttcgatctgcactttgaaccacgccacgctatcaagagccaggccctcgccgattttgtggcagagtggaccccggctccagagaccgtctcaatccccgggccagcacgaacccctcgcagctgcctcacaccacccactgggtgatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccgggctggggatccgccgcctcctggtgttaggcgactctcagctggttgttaaccaagtctgtaaggagtaccggtgctctgacccgcagatggacgcctacgtgcgccaagtacggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgttgacatccatgagggcgattgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccagggccctgcagatcataccactgtcatggccatttgctgtctgggggcttgatatcctgggacagttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaaacggttctcccatccgagctcaccctgaggtctcctcgggccaccatgtaatgcgaggctgatcaagatcagcttcgcagagatgacctcgactacttagaagagcgaaggcggcgcgcggccctccaagccgcgcgctaccagcagagcttgcggcgctaccatcagcgccacgtccgggcccgatcactctgcgtcgacgacctcgtcttacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgagaagggggggtcgggtgtcaggttttggctcaggccaaccccgcacccccctcgggtgtgtagggttggccgggggctaccacacatgcattacattcttatttctcttttttcaacatttcaatagaagcagtttcaatttcctaaaggttgtgtctgtgctgttctttccttttgaagaatcttggcttaaaataaggtcactcgtactcaaccttgccatcgggggttcggtccggtcagctaaaatcgccaaacggggcccagaaccgagccgtgccccggggcgtggtgaactccgggggggaatcgacaaaaacccacaatcgggtcacccatacccctcggtcaccacgttcccggcctggccagtctcgacatgtggatctccccaggcactagccccgacccgagccattcgaggactgggacttgggcacgagcccttatttcaagctaagacgcaaaaggaccacggcacagatcatcctcatctcgtatgtatagcaaaataaaactaacacaaaaattttttcatcatttctgattgcagattaagttaatttgtacacaaaagaggcatgaaggccttagaagaaagaaaaagaaaaaagtaaagattggcgggggcccgggggctcattccgacgcgcccgagtcgacggcctcgtcaccaccatcgtctgcactgctggtgttgccctcctcgtcggagctgggggcgaacgcgagccgaggggccgacccctcgaagctttggacgatgtggttagcggcatcccggacccgcgcgcgcgcatcgttctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccaaattggtggggggcaccgtcgtctggcctttccagagacccgcttgccgaccggcgcgcttcaggcgggagaccgcatcccaaagcatgtcgggcccaatctcgcccgccaagcgaagggcctcggcctccccggtggaggagtccagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagagcagcggcggcctcgcggtccgtcaagccttcctccacggcgccggcgtgttcttccagcgccatagcacgggcctcaagggactcctcgcgccgccgggacgccgcctcactctctgttacccgccgctctcgggcagcggcggag

SEQ ID NO: 19240 - DNA, 8434 bp, Oryza sativa
aacttccttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcactcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgtccctcgcccagcatcactatctcccgaccggtggcggactccggcatgaagcggcgcggcagtccggcgtgcctctcgctcacgatgcgggaaggtggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcatacggcgcatgatgtggatatgcggttgtggcaatcgaaatggattgtatcgtgcgcgcgttaattacgctcgccgaccgaagcggcgttaccatatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttccctggggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcctcgggggtcgggttgcgcttgccccggccccgagggccgaggcaccccgaccccttaaggaagtctgcgccacatatatgggataagtgagcacagctgtgctcacctaacagcatttattgcagtctggtcaaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagaggggacttttcccttttggaaggctgaggggaaaggaagttaatcctttgtaactggtccatacacaaatccacaaaaacacaggagtagggtattacgcttcgcagcggcccgaacctgtatacatcgccgtgtctcgtgtgtcttgcgggcgggtgatctttccacatacagagagagagagagagagcttgggattgcaccctaagcccctggtcgaaccggcaaaggggggcttgcgcagtctcccggtgaggggcaacgagctccgtcacatgtcctcaatgttttttttggagttaaccttttgcgcttattccttttcaaatcagcagcatgttctctgcaaaacaaataaacataaaaggctaagcaaaacactttacgccacatataaaaggctatgtcaggacaatacgtactttagatatggtactatagcatcacagttgtatagcacatacctatgggcttgcaatttctctctaccagttaaggagtacactgatggttttcccaatggttttcctactggaggaaacaaagtagattcttgcctactcatgggagtctcaaactgatctggcttgtcattattccttgatggtaggttatgcttggtagggaaaccttccaaatatcgtgaacaaaatgccatacactcatctgccaaatatgattctgcaattgaaccttttggacgcgctttattgcgaacatacgacttcaatttacccaagtacctgtaatatatatacaagacacaaaattaataagttactactatatcatatgacatatgacaaatattataaattgtatactaatatatttaataaagtacctttcaataaagtacatccatcgatagcaaactggcccagcaatcttacattcagtagctaaatggacaaccaagtgaaccataaccgtgaagaatctaggaggaattatcatttccattctgcataatgtgatttgaattgcttcttccaaacggtcaagctcatcaacatgaagaacttttgaacatattccttgaaagtaagcagataagtcaaacaagacggatgtgacatcatcgggaagaatacccctcaaagcaattggcatcaattgttgcattagaacatggcaatcatgtgtcttgagcccatgaatttttccttcggcatagtttacacatctggatatatttgcagaatagccatcaggaacttttatatcccgaagaactttacagaacaattgcttctcgcttttcgacatagtaaagctagcaggtggcaagtaaaacttgcttgaagttctttgttgtggatgcagctcctctctaatgttcatttctttgagatcaagacgagcttggagattatcctttgactttccttctaaattttagaagtgtaccataaatattgtcgcacacatttttttctatgtgcatcacatcaagattatgccgaagaagattgccatcccagtaagataatgtgaatagactacttactgccttataagtttttgacttcttaaaatcaccaatagcatttatttcatccaatactggacgcctatagtaagttataggctctgcactaatctctgtggttccatcaaaagaatttctatcaaaacgaaattcatgattaggtggcaaaaatctacgatgacccataaaacaagattttttcccatgtgccaaacgtttggaccatacatttggaccacaaggcgggcatgcaaattctctatgcaccatatgtgaagcaagcattcctaaagctggcaagtcatttatagtccatagtacagctgccctcaaattaaaagtttcatctctagatgcatcatatgtggaaatgccattgaaaaatatgtctcttaaatcttctagaagtggctggaggaaaacatgaatgtaatctccaggacttttgggcctaggaattattaatggcattagaagattaggttccatcatgcagagccatggtggaagattataaattactaaaacaattggcaaacaactgtatgtagagctcaacataccatatgggttaaacccatctgtagctaacccaaaccgtatattacgagaatcagatacaaattgcttgaacctttcatcaaagttcttccatgccggagaatcagttggatgttgaagcgcaccatcctctaagcgctcttcatcatgccaacgtgggagcgatgctgtttctctgcacatgaacaatctttttagcctatcctttattggaaaatatcgtaaaactttgcttggcgttgctttctttctttctttcgttaacttggtttctggctttttacctttccatctagaagccttacaaattgaacaaaaatcatcattaaccttatctttccaaaacagctgacagttattgggacatgcatgaatttgttgataatctagaccaaattttgaaaccaccttcttagcctcataaaagttttttggcaattctttttcatttggaattgccatgtgaaggatatcaagtagatcgccaaatgatttatcactccatttgttcatggatttcatattgaacaaaagcactagcagagataagtgtgatagttcacatccatcccataaaggcttctctgaatctttcaccagcttataaaatgcttgagcttctaaatttggcccatcagtatgtgtacatggtgaatctgcatgatcactcataggcacgtcgtcatacacagtcctaaatgcatcattaattaattcgtgcatgttagcacgcatattttcattgtggggctgtggttgctgattcctagtttgctcctctgaagactcaccatgaaaatcccattggtcataactctggagcattccattgcacaccaaacgatcatagacatcattttttgaaagtagcatagtatgtacgcatgtttcacatggacaataaatctttgtatcctccgacttatctttatatgcaaattcaagaaatccatgtactccagctaagtactcatcagaacctctagggtagcgcaaaagaatcttgatggtttttaaatccattttgacctgtatagaaaaatgatatttaagattcttttagataataacaatgacaaggaattgtctcttctgataattttttgaaagtagcatagtatgtaagccttagtccataaactgtaaaaacaggctatatactacctgaaattaaagaaaagaaaatggattctctcagagaaagtgaacattaagggttaaaatttaccaagaaagaatatatatatagagagagagagaagtgcagcacttaagaaaaacccaggatggctgtagcttgcaagaagatgagatcaagcaaataaatgggacataaatgttctaatttcaaaataactgtatggaaccaaatacgaagtataataaccatcaaacttcatctgccagcagcaagtatctcaacataatcaaatttcatgcactgctatataatgtatatacacacatatcccattcaacttcagtccatcatttttatgaagacatttctaataatttatcaaacaaatacactaatgaaatgagtggagcaggccggggattggactcagaccttagttctgcagcctagccgtagaccaccttcacccgcgtttaccccgtcagcggacgcggaacagatcggggcgctgccaagtggtgagacctccggcgatcgactgcggggttgaaagtcacgacgttgacggaggatcagcgccgggactattaaaggatagagagaatgtttttaagtacaaatgattcaaggttaaacatgagaaataaactatcaaaattatattatcatccataaatgtaaattagtctcttgaaaattcagaacttagttaattcctttaattggaaaagaggcaacataaatgaaggggatcatcgctttggtctaaatccagtgaaaatattgttagcacaaatttatttaaaatcctataggcatggcaatgtagagaaacagattggtaattgttttataaacaaatccagcagcataacatattggtgtaatactttcctactattgactactacctccgtcccattataagtgcagctatagtttttcgcgtccaactttgaccgtccgtcttatttaaaaaatttttgaaaaaaatttaaaaacataagtcacgagtaaagtactattcatgttttatcatctcataacaataaaaatactaattataaaaaaattttaaataagacgaacgatcaaaattgggcgcggaaacttatggttgcacttataatgggaccgagggagtacaactttgcttgattaacagggtagcagaaagtttctgcggcattcaatagaatgctgaatgtccatggtctgctcgtacatggcatgaactagtcagaatatcatgttcaactcaacagctaaataagtttaattggtgtttgcatcattaataatgccatatcatcgaagatcgggcccatcaggtagctatcccatggataatatgctatacgtaggagttcgagagaagcagtagtgcctccaattccaaataccgtcttcggaggctggggttggcagtcggcagcccgacgaacgaggcggcggccggcgtcgctgtgcccggcggcggagggcgacggcggcgcggcacagcggagggggatggtggagcggcgcggtgccggagggggacggcgcggtgtcggtgctgcgcggcgtggcggcggaggccggcgccggcggtgcgctacgacgcgaggaagaggcggagcagagttggggtcgaggaggcggcgctgggttgagcccactgggctatattttgttcacgtatatcgttctgttggttctcattaattaaattactaaatatagtatagtagttatgcctacatataaacacaaagcataacattaccaggttgttaggtgactggacggagagcactttttcacgaatgttgcgtctctgtttcgattaacacaggccgatttgttttttttttaaaaaaaaaactcgcttgaatttttttaaaaaaaaacagctcgcccagtacacagtgtaaaaaaacagctcgctcaattattattattttctaaaaaagcttgctttagtccaaaagtttttacatggcaaaaaaccaactcacttgatgatttcttaaaaaaaacagctcgctagatgtccgaaatgtaaaaaaaatatatctctttcaattattttataaaaataaacaataagtttgcttagtccaaaagtttttacaggacattgagaccattgcaacgcatgttatctattgcagagtggactcaggcgttgcaatatactcaatctctgcaacatatgttctacaacacatattatctattgcaaattaggctcacccactaataagcgttgttaggctcgcattttggtaacgcatgcttcatgcgttgccaagcatgtattgctagagggggttcctgttgtagtgcggtgggtgcgactccggtcggtggcaagcacgacaaggaggggcgacgagcgcggtaggaaggggggatcggctggcagcgtgtggcgagcggcgagcagcgacgggtgctgctgggtagctccggtcgactacgggtgcagttgggcatgcgtcggcgggtggtgttccggtcggcggt

SEQ ID NO: 19241 - DNA, 3429 bp, Oryza sativa
gcaccaccacccacctcccactcctgcgcccccatgagagagataaagtgaagagagagagagaggaaaaagggaagcggagtatgataggtgggtcccataatttttttaaaacaaaatgatgacatgattgccacgtgtatggcatgtaggacaaaatcgctctggattaggtcaaggggggtaattcgtgcggtattgaaagttcagggtgaaataataacaaaaattacatgaaaaaattacagctcataatctttacaaaattagttacaaaaagttcaatcttagataaaaataaagtaaagccatatataacagcataagtacagttaaaaaaggtaaccatacacacgcatacctagtacaattttagacttaggagtgtgcaattttaggctttattttttaatatatgatatcattgactttttcatatatgtttcatcgttcataaaaaattacgtaagtatcattaattttttttgactttagaagagcatgtagacttactgtaagaaacatatttcttaatgaatgagagaaaaaaaataatctgaaactaaggttcatggagttttccatacaagcttaacccgattcaacaaaagaaatatatttttagtgtagtcactagtagaaaaacctcatagatatctgttccaagaccagcaccaatataattaatgaagctagctagtgatggtacttgtaggtgcctcttatatatagtaatcaatatgtgctggtttttcctagtacatatatgccggtttgttataacaaccggcacctattactccttaaaactattaattggtgccgctctgtattttaaaccatcataaatggtgacggattttaatttgaaccagtcaatgaggcttagatggatgagaaattggtcatatttgtgctggttttaagcgaacatgcatgtataaggacgttacatatgtgacgcagtgtattagtgaattattaaattaaattagatgataactagaaaccaattagatctctccttggaagtagactttttgattagtagtatatggacactccagccaatcatttattaattcaacacagtgggattgttgcgcacagctccctccagtgaatcaccaatcctcgactccctcaagtcactactctaacaaccattgtgcgggttggtataatgtttctttcttttaactaatcatgctgaaacttttgcatcgttttgcctgaaaaaagtctgcattaccacggagaaaagatgacaaaataagacaatatccataattccatatatagtcctgccggcgagcttgtcaatcaatcccttaattcatcaaatcttgacgggtcccctatctattaatctcaagccaacagataaattaaaatcacagataaattgattgggccacgttttgtccctgacatcacagataaattttgaatttatataagaagaaaagtataaatctatagtataataatatgagatatatcacattgatgcgagtggatagtcatcgagaaaactctacacaacacataagccatgggctcatggcccgactcaattgatgttagttaggccaaataggcccattcagcaatgtaccatgaggccaagttttaacaaaacacaagaataatttgtagaataataaaaatattctatttgaatgctagaacctattcatagaaatcataggaattgtcgaaactggaatttggcaacaataaacggggtagcgcagagacctaaaaatggatagatgcggagataatggtttagataggttcaggccctctcgatgagaggtaataccgtacttctgtttgaggattgtatccgcgagttatgtattgatttgaaaatttggttgtggttatgtgttcatctacccttgagagggcccctgctcgtcttatataggttgggggtggggcagggttacaaagacagaaacctagccggacacggcattagtttcctaatctactatatgttagataatagagaaatgatgaaatgacttggattgaaatattatgaaaatgatctagcatgtgtatgtttagttttagaatgaagtaaattgtagatataattactatatgtttgcatgttaagccttgtgtgtttaatgggttgatgtggcatgcttgtatgtaggttttaggagtgctaataaatacaatacttgcatgttttgctttaggtagtacccggttgggctctataccatgccttatgatacaaggcaacatagcaaccgagtcctactctataacataatatatgcatcctgcccacctcatatctcttgtcgaatatgcactagaacggataccctcatctcaattgggtggtaagccccatctcaatcgggcatggcgtccgtcacaggctagaagtcactgatgtgaagagctatctcaatcgggcaaacggccgtcacggatgattctatctcaatcgggccctaagtaaagcccgtcaccgatagctttgacccagacgaccagtcaaactatatgacctatctcaatcaggctacaactagcgtccgtcacagatgacccttatctgtgacgggcattaattatagcccgtcacatatgagtcatctgtgacgggcattaacctatgctagagttaatgcctgtcacagatgagtatattccaaaaataaataaattttattttttggctagccctcactcgtcacttaacgtcaaagttctctagagattggcttccggaaaagtaattgtgacatgttggtatgagtattctattaatcctattatgccctagtccaggatgtcaaattgggattattaaatgatttcaaatggaaaagtcaccaaaaccaaagttgtagaactcatcgaggtgcaaaatttttattttggtaatttctccatctgactctatttaaacaatttgaaatttgaaattcaaagtttgaaaagttcaaatagaattttagatcagtgaacgacttcaactgaaaaagtcatcaacaacaaagttgtataactcatcaaaatctataacttttattttggtcatttttctatataacattttttgaaccgtttgaatttgaatttaaaaatatgacaacttcaatcaacattttcaaatactaaatgatatcaactgaaaaagtcatcaacaacacggttgaataactcatcaagatctaaaacttttattttggtcatttcttcatacgacaaagtgatagtaacattgttcacaaaattgacatatctcttatctggttttataaactataacacatatatgtaaaatttgtgaataatattactaacatttcgtcagatgaagaaataaaaaaaataaaagttttagatcttgatgagttattcaactttgttgttgatgactttttcaat

SEQ ID NO: 19242 - DNA, 827 bp, Oryza sativa
gacgggccacaactttaggcccgtttgagatatgaaatgttatctcaattgggcctaaagttgtggcccgtcactgataggtgtcatccgtgacgggcttaagttttatacccatctaacatgtctgtgcgaccatatctcaatcaggcacttttcggcccgattgagatgacttccttgtgacgggccgctatttctaagcatattagagtccgtcacagatagaaggatctgtactagtgatggaggccatgtgggtacccggtaaccatattctccacagtagccactaagacgaccatcacagtcgaaaagataatcttctgctgaggtaaatcaccaaaaagccaagtatttcaatcatcttcgccatagtctcgcgagcgcttttatcaaatcatgaggctatggagggccgaaaaaatttaaggataatatcgaatatatatttaagtgaattgattagatgcacctaattaagtgtagttcctgactatgtgtttagttgaacaatctaagcatatagtcaagagataaataatttaaccatccaagtggtttaagccacctaagtagcataataatagtagtatgaaccctcgagtatacgatactcaagtgataaaactgactgcttaaaaaatataatgcgtacaacctaaagttgactacatctttcaaaattcacatagaaaaatagctataaagaagcttgtatgctgtgaataaagaaatctctaaagtatcgggcacatgccatgcgcacgctgctttaacaaatatgcttaactcactaaaagacacatggtttcactacaccaagaaat

SEQ ID NO: 19243 - DNA, 1385 bp, Oryza sativa
  unsure (1)..(1385): unsure at all n locations
ctaattttggaagggttacacaagtttacgtatctagttgtccaagttctagcaacacttactaaacattttacataaagtgaggatgaaaaagcacgtgtgttatcgtttaggcatggtttaacaaattcatgttgagcatacagctataagtattggtacctggattattacgattttctatcagtaatagatgttcaatatggtttcaaaattttaggtttggtggtgaaaagttagccctagattctatcccaaaattttctcattagtgatttaaacaaaagatttcggggatagaattttgggaactgttggtgatgctcttatattgaatatataataaatgtggatagtttattccaatagatgacaaatttcattggtgcacacgatcttttcttggtatatatcgataacatacagtaagaagaatccattaacgatcaatgcataatatgaagatttaaacaaatacaggaaataaaagtggaaagatgcagtacatatataactggtatacctcttttttcatgcaggtcacccggtatttgtcactggcctctacttgagcttcagtctccctgaagtaattctgcagtgcacggtagaactttttcatgtactctggtagtaatgagatagcactttcatcccatctgtccaataggccaattgggaatttttatgaaattacttaattaggcaagtgtaaataaatctagccgaaaaagatagtttgacagggatgtatcgcgttgaaaccacaaataaatgaatgaaatactttgtaaattatgctcaaatggacacgccatgtaccagtgacgaataaagtggtttgatgatgtttaatatttctcgaatgaaagacttgttaacattgtgtgaaacgcgtgaccataattaattgagatgtatagtgatcgataaattcgatggtaactgtacaacaaatttatttagttagaggatcaacatggtttttcagttgtgctttactcagattaattgtttaggtgcattaaacatcaaaaggtaaaataaacaatttcttttttatttgctctaagtagctcgggttcatggaaattgttggttcatatcatgctggcagcaacagctcggtaacaagaatactgatgccagctacctttggtagttgtagctagctctacctccagttgcacatctctgttttaattaactaaaagttggccttagctgtttcttgatagaatgacagtagaatatatgtgtatgcatgagcggtactctgcttggtcattgcatagtagttggaaaaactcgcatgttttgctgctctagaattagaggtggaatgttgnnnnnnnnnnnnnnnnnnnnnnnnnnnnnnnnnnnnn

SEQ ID NO: 19244 - DNA, 11380 bp, Oryza sativa
  unsure (1)..(11380): unsure at all n locations
nnnnnnnnnnnnnnnnnnnnnnnnnnnnnnnnnnnnnnnntttattaaccaatattatggcttaggctgattatatattatggtcattttccaggcggttggtaaatcctttatgagtttatttactcggatttttcaccacatgtgccatacatttccaggtgtggtaaaaccatgtgtcttttagggacttaagcacatcttttaaagcagtgtgcgtatggtgtgtgcccgatactttggaaatttctttattcacaacatacaagcttctttatagctgttctgctatgtgaatcttcaatgatgaagtcaactttagcttgcacgcatcatattttacaaagcagtcggtatatcacttgtatcatgttattcggggattcacactacatatgccatatattaatatcaagtcacttggttgactataattatcgaaaaccactcagttggttggattatttactccttaaatatatgttcagtttgttcaactaaccacatagtcgggggctacacctattaggtgcatctaatcgatgcacctaagattacatttaattatttctcagccctccacagtcttcagatttggtaaaagtacttgggagatcttggcggagatgattgaagcactcggctttggagtaatctagtttgagagaagattatcttttcaacagtaaaggtctcaggggtactgtggagattatgggtaccccatacacatacggcatggttatccgactggttataggagataacttatatctatgaaatatgtaacggatcatgacttgggtattatgttttcttgtatattatggaatggcctaaagtcctggtttgataatattgtaaagtagatttaggaaaccgataccgtattggttaaggtttctatcttgtaatcttgccccccatcttatataaggtggacaggaggccctctagagtgcatgtgacataaacagttcatcagatcaatatacacccagcggattcaaatccccaaacaggagtagggtattacctctcatcgagagggcttgaacctgtctaaatgcttgtctccgcatccatccacttttaggtctcgtgcgctaccccttttattattgccgaattcttgtttcggcagttggcgcgccaggtgggggtgcgtcgagtttaccgtcgacgagtgcgatggaacaaatctcagaagttgtcggcctcatcgttgctttaggccgggaagatcaatcccgacgggttcgatgaatgcaatctctctcgctgccgagttctttccttgatcagtttccatgaagagcactgcagcgatcagcatccagtttaatttgtctggcgagatcaaactatcaagcaacagatccattcccaagaatcggcgtcttttctcatcaacatcaaaactcctggcgatatccaatttttagcgtgtttgcttgaatcggagtcgacgtggaatcagccgacccaattgattgagcaattatcttgaagtgttgcactgtcccgtatgcatgtatggctcgtgcatgtacatgtatgcatactcgccaagaagtcatcaccgagcaacaggagcgctcaaacaaatatgcatgcattggttgatatgctacaagagtaataatataatcgtgcaacgatgcatgagctggatactacgaactattccgaatagctaagtcgctttattttctcattaattttatattctcatctgagttatattttatatgctcttgtctttttgacaagattattctacttattgctttctttggcatgtaagtatacgacaatcaagatcaatcggtcatccgtggctaggcgagatggtcgttaacctactgtcatgcacatgtatcacctacgtgggattcacagtagcatgtatggatcaacacacatgatcatccatgccgtcaggatttttgcatgaatttgtcaagggctgtgtgctgccaccatcgctattgatgggtgtcctcatcgtcaccaccggctcgcctcgtccgtaaccgattggtgttctcgccatcacggttgaatggtcacaccaccgttgataggtgtcatcatcttcaccgaccggccatctcgtccggtgtcaactggtgtgtttgcctatacggttggttggtcacaccgccattcatgggcgtccacgtcttcaccgaccggcttgccttcgccgccaccgactgctgtctccatctacatggctggcctattatgccgtcgttgttgggcgtctacgacttcaccgccggcctgcctccgtcgccgccgactggtgtcctcgtctatacggttggttggtcacaccaccgttcatgggcgttcacgtcttcaccgaccggcttgccttcgctgccgccgactggtgtctccgtctacacggctggcgtattatgccgccgttgttgggcgtctatgacttcatcgccggcctgcctctatcaccgccgactggtgtcctcgcctatacggttggttggtcacaccatcgtccatgggcgtccacgtcttctgcaaccggcttgccttcgttgccgccgattggtatctccacctatacggttggcctattatactgccgttgttgggcgtctacgacttcaccaccagcttgccttcgccgccgtcgactggtgtcctcgcctacacagttggttggtcacaccaccgttgatgggcatttatttacctacatcgctggttgcctcagccgcttacacggttggtgctttcattgccattgatggacgactttgttctcacatcgactacctccgccgtcaccagcgggaatactaaaaagctaagtctttgttagttctattctttatatgtattttccttttcctctgcctcactacatcaactggttcgccttgactagtgagtcgggggctaaagatgttatatcatattttttctacaattttcatatatctatcttgattgcttgcgacataatctgagtaaaataaagtgcctatcgagttatggagctctttttccctatgctttccgttttgtttgtcgatggatagttgcctttggaccgattcctagcacccggggctcgttggatggacgaagtaacgcaaggtgctaagtattaatcggaagaaatcaaaagcatagagataagataatttattttctggtcttaacaattgcaaaagtatccaagtagtaaattctgatccgtgaaactttgttccattaatgacgaactcatgtcactcatttgcatgtctgggaagtgcctccgccgactcccgatgcgtgggagcaatgactagtcgggcaaagtgtttaaacgtaaggagtcatcggttcggggagatcaaaattgacaagagaagaaatacatatttataaacattttaaaattcttgaattttaaacattttaaaattcttgaatttttctcgagtattatatttacatcagatactactcatcctatatgtttgttctgtaggatccagatccagatatacataaaagggattcatggctttaagcttatctcctacgctctaggaatggatcagtcagaatcaccaccggcttgccgtcgtcgccgccgactggtgtcctcacctatacggttgggtggtcacaccgccattgttgggcgtcgttgtcttcactgaccggccgctgactggtgtcttcgcctatacggttggttggtcacaccactgttgttgagcgtctacttcttcaccgccggcttgccttctccatcgccgactagtgtctctgcctacagggctggcctattatgccgccgttgttgggcgtccacgccttcaccgaccggccgcctcgtccgtcgccgactggtgttttcgcctatacgattggttggtcacaccaccgttattaagcgtctacgtcttcaccactggcttgccttcgccgccgccgactggtgtcttcgcctgcacggctggcctattatgccgccgttgttgggtgtctacgtcttcaccaccggtttgccttcgccaccgccggctggtgtgctcgccttcacggttggttggtcacaccactgttgttgggtgtctatgtcttcaccattggcttgcctttgtcgccaccgactggcgtctctgcctgcacgcctggcctatcatgccaccgttgttggacgtttacatcttcaccgaccggccgcctcgtatgatgccaactggtgctatcgtcttcacggctggccacgtcgccgccaccgctaataggcgtgatcatcttcaacacaagctatctatttcttctgccgacgagtttcttcacttaaatggctgcatgattctgccagtgttgattggccttatcgtcttcaccgccggtcgtctcatctgctgctgactagtgccctcgcctctacggctggtttataccgctaccataactgatggacgtcatcgtcttctttgctggccgccttatctgacgccgactagcttgttcgcctccacggttgcacgtcttcgtcaccattgactagcgtcatcgtcatcgccggtttgccttcgccgccgcccatggtgtcttccctttcatggctggcctattttgccgccattcaaggacgtcttcgttttcgtcatcattctacttcttccatcgccgactggttatgccgccgtcgactggtgtttttatcttcacaactacgcgtcttcactaccggtttgcttatcttaccgccgacttgtattcacttcatcacggctatgcaactttgtcaccatggtggagcgacttcatctttattatcttcggcaccggcaaactctattgcctctacttcgcaagctttgctacttcaccatccacgacatctacaggagcttcgacatcttggcatgcatcaccaaatatgatgccgtgttattttattacaacaagtggtgttttaatcttcaatatttctactcggacatcttcaacatgcatcttcactcaagcaatgactactcgacgacaagaagctacagttctcgactctatgttcagttgtttcccaactaatcaaagagtcgggggctacacaaatacaagactttcaaaattcgacaaattttatgtcaagacaaaacaatcgactaatcagccaacgagttctatgcaatctacttcgggaatcaaaagttttgctccagagcaggctttccacttcagcaactccaattatttcactggcaattttggcttctccaaagtttctcaagtatcaagtccaagatttaatctacatgacctgtcagggagtttggagttatcgaccaatcagctcagtttcaacgagttggacaacagtttctactttcttccaagtgaagcatctgcaatagctacaacactaatttttactgctacctttataaatcaagaggcgttgcatcaatcttcgtcacgcacatgccaacattaagaaaatacttgagcatggttttcttctcaacagtttgatggattattatcactgacatcatcatcagcacctctacttcatcggccctggcgtcttgctaaggggtgactacgtcctcgtcgtcggttgcttttatcatcatagactttcatcgccgacttgttatttcgtcttcatggttggcctactatgcaactgtcgatgggacacctcattgttatcattgactgctacactactattcactggatcaacgatatcatcaacttcatcaacatcctaccttgcctctttgcctatgcctactctgctactgttgatggtcaacttcgtcatcatagctggctatctttattgctgccaatggtcattatcgccgattgcatttgccatcgccaattgttttcttcttttgcatgattgatggatttcgctattgctattgatgagcgtctacgtcttcaccaccggcttgcgtccaccgccgcccatggtttcttcgctttcacggctggcttattatgcctctactgatgggcatcttcgtcttcttcaccgggcgcctcgtctgttatcgactgattatttcgctgccatggctgcacaactctatcgccgttgctgggcgccttcgtcttcactactggctgacatgactgctgccaactagtttcttcgcctccatggctatgtgacttcatcacctttgattggtgtcattatctttaccaccaccatcatctttgtcagctttgatgggtgatatcatgttcatgttggtcatttcgtctccatactgactgcgtcaactaccatcaatggacaattgtgactacaacagaagaataagctacatgcttaggggcgatcaacacaagcgcgaggattatatcttcaatttggacttgttccagatacattcaacatggattcatggtcatgagtcgatttctcatgctcaaacgactggacaattcattattccccacgagggacatcagctgagtgtttgcgccagtcgggattcaattatcacatctactttggtattctttatgagggataattacgcttgatctacatcatgcatgatattcatcacttggagtcatattaattggtgtgttctatacgtcatattttaagggtatcggtatacataatttaggtctaggcctaatacgtctgcagctcatattttcaggtgtggcctgtcacgttcttttagggacttaggcatttttttttgcttaggcaaaggtgcgggagattaagtgcccaataccttaaaatccttttataccgcagttactcaactttttaggagttggtacaatgcattttaaaaggtgtcgaacagtgaagctttatatagctgccccgttgactttttattagtcaaggcactgtttggttttataaagcaattgatggataccatatcgttgtttttttgccatgtaagtgtgcatttttattgaccaatattatggcttaggctgattatatattatggtacgtcattttccaggcggttggtaaatcctttatgagtttatttagtcggatttttcatcacatgtgccatacatttccagtggtaaaaccatgtgtcttttaagttcttaagtacatctgttaaagcagtgtgcgcatggtgtgtgtgcccgatactctggaaatttctttattcacaacatacaagcttctttatagctgttctgctatttgaatcttcaatgatgaagtcaactttaggttgcacgcatcatattttacaaagcagtcggtatatcacttggatcatgttattcggagattcacactgcatatgctatatattaatatcaagccacttggttgactataattatcaaaaaccactcagttggttgcattatttactccttgactatatgttcagtttgttcaactaaccacataatcgggggctacacctattaggtgcatctagtcgatgcacctaagattacatttaattatttctcagccctccacagtcttcagatttgataaaagtactcgggagatcttggcaaagatgattgaagcactcggctttggagtaatctagtttgagagaagattattttttcgactgtaaaggtctcaggggctactgtggagattatgggtaccccgtacacatacgacatggttatccgactggttataggggataacttatatctatgaaatatgtaacggatcatggtttgggtattacgtttccttgtatattatggaacggtctaaagtcctgatttgataatattgtaaagtagatttaggaaaccgatactgtattggttaaggtttctatcttgtaatcctgcccccatcttatataaggtgagcagaaggccctctagagggcatgtgacacaaccagatcgtcagatcaatatacacccggcggattcaaatcctccaacaagagtaggatattacctctcatcaagagagcctgaatctgtctaaaaccttgtctccgtatctatccacttttaggtctcgtgcgctattctcttttattatttgccgaattcttgtttcgacagaggtagtaattattaacctccataaaacttaaccgactcaatgcatgacaattatctataaatatttaagcagtacgttgtttgtggttgagaaaaattcacacacacacacatacggtatagataatataaactttcctgcgttggccgaggttcataatggacgaaaaaatcaccccacacggagggcttgaaactgggagcctgggcagcagccggggcagatgacggtgctgcatgacaagacaccacacgcttgctgctgctgcgatgcttaatgcacgcgatgttgttatttccagctgccgcggtagtgctggtggtgttcatccgcacgcaggcagatgcaggcggcggtggctgcgaaatggtgaaagcacacgctaagcggtgagccataatatcggtcgagtatatgatctagatagctctgctaattaatgcttatagcaagttaagttaaccaccctgccacccagcctatatatatagagcaattaatggacatactacttctgctagctagctagctatgcaaggataatactccctctccgtcccatttgaagtagttttcgtatctaattttaatcgtttgtattatttaaaattgttttaaaaaaatgagacactttaagtcacacataaagtaatattcatgttttatgatctaataataataaaagtattaatcataaaatagtttaaaataagacgggcgatcaaagttgacatcgaaacttatgactgcgcttaaaatttgacgaagggagtgattagaatatgttgcccaatttagttaattcggcatagaaacattaatttttgtggtctcaagccggttacgtacgttacgtctcattttttttgtggggtttgaaattaaattctagtcgtaattagcacatagtacttaacctgcagtacgattgcatgcattttacacaactttcctttgtttttctcttcacgtgtttgattttttagcggtcgtacgctgccgtaagttagccctgcaactgcaaacatgcgatgaaccaccaaatcgcagcatgcgtgccaaacctttcgaagttatccaattattgatctttctagtacagcatttggtcagtgatcattgatctggttttacttcagcagagataatttgcgaggacagatagaaaacgtgttaataaacaaatggcaagatatatacaaacacagcacgacaagagtttgtaattggcgtacgtacgtacgttgttgaaccggcaccactgcagaaaccacctttgtcggtgtcggccaaatcccacgatagccccgattttttaataaaccaggacgactaaaaagcacttttattcccggtttataagtgcaacggaactatatgatatttagtcgcggttcacctcatgtcagaggatattaggccgcctgggatctttagtcctggttagtattaccaaccgacactgaatgtacgttggcacaccgactcagcctcccatccgcagtggcacggcatttagcgccagttgacgtggtgttaaggtgtctaagtttagcgccatacgatttgaccctgaacaaaagggtcatttctgaaataagttttggccatggttcgtttgtaaaattattttttgcaaagggtcaaatcatcaaaatttgtgtagaaccggcaccttttaggtttgccgaataaaaaaaaaagccggctcgatgcgtcagctcgatcgagccgagcagtccctccaaccacatccgcaagaaaagaatgaacacatcacacaatcacaaaatttggcaacattcatgcatcacacaatcaaatattcatcaacaagtttacatcactgaatcaaacatcaaacatcattggatcatcaaatcaaacatcaacaatgaaggagacgattgggggtgctcacctgtggcagaagaaacaagggagcccgtggggagcccgatgtcgtcgatgccgctgcctgccccctaccggatctggtggcggagagggctccgctgccgccgctgcctcccctcccgccggatatagcggaggggaggttgccgccgccgcggcccgtgagccacgccacttactactgctgcccctcctgccgccgagccgtcaccgactccactcctggccagatctagcggagcggaggcgctacctcccctcccgctggatctattggaggggagggcgtagtcgacgccttccctctggcggccggtccgccgcgggctcccctccagcagccgggccgcagtgggctcccctccagcagtcgggccgccgcgggctcccctccagctccccgctgccacttcccctccagccgccgccgtcagccctctcaccggatctagcggagggaaaggcgcggtcgccgctgccgcctccgccggccagcagctggcagcgctcgggagagaagggagggagagagagagaagatcgtcatggtggggcccatcggtcggctcatccgatgctggctcggctcgatttctacaggtgtcggtgttttaaaaaaaaaacggcacctataatatattataggtgtcggtttttaattaaccggcacctataatatactataggtgtcgtttttaaaaaaccaacacaaaatataataggtgtcagtttttatttagaaccgacacctatacttagttaaaggagccggttttttacgatttcaacccgcaaaggtgggaaaaggcctataggtgccggttttagcactaccggcacctatagtggcaacacctatttgatattttgtagtagtgtgtcacgtctagaaattcatgaaccagaatttttaagctaaatgtgcattaaaacccctttccaggaccaaccagggtacacaaacgataatttttgacgtacagatccacgacttacaaaaatataaaagattataaatgcagcggaaaagataaaggcgagataaacttgaaagcttgactcctgcaacgggtcgactccactctacaggcaatccttgacggcagtgacgataccaacttctctgagaaggctccaactgagaaggactctagctctggtgtggggaagagagagcaagactgagtactacccactgtactcagcaagtcataccgggagagaaggcacgatgcaagatatatccaaagaaggctaaaggctcatttgcataaagcaggcatttaaaagcagtagttgaaagcagtaaaactgttgtagtaaattaagcaatactgatcatcacagtccaacactacaccacattgcaacaggcccaaccaaccacctgaactacaccag

SEQ ID NO: 19245 - DNA, 552 bp, Oryza sativa
accatcttccacattacagtcatcatcatattcacaagggatctttagatgacagttgtccaccttgtagtaaccatattgccccagatcatgatccatttatcttgtcaacctgtaacagaaaaaaaaacaaccattgatacagtattggaagaaagaagatcacatctaaagaatttgagaaatagcaccgtacaaaaattgctggccacgcaatatcaagtcgtacgacattgccaataattttgtagcctttgtatggcctgatcaattcttcatattttgccaatggaaaatgaacatgcaccatcaagtattcagttcctagctcaatacctgcaactttgcgtgttggatcacagcttacaattgaagcaacaaccacattcttatttcgatttttccagcttttcaagaatacattagttccaatctggtgcataaatatatgtccatcagcattatctctatataaagagcaattaagtatggaaaagaacatcatattaaaagttttacctccaatgaattggcatccataatgtccactat

SEQ ID NO: 19246 - DNA, 611 bp, Oryza sativa
  unsure (1)..(611): unsure at all n locations
nnnnnnnnnnnnnnnnnnnnnnnnnnnnnnnnnnnnnnnnnnnnnnnnnnnnnnnnnnnnnnntgttggcgcgtccgttcccggtgattgggacgccgttcaagggggaaaatgggggaaatcaaagaggaatcaatggagattaattccccctatttaatttggaaaaagccggcttgaatggggtggatttggaggaggaacaacgctagggttcacgggagagagagagaggaaggaggccggcggctggaggtcggggacgcgcctggcaggcgggacccatgcgagaggcgcgcagtcaacgcgcggcaacggcgcgcacgcgcgcgcacatgcgcggcacgggtgggaggcgcggctcggcttgggccgggcaaagccgaggcggcccaggaggagaagaggagggagctgggccgaagggaggggaggagggaggggcggcccgggagaaacagggaaaacagagggaggattgaaggactttgggctggactcggcccaaaggagggaggaggattatttttagtttttctttttagttaattgttgttgttgcttaatatataattccggtgctctgaaaattcaagtaaaatttgagagct

SEQ ID NO: 19247 - DNA, 4635 bp, Oryza sativa
cggccaaaagatttttctatgttatgttaataataaataaagaagtatttattggtaaaacttgttaatattgttataaaaatgtattgaagttggttgtttccaatttcatatgttaagtgaggtattattttgtaccttattcgacgtatcagtactcggataattaatataggcctatcgcagtctcggtcgtagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatgcagtaatgggacaaggaagcatgacagtagaaatttcaatatgccaagttgtccgataatagctaacccctacgtgaggatccctctcctctctcaaaccgcgctttagtaaccctgtattgctctggtagttcccctgcacaacatggctaggtggagttagaacccttctagtgtctatccattctctatattgacatctccttggtggttcctgagaggaaagaatagatgtcaagcgagcaaagttagtaaatgttgtgagaaaataaagattcatgtaatcaaaatattcttaccatgaaatcatcgtcaagaatatttagacaaacaaagaaccttcgacccaatgttgtaggctttatagaacgaagaacctgacaacgatcaccacacctgcatcttggacgggcttcccatggagggagtgctgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgtcgaatagagtagtgttacgaagaataaagcgattgcccatacggaatgaataagcatatgcagataataaaatacctcacggtcatagttagggcacctaaaaaagtgccttcctcgaatatcaggattcctcgaagccattagttggcatcgatcaccgcataggcaaagaggacgctggcaccaaggtggtagtaggtatacacaaggatcgctacgccagttcggatcctcaacaccccggcgtctagccattgacgaaagccggtaggatttgtacccgtgcccgtgaccgccacagaacatcacccagccaaaaagccagagcaagtacgcctccaaacagcggctgtaggagtactcgtcagcctccgcctgtagctgctcgacctgcaagcgttcgataaaatgttaggcaccttaactgtggactaaatatgtagtacggttgtcatttcggtacaaaaacactcacggtgaactgaagcagccacctcttcgtaggtccggtgttgcggtggtgtgccaacggctcgagcgggagatgcggtgcgcgctgtactagtgcgaaacgtgccgtaagatcgtcctgccagtccacacccgtggtcactggcctaacagcgtctcccgcgagcggtagccccaacaagtacgatatgtcctgtagggtaggggctacctcaccgcacggcaagtgaaaagtgtgcgtctctggcctccatcggtcgaccaaagctgctaggagggaccggtccacagtccatcgtctggccgggtccacgtcgccggcggcagcctccaccagccgacacatcggtaggaggccggcctcacgcaacctgcaataacaaattaacatgtcattataataattattacagcgcaactaatttatagtaatacactgtttgtacctctcgacaaaggagtcgtgaaccgtaagtagctcaccgcacgtcggtgcccggaacgtcccaattctgagccccctgtaccgcagtaaggtaagaccgggtgtcggtgatctatcgccgggtccaacaactgaggtgtatcctgacgtgccatctctgaaaaatatagtgtttcgtgttagaacaattcaaaaagtagtaatgtaaaacaaaagataagttgtaaaattatgaaatagtaataaaatcatgagaataattatgtacaacaagagtacaggctatttaaatatagcaaacgttactaagggtacataacgatgacgtgcaatttaacatatatgtagagttcgataatataacataacataacatagcattacgtatcgaagtccgacattacatcagcatacctaaacacactaggtgccttagtctgacgttacatcacgagacctaaagacatgacatgccgaagtctgacattacatgacgaaacataaacacatcaataagttcgaaacaaattacaagcaaagccacatgccaacatagaacataagaactacaccacgtagccagatgtggcacgacgacgcctaggacgtggtcgagtgtaggtagtgtcttcacccgtagggcgagctccatctactgctgatcctgatagtcctgcctccgccgcatttggtttctccttgtctttaggacaatgcttgtaggtgtgcccacgttcatcgcatttgctgcaatgcttcaccctaccagcatccgactcatccatatcgttgcggatgcgacgagtcctcctccttctagccttgcctcggagcttcgatgggtcaggaatattgagtacttcatcgttagtctctgtgaactccccagctatgccgaacccataaatctcgctgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgttggctttgagaacacactcctgcttcactctcttgcggtagatacccctgcctgccttatcttgacaaagtatctcaaacctttgttgttgagtaccttgcactagagctcgatgtttcatggcctttttacgcaactcctctagctttttctgcatgaaagttccaaacaaaatgctgttgttcggcatagagggaagaattgcctggaaccgatccctaaaatatctgcatgtcccatgtaaaatgaactccactatgccaactagtggcagtccacgaacaccgtgcatcacccagttgtaaacttctgccaaatttgttgtcattattccatatgatgcaccacctgtgtcatacgccttggcccatttctcttttggttcatgcagaattgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggcctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgtgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcagacaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtgataagtacgataaattcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtgggtaataagcatggctaagcatatagttctagctaggtcacataagtaacatgagctagtcgaatcattacccaagggtgacaaagaacagatatcaagtaaacatggcacaagcgagcagataggtaaacc

SEQ ID NO: 19248 - DNA, 4253 bp, Oryza sativa
  unsure (1)..(4253): unsure at all n locations
cggctatagggagcacggtggggaggtgtctagggggcgcggggtgctcggggagaggggaaacgaatgaagggaggcacgtgagtcgtttatataggtcccggagggggagaacgtggccgggagaggcggatttgaagggggaagaggcgccggcgacgtgggcgagtggggtggtttggcgccggttttggagggggggaaaagtgggggaggagagtggaggaggtggggtgacgcggtcccgcggtcggggcgagcgcgcgggtggaggaggaggcggaatcggcggcgacgtggggaggccgtggcggcggtttcggctgagggagccggaggttagggatggccctgactggtggggcccacctgtcggtggctcggggggaaggagagaggaggagacggttgggggagaagatgacaggtggggcctcgggttgacggggaggcaaagcagacttgagggagagagagagccgagcgggctgagggagaaggccggcccgagagggagagaggggggggggaattgggccgaaaggggcccaaagagaggagggaggtttttatttgttttctttttattttaattggttaaatgatcttcgtgactttaaaactatttctcgagctccgaaaattcacggaaaattccggagagtacattagggcacaaagaatattacaaaatattcccggccaatgatttttaagggaaaattttaattctcccattatttcacttgattaaattgcttaactttttattcaatttctaggaaatgcatcattaaatgatttttaatcccgaacgaaaatcggggcgttacaaatctaccccccttacaggaatctcgtcccgagattctgggatggctagaaagaaagccggtgcagatgggcggtctgactgatctgcaccttgaactgccacattctgcttcgaactgattgattgactggttgatcaaacctgcacgattgaactggctggattcgacctttctgttcctttgctttgccaaaactggaccgactggttctgcttgaactgacccagtctaggactgcggatgctcctgaaacttacttagtttggactgaactgttgaggttagcaattttggtaacctgagaattcaccacgctggctataagaggatgaaaatggaatctggcatttataaatcatttaccctatgtccgcttcgactggtcccaattcaaataacaagtaattccaggaaaacctgcttgacctgtctttcgtctgaactgcaaccatcctcgatgctacttctctaagctgaactgttgacctggcctcaagggtgtacattagaattgaacctgttgacttgagattgggagactctgctagtggctcgcaacggactcctttaattactaaccaaattgctgcactgggttgaacattcaagtgaaatgccgacgaggtaaaccaaaactcatctctgagacctaccccccttacagtgggtagtcttactttcgcctgactgagaacttttgaactattgtccttgaaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatatgttgtgagtagacttttattcttcaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaactccacttgatcttcgcagaacgacgactctgaactgatcttctcactccttgcacgaagcttgaggctcgaattgacttgacttccgaacagacatgaagctgacagctggtcctctaggtttgacaactaaaagaattggagagattgggaggagaattttgaaaaaccgtttcacaaagaaatgccgaagggcgagaggagacaatttgcaagtagggttttcagaaaacttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgtgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtgataagtacgataaattcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttgcttcttcactttgatcttccgaactcttttcctcgcgaccgcggacttccgaaacgacggaaactacacgctggcacgcaaaacgagaaaaaactctaataaaaaccaaggaaacaggacataaaaactaaacaaacatgtagagctcaattttagatgaattttgcaagttgaatggctcaattcggagttcgaatgaattagatatggattttagaaattttgagccatttaaatgaatttctagaattaaaccgaattattgcgcaattaataattaatttctcaaaggaaatgacaagtgctgacgtcagcaaannnnnnnnnnnnnnnnnnnnnnnnnnnnnnnnnnnnnnnnnnnnnnnnnnnnnnnnn

SEQ ID NO: 19249 - DNA, 417 bp, Oryza sativa
ttttaagtcattgtattgtaggtattcattcattttcgtaattattttttgtgtcaaacaatttttcaatataaatccaaattagagtatatatatacataaaaattagtcaagaatatccgatgtattaaaaaattgtatgaaaagggaatctagtatcttttggaaggaaaaatccacatttaatttagctgccttgcagatgtattcgaaaaattcaaaggagaggatgggaggttcatcaatacaataggtgatgaaccaagggcattattaagtttgtacaatgcagctcacctcattgtccatgatgagccagaacttgaagaagctatgtcttttgcaaggcaccacctcgaatcaatgagggatggaagtaggctcgaggcccctctagataatcaaatcaaccgtgcc

SEQ ID NO: 19250 - DNA, 1184 bp, Oryza sativa
  unsure (1)..(1184): unsure at all n locations
nnnnnnnnnnnnnnnnnnnnnnnnnnnnnnnnnnnnnnnnnnnnnnnnnnnnnnnnnaacaggttagaatagttgggagggcaaaatgtctagcacttgaatttaagggcaattcaaacgaccacgataattcatgggataatccagacattatccttcgttaaaactatttttcctatctgttagttgtctggtttttgttatatattggtcaccgaaatttacatatgacggctaatatgcatgcctgaaaccgaaaccttgcataaaacaaaaaactttaatttcagtacaaattaattgtaacttcttgtttgacttattttttattttaaattaatgtagatatatgtttatgtttatataaatagttcatagttttttctagatcagtaagaaacaaagtacattttctaaaattagggttaaaatattataattctttgtttcacaataagaattaatacaaaacatgggttattaatagtaatattgccccaacagaaaaaataatcattgatcgatatatgtacgtgctgcaaatgaatttatacatgtcaaattaattaattaattagttaatcggtatatatataccttaaatccggcaatgtcgttcatgaaacggccagttttcccgcatgagatgatggcgtcagtgctattcacagcccactcgtacgcttgtttcgttgtcatggactcactcatgccaaccattaaaccagcagccagcggccgtgttcctgtggtcattgtcgccagagccacctgctcgctgaagctgggcatgtgcttccggtgggaccattcggctccttccagataataacttgacaacctttgtaactgtatgaatatatatatatatataattggggcaaaggaggtcataaaaaaattaattgtgggacgaaatttaaggacaaaacgaattaattgtgtaaaaattatattattaattatctatgtaggcatgcatgtttttggattctggaacatatataattaatagagctagatgtacctctgtcttgctgaaggcaatcaggtacttctgattgcttggcacttgatcctcaaactccctaaagcagcgcaagataaattcataaaactttctcaggtactcgggtacaagcaagaaagcactgtcatcccatctgcacgatattaaaatcaaa

SEQ ID NO: 19251 - DNA, 5545 bp, Oryza sativa
  unsure (1)..(5545): unsure at all n locations
nnnnnnnnnnnnnnnnnnnnnnnnnnnnnnnnnnnnnnnnnnnnnnnnnnnnnnnnnnnnnnnagtgctattcacagcccactcgtacgcttgtttcgttgtcatggactcactcatgccaaccattaaaccagcagccagcggccgtgttcctgtggtcattgtcgccagagccacctgctcgctgaagctgggcatgtgcttccggtgggaccattcggctccttccagataataacttgacaacctttgtaactgtatgaatatatatatatatataattggggcaaaggaggtcataaaaaaattaattgtgggacgaaatttaaggacaaaacgaattaattgtgtaaaaattatattattaattatctatgtaggcatgcatgtttttggattctggaacatatataattaatagagctagatgtacctctgtcttgctgaaggcaatcaggtacttctgattgcttggcacttgatcctcaaactccctaaagcagcgcaagataaattcataaaactttctcaggtactcgggtacaagcaagacagcactgtcatcccatctgcacgatattaaaatcaaagtcagcattcatctaaccactaattgtcagcgtgctaataataattaagacataatttgatgcatatataaacatatccaatgtacccttgaatggctgcgtttagcatccggcattcctggatggaggtatatccatggacatcgtatgtgtcatctaatagggcaattatcacaactatcttagcaaagagcatccgtgcaaacgacatttcttcctcatggtacactgcgtaggaccaggtgtagcactcaatcacacggtctcgaatatggtttatacccatatatccagaaacatctttccaccacctgaaagaaaatatcatatcaattttgtacatacattgagaccgtcaacatagcgcaacgtcaggtatatatttaggaaattatgtgtgaaaccaacgatcataattgaaacagtctatgcgtatttatgatggtacattgatcagttccacattcttagatatacttcgtctgtttttaatagcatgacaatattaaattttggacatataatatttgacatttctccttattcgaaaatttagtgtaattatgaaaattatatgacatgctccatgtacttgataaaagaattcgcaacaaaataaatcatacttacataatttttcaataagacaaatgatattaattaaacgccgtctccaaaagttaataagataatgcatttaaaacatattataatataatgcaagagatagaatatcattttatattgaatttagggtatattttgctctcttttttttgtggccacatgaattctcattacccagccgttgatatactcgtaacaaattgatattagtacctagatatttccttgagttctttcaagtgaacacgctgcagtaggttgaaatccagctttgctagttcaagaataacgggattgtgcccatcctctcggccatactcaaacatgtatgataccatctccactctcctgtgtgtccttggcaatggcaagtgaagggcacgcttgacttgatcagctaaaggggccttcagaacattacgccgattgaatgattcgagatggtgccttgcaaaagaaatggcttccacgagttctggttcaccatgtatgaacagatgggctgcattatataaagatagtaggcctcttgggtcatcggctaatgataattcgttattgaaagtgccatgatcacctttgaatttgttaaatacatctgcacattagatttgagaacaattaatatatgcgattattgtgacatgttgggaaaatatatagtagaataaaagttttactcataatgacatggaaaaatcttacacgttcatttttttattccatgattgtttctaggttttcactatatacacagtttacactacatatttttatagcatgccaaggttatataactgtgcatgtttttaagcccttttatggcctcaccgtgttgatcaattatactaagaaacttaacaatttattaaataggtacaaaaatacctggagacacccaaaatccatgctctctaagcaagcgaaaccgaagagcaacctcatgcagcttagagctagctaaatcattttcatggatgtcttttagtgcagagtcaatctcctcttgaaagaggtgatctattcctagatgttgaattgtatccactaagttcatcctctccaagatgccatttgaggccataataaacagtccgcagacatcttctttcaatttgttggctctctctctcatccattcctctgatatctgcttgcttacatgcattggttggtcagtaataaggattgtaaagaaaagaagtaataaaattttcgatgatattactgtaaccaaagaacgatgcaaaagaaagaaacctaaatgtatggaaaaaaaaaggctggattaggggagagtgaacaatatatccaagctgttggttcattgtggaacggttggactggcctgttagctggtttaaccgcaacgtgcaattaagtcggttggttgattaatactttttcgtttatactataaaatgttttgacttttttcctactaaaatatattggttatgtttcaaaataattatcaacatctataacgtcagattagttttgttaaacctaacaatcatatatatatttgatggtctgtctgtatgtcttgtgttgaaaatgttcacatgttttcctataaattaatctagtcaagattaaaaaaattgactacagaaggttaacacatcttataatataaaatgggggagtatataggagccttctgatgcgagacatccagggttgaatcgctctgtaaaatcgtccattttgaagaagatcatggcttcaattgaccaactaattagcatgtcctacgttttcaactatcctatactgagtttattctatgactttgctttttattaagactggaattcaatcttccgtaaattgaaattaccaatatacttccgtagatttgcaaaaatggaatgtacaacacgtatgacacgccatggtggtcaagtggtcaaccagatatcactatataccctaaattatcaaaatttttataattctgtacgaccaattacatttgattttaagaaaaaaagtaatcaaagggggacatcatttcgaagaattataatcgattactgctagattttatatagcttttacacttgcctgcagtggttgtggttcatggtggataaaaaactcgccccacaccgagggctcaaaacttgccgccgcttccacggcagctggaacaggagctggggcatgtgaatgacaagacacggattgtaaactcttgtgcctgcttgctgatcttaggatgtcgcacgtatttccagcagcaacagctggtttgtgccaaaccatatgtataggaaaacaacatgtggtagtaggtggcttctgcgaaatgatcattttgccggcatttatgccgaaagcactagcaaggctgtgatccatctatagctttggctagcttagaaatgagaagaggatgtaggtacatatacacacacccagtctatatatatagactaggtaaggtggtatatatatatataatgttcaaatttggcagaaatatatatgtacatttcttctgcggtattgatcgatatatagactggatttcatgattgagacgtagaatatatgactgaatatttttttgtttattaaggtttgaaagattctacgttggaaatggattgggcgatcgatcgagctgaaggtcagcacagaaatgacaagtaggattagctagagtgcaggttagtcaagtacacgttgctttggttttcaattcacgtggtttgaattcttggtttttgtatgttagaatgagtcgtgactgtgatgaaaaagcagacagtttcgtacatggatgtgtaccctcttctttcattactgtgtggcaaccttgttagattctgattcatttgttcttgaccagttaaaagtcagcatattaagacttgtttgcctccaagtagtagaaagattccaaatttccaatagagagacgtaggacattttcatgctgggtaggtagcgacagcgtggtaagtaaggcaagttacaaacagaatatatactatgtgtctatcatatatataaactacctctctttttttttaatataggatgccattgacattaattttaacaaacatttaatcattctcttatttaattttttttataaataatatttgatgatgaatcaagccactataaatatataaataataattaattaatttcttaatgaaatgaatggtcaaacatatatgtggaacgacgtgtcgtgaatcggtagggaggctacggctagtagagctagcctggtgcatgtcggtggcggctgtaggccggcgcgaccgccagcggtggtaggccggcacgatgcgagacgtgcggccggcagcagcgggaggctgactctggaggtcagtgcgggcaacggtagggagctcgacatggcgggtgttccacagaggcatgttgtggctaaccggcagggggtgtcaggtaagtgatgtcctcacgctagcggggttgttcggtggtgggcaatggagcaatagctaagctaaggatcgactcgggggatgcggtcggttcaaaacttagcttgtcattgccaagcccacaacgatggagctttagtgccattttacctcttggggcgctgtggagccgtctctctccctctcgtggggttatcaggtgaaaaacctgtcttggttctccttgagacctcgacaaatggcgttggcggtgctcatcgtctaggaagctcccttgtcaaattaagcttctctcagacagcttgtacgtgctctctctagatatgattgtcctcttgcggcggtatcctagctaatgtaagatagtcatgttgacttacggggaagagcactttgatcctttgctctaaccctgtctcctccaattccaaaggcgtagatagagttgagtgtggtgttaggctgttgggtttggtttcgggcggttgagctatagcttttttgttggcctagcgggagcatgtcaccttagtagcggccggtttatagtgctagccttctctggggttcttcgttggtggtgtttttttctttttgttttataattactacttgtcaaaatgctagtcttgtaatttttttatactctattcaatgaatcatcgctccatccgatgttggttgtaaaaagaaaaaagaacttgtcacaagtcatctaaggtggatcatccttcaacatgttccggacaatctcccatttgatcaacgtttgctttctcccccgtacgacccacgagggcgaggtcacgacaacgtgcaccatgaattgtcatgcatgatcgatgcatcccaccctcatgcatgcgtagagcagagaggatttggggc

SEQ ID NO: 19252 - DNA, 8031 bp, Oryza sativa
cccaatccgccaagagaatccaacacagccttgatcattgtcgacagcagacaaaggccgcagggacaaatcgctgagtgaagaatggaggggagcagctgacttgtggggaccacatgggtaaaatggacatttcgtaccacccatttgcactggcaggacttcttgttggcacttggcacgccatgtcgatgaaagtggcgaaatataaaaagttttgtctctctctctccagtaactaaatgtaatactaataacaaataggagaggggtatatgggagattttacaaatttaatagtgacaaattagttaaattttccgatgatcataacactgctcatcaacacttaaaaccgcacagtacgtatcatactatcttctccatatgttcaatagcctatgacaatcggaggataattaaaaacattttggtttgaacaaactgtactattaaacatgacatatggtttggtaaaaaatacgatatgtcattgcttacttgtcttcatacgtattagagcacaccaagcttcacctcggttagtgagccagcagcatgtatggtttggttagggccaggagttcggccatgctgggccttgggcctgttgggcctactaggctgcgcaacggtgtaaatgggccaatagagaggaaagcgagctgggctggtctggaaaaagtgggccggcctgtaagagagaatgaaaagatgtcgagggggttggatcaagggagtggatggaaagtatgggccagtagagaagaaagaattgaatgtggcccaagtgtgatatcctaaaattaaatttgggactttctatcatagtatagtgggccggatgtgtataatttaaatttgctgtcatacaatgtcccatggcacataaaagtgcctccctgagtccctgtttacttcgtgtagttccctgtttatgtaagtatagtaatccttatggaaggtagttctgtaaactacactgtaacttcatgtcttaactcagttaaagaaattggatgaaatattctaactaacgagctagcttttccttatcatatcgaggctgtttgatctctcatgtatgtcaagcctgcggtcatgcatgtcacatggagcgtgttcaacgaaacacatgacattcagcccaggaaatcaagcagctaaacacattgcgtgtgtctccggttctctccctttatatgctacccaatctctagctttatataataaaaagaattgaagttttattattcttattatttggctgtgaaatgagatatttgagagaaccaagcatatcaaagtgtccttagcagggtatggaaaacattgagatgatcgcgagaatactcaaatcatccgtaaattcgagttgctcaaacacaacagcttgatcccaaatctcacggacaagacgtggaattcttcttaccaaatccatgaattccagttgctcaaacacaaatcccaaatctcacggacaagatatggaattcttcttaccaatactgaaacatgtggaattttgctcaccaataccaaaagaggcgtggatcccaataccaaaagaggtgtgtacgttctattgattataatgatcaaaatagttctattgagtataacgatcaaaatacaaatgtgtttattgaacaatgcggctgaataatctctgctgaaattgcaagtagcactagtgcagagttatataatagggatacaatatgcctactcgagaagaataacccatcataccagaataattttctggataattcaaattcatcattattttttatgatgggacaaatgattataccattctattcttttatgttttataaagaaaacctcatttaaaacagaacatggatttctattttcaccaaaatctaccatcatttttgataaaaaatgaatgctttctgtattatctgtactactttaaaaaaatgcatagtggttgaaggtaaagccaacgtaaacacgcgaaccaatatagacacatgaccttaaccatggcatcagaaatccatagttggcgagaaaaaaacggcgcccccaatccctctctatctcccccacaccctcaccccgccgctgccgcctctatacctcgacgcggcgccatcgcgcatccatcactcgtcgtgctctccgcactccgccgcatcaatgcacgcgtcgcccccctctctcgatcgctccctccgtatctcccctcggctctctcctcctcaactcctcaatcgacgccgccgcagccccctctctcggtcgctcccccacaaccgcttggtccgcttcgctccgaagactcctccttcactgaatcgccgggatccgccgcccccacctcgccctgcggcctagggtgctgctgcccgtcatcgtcgaaggagctggtttccgccgccttctttttgatccgtcgcgtcgcgcaccgtggcgggggatctcgtggggcgaatcccgcgccctcctccatcgtcgtcgtcatcgtccctggtccctggtactacaattaagttgaaattgatgcgagtactatgactacattgatatcatatattttagggaaagaagaaaacaatatatatagaaaaaataataacgcaaataatgtaaaatattggttcaagtttttacattcttatgagccattttttctatatgtttattttctactaggttctaatgaatatgtaaaacttacaagttttataaaatcactgccatttaacacaacacacttactattatttttcctaacacatgcacctatactcatgaacttaaacaacacaatctacccaaataattactgacaaatcataaattactatttgatccatctcaattttcgacaaacatatagataattaaaatccagtaaaacattcttttgaatatatgatttatgcataatttgaaataacccatatactcaaaaaataactaagccatgtaatattatacaaaatttccatattcaagatgatcgataaataatgtatatgggctataaatttctagcgcgccaactaacgcgctgattttctagttatacgtactatagatttttttacttttcttcttatataaattcagaatttatctgtgatgtcatgggctaacacgtggacctttaatttatctgtcggcttgagattagtagataggcgacccgacaagatttgatgaaataacggattgacaagctcgccggcaggactatagatcgatattgtcttattttgacatcttttttccgtggtaatgcagaccttttttcaggcgaaacgatgcaaaagtttcagcatgattagttaaaagatagaaacactatacctacccgaacaaaggttgatagggtagtggcttgagtaggtcgcaggagtggtgattcattggagggagctatgccacaatcccactgtattgaattattaaatcattggatggatgtctatatactacttcctccatcccaaaatatattttaggacggagggagtactaatcaataagactacttcgaaagagagatctaattggtttcttgctatctaatttataatttaatgagtcactaatacattacgtcacatacgtgacgttcttatacatgtatgttcgcttaaaaccggcacaaatatgacccatttctcatccaactaagcctcattgactcgttcaaattaaaatccttcacctatgactactcatttgtgatgatttaaaatacagagctaattaatttttttagataatacagagctaattaatagtttaatcaagtaataggtgcctatttttataataagcgcgcacatataaatgccacatacggtgtaagtaggttgaaaaaaccgacacctatttgtataagtggcacctgtaagtaccatcattagctccattatattggtgttggttttggaagtgatatctatgaggtttttctactaaggactacaccaaaaatatatttcttttgttgaatcaggttaagctaagctacacatgtccacttttcatgctactgtagagcaaccattagaggagccaattactaaggtttctttgtgacaagttgatttatttgttattccttgtggtaaagaagagttgtgttataatacttcacttatatgcatgccacaactaatgaatgaacatactattcctagtgttcttttatgtgctgattttaagcatgttgttcataattgcgaatgaagttgaggaatgtgaattgctatcttctttaaagactttgggctatattatgtttgatgacttttgtgtactcgataatttgaagtagaatttattagctaagtctaatttggcatgtcgaatgaatactatttatcatatctttggtgaaaataatactatttatcatatctttgatgcataaagtttacatatgttcagttttgtaacatcgtatattcatagaagaaaatagtaagtagggagatacattatttgtaatcatgttatctcaagtttatctcatttcaatttaaagaataagttggttctaaagaaggggagctactagattgctcaatattgcttccatacaccattacaactacaccattcgagtactttgttcataaagaaggagagcgatatacgctgcaaagggaatagtttcaatgtagcatataaatcctatgttgtgcatccacattaccaggtataaccgtttcattagacgttaatattatttgcgaaagaattcatgatattgcatgacaaaagttttttgtgttcgtgttcatgtacacacgtctatgcgcaagatcatgcactacatgaacaacaacatatggaaaaattgagaacggtttcctttgaagaaggggaggacgatgtgttcatgcctactatagaaacatgaaggcatggagaacaagcaaaaacaattcaattcggccacgttgaacaacagtgacttcaaacggtcaccaattgtgcataagagctttgttttgggcccatgatggaaagctcttggagtcctctttccaatggatccagtcgcatctccaaattccatctaagttggccacaattgcaaaatcaatgtactgtatcacctgggaccccggcctggggtgcgccccaaacttgtggagcatgaccctaggaaccccttagtcgtcgccccacctccttaaataaataggttccccttccgaatttctttggttttgttagattaaaatttagccattactactaaccttgtatttgcgcgtgtcggctagaccgtctaattacttgtcttcggagccccaccttatcgtgatctttaattcctatttacaatttagattgtttttatcttgttcttgcttgtttctttgatttacttacaggaatatggctgatctgcaccggtaagatcaacaacccatggtaaggcacaacacaacaacgcctcaaacaattgtaattgcgccgacaacttctctcccaaatcgtatttatctcaactcatcgaaagaaccggccaatcatagcagtgtgtgtatcgatcggagcttagggcttatcaacattattttttggagatatgagttttttcttatatatgtagaacttttttgaatagttcaatcggaacctaggaaacaacacttaactttttggttagggttagagaaagaaagttctagctttaaaaaaattatgtgttggtgtgaaccatgccaatgtacaacaaataatataatctgcattagcgtattaaattgagttaatctagaatttaaaacattttacaaagtcaagaagatgaaatcaatttatgctaaatttgcattttatttctggtgctagtttgcagtaagtaatatacaatttgagttgactgaactttttttttgttgttttatacttttcattatgaaaatcaatagaatacataactcacctagtagaagattggttttcctttttttttttagaagttgtacactgcttcattttctcatcgcactctaattatatttataccttctgttgctctcctaagaaatccaatcagaaggaaaaacctcacttcattcatgatagtcgctcgagttcccttttccttttagttcagtttcgcctctcctcgtttccttgtctccattctgattgattcgcttcttcgtacaagcacttggttcacccttgactacaataatcgcactcaatcttttaaaccgatgtttcatatgctcttgatcacatcatcataagaaaatactgttaaatcttcccgatacgagagaacgagggaaggcatgttacaacttactgcttaaaactacaagattagcgataagaagaaaccttagtttaagtactagcgtcccaccccaacgttcttgtagttaaaaagcctctcccagctccttgctgctcgcctcgccattcgtggcttatgtagtggttggcattcctacgtactccgagtgattcccacacgagattatatgagaagatttatacgtgctccgacttattgcctcagccttttagaagggcatttggtgcaagtgtagtcaccaatagtattgtggcatattcctcgacagatgcctgttatactacactagtccacatctgtaaccacacacattgagagcgaagagatgtcctcatcgcaccttattgaggagtcttagcttcaagatgtcattacagacattatagaccttactgacctattcacgaaaggatggtccaataatttggatgcagaaggtctatcatccggatatggtctcaaacactggcttatgaaatcacgagcctcctttgaaaggtattttgggattgctggtggttcaccccttccgatcttaaataaagcttgtgcctgtaaaacaacaattgaagaaatagttggacacatttaattgaacaagaattgaaggaataattcaagggaattggatcatagtggacacatttaatttatcgaattttgacacataatttaattctacagtggaaaacaattttcctgatgaagaataactcacccattctaaatttgggtaaggcagttgacgtgtcaacatctccaggactgtgcaaccgagactccatatatcagctgccgttccatatgtcctcttgggattgacaacctgaatgttcagtgtatagatttaagctgaattaagcggcgtactgctggtaaatttcagtacatgagaacaaaactctacctttgccatcatagacagtttttactatttgatataatactagctagccagttcttagcgtttattaacattaaattgttggatatatccatggccacattgtgccagctgactttcactttcacccaagtccacaatgtatatgtgccgctcatttttaggataatatttcagtactttttattctggacaaaacatcgaaggagggggagaaagctatggtgacaaaaaatcttagcatgtccattttgttatttctttattttttatagaaaaaactcatcgatcatgcatggtggtatacctcgggtgccatccaataaacacttccttcacatgatttaagcatgctgaatttgtttatctgaaagagataactaataaatcaagagtagaacaaagtcagtaacaaagaactgaaagatctaacacaaacataaatacagattctgcccagcagaaagcagagacctgcttagcaagaccaaagtcggcaagtttcacagatccattcctatgcaccagtatattgccacacttcacatccctacaagaattttgaacattgaagtacatgagtatataattaatattttattcctttgcaagacaaattgagaaatctagtgagcaatttataattaagaaatcccatttatgctacaaaattacaggttgaaattgcctatggtgcaaacagacgtatgaatattaccgatgaacaatgtttctgttgtggaggtaagtcaacccattaaggatttgtttggggatcctctagagt

SEQ ID NO: 19253 - DNA, 7852 bp, Oryza sativa
  unsure (1)..(7852): unsure at all n locations
nnnnnnnnnnnnnnnnnnnnnnnnnnnnnnnnnnnnnnnnnnnnnnnnnnnnntattttttatagaaaaaactcatcgatcatgcatggtggtatacctcgggtgccatccaataaacacttccttcacatgatttaagcatgctgaatttgtttatctgaaagagataactaataaatcaagagtagaacaaagtcagtaacaaagaactgaaagatctaacacaaacataaatacagattctgcccagcagaaagcagagacctgcttagcaagaccaaagtcggcaagtttcacagatccattcctatgcaccagtatattgccacacttcacatccctacaagaattttgaacattgaagtacatgagtatataattaatattttattcctttgcaagacaaattgagaaatctagtgagcaatttataattaagaaatcccatttatgctacaaaattacaggttgaaattgcctatggtgcaaacagacgtatgaatattaccgatgaacaatgtttctgttgtggaggtaagtcaacccattaaggatttgttttgtatatcgcgaaacatgagaatttcgcaggcgatatttctggtacaaggatgcaagagagccttgtgacattagttctaggaagacgtaaagttttgagtcctcctgcagtcgtcacacaatggatgatcatattaaccttaaaagaaatatgtataagaaaacctatgaatttatatacaacacaataacacatattacttcaacaaatagatgaacaaccacaagatcccctaaaggcaaagatcacaagatcgatcaggagcttactttgtctgtaccatagtactgtacaatgttattgtgttgcagacgactcaggagtgcaatttcctgaacagattattagaaattagtagatgctttatgatctgaaaatacaccattaccaacagaaatatatatactccatatattatcaacaagagaagcatctagcgaaaccaacctgctgaagctgaaaaatacactgttgtgcatcgtcgtatttcccttgatcatctaagtacacttctttgacagcaaagaaaacaccctcgctgttacgataaaatacttgtcagccgtaacatggttgtataggtagctatacaaattttattttctttctcgaagaataacactcagggtaataaaaaagaaaaacaaattaaattacatatctgttactttttaatttgagtttttataggtattaattagagttgaaactaaaaaagatcagtactacaacaaagtgattgatcagtagtaattactccctccatttcatattataagatgacttcattaaatttctttagattttatgaagattctattaaaacgtagcaacatttctaacatagaatagacatactaataaaatatatatgttaacggcaaaatttggtgcatgccgttaggcaaagcaagtcaaagagatggttgaagttgtgattctagcaaggatggttggaaagtgtatcagatatatttaaccaatcttagaagtattttgtttttagttttcgtattaaggcaagtttgttagtttccttttctaacaaagttaattttgatgagttctaagtatcgagtttagactgcaccggtttcgatctccaacgagaaagtaagctccatcaacttcgcttatatcggcctaattagtaatttctcgattaagtccgatattctaatcacattttactaccgttccttatctgatatatcgactctttctttgatttctttgctttcttaatttgattcaatatatctgatatattggctctttatttgattgctttgctagtttgatttaatatagatctatcaagcctttcatcaaacttatattgtcttggttaagtccgatctgctagtcttttattcgttagatagacttattcaggcttgataggctctgttcaaagttctatcggagttttagctgatgagttatccatcacgattgtatagatctatcgactagatagtttttcttattgtcttcaatcctatactatctcattttgtcgacgggtgatacccgtagaccggatatagagggtattggggtacgttggtacaaggatctacgtaatacgacatcaagcagacaaaagacaaagattatactggttcagaccccttgatatgtaatagccctaatccagttgatgtgggattatatgatggaaaacacaggttacaaagggaatagtggaacttgacgaatccggcgagatcgtggtcgagttggctcgactacgatccctggcgatttggctcattgcaggctccgacttcgtaggctgtgtgggttgtgttggctctgagattcgatgccttaggtcctccccggggggtcccttttatatcacaggtcaggcggtttccaagtagaactcggaaacatcaaaccttacacgatacattgacgacccagtcttgtccgagtaggactcttttcatttgtaaactccgtgaggggtttccttaatttacgcggagagtatccgtatacgtgtgggtatactacataggtatgcgacgtacgtcaaagggtaaagggtatacctaacccgtaaccctaacagtagcccccgacttctgcttaaataagctcgtgtaaccattcacggcttcttgtgtcgagactgttgtcgttcccgatgcgaggaccgtagagacaggacgtagtcgagaacaccgtttgaagcccaacggtcatgagcgaatttaaactgaagtccaaaaaactgccgcgcgtaaaggacccagaaatttccggcgagcatctctctcctttccttggaattcgcaccgtcggtagtgtgtctatttaaaggaattttgaggatccaaagtccgcccatcgtgtagaaaacatccagcctgcaagcgctcttcgtcttctccactcccacaagaaaccctagttcgtcggccttagccccttctccggtgatctccgatcgacgatggatcttggcaaatcatcctccaccagcgcgtcgctgaagaagctttaggaagatggcgcccttcccggtcgtgggaccatggaaagggaagcaggaggtactaatccccagcctgtcttaggtcgcatggttgtgatcgaagactacattctctgtgattttatccctccgccttccgaatttcttctcttggttctgaacttctacggtctttctctgctccacctgaaccccaattccatcgcctttcttagcatcttttctcatctctgtgaggcctacattggggtagagccctttcttgatctctttcgcttttactatgagctgcgttggatggagcccaacagggtgtctggatgcgtcgggttccgacttcgggatggcctgaagtcgcgttatatccccttccagtgcccttcttctcgcagcaaatggcggacgaggtggttctaccttcagatcaaagattcggaccctgtcttcattgttcctacggaacaaccggacaaaatcccgtcttggactgcaaagccccttttgactctttctctccaatcgttcatcgacattgtcgatgatctccgagtacgaggcttgtcgaggtatgaagtcactgcagacttcgttagaagacggatccagccgctccaggctcgagtccatccagcctttgactattccggaccggaggacgcgacccgggtttctcctcagggtatctttctcgcatttatcctgacatgctcatgtccacgttcctcctgatttatcaaaatttggttctcgattcacaggtctgaacagcgaaaccgtgggacgtcgtgtcggccaggtgatgatcagcagcccgacaacagcgagtaacatccccgttcccctttgtgaaaagcgggcggctgaacgtgatgctgccatcaatgtaagtgttctcgataggcatcctgcgttttccttttgagatcactttatgacttgattaagcgtaggctcttcctctgactaacatcatcgggccgctcgcggaccatcaggtggcggcgtcactgaaagagaaggtcgccaaggaggcgtctgatgctgccgctgctaccacaagtggtggcaatgttctgagaaaggggaggaagttctctgtaagcggacatcgtcgcaaggcatcaaccccctcgataagctatcctgtcgtcagatcatgcagctagaagaatttcgccttacttcgcatcaaccgtttttcaggcctcggacgcgtctcccctgcctccacggcgacaacgtcttgtgacagttggcgagaagtaagtagatgaacttaagtcttcgtgattttgttcgagtgttgtctgaaccatagctgtctcacagggcggcgcgggcgaaggcggtgcaagacgagtccggagggacttccggcgcgtctcccgctgcagcctcgacggatgtcgtgcttgcgcctgggagccgcgaggtgacaccaagcggcccagtcagcgatcccgcagctggtcgtggtccactggctgccgtcctcacctgggaggatctccaggtcgaaatggggcgcctcctcgaggctagtgctcgcggcattggccgtgatggaagaagtcggtgatctgggggaatctgttctccccctttttgaagagtaggacctcttgtaatccctagacatgctgtgtaaacctggattttaaccgcctttgtgtgtgcagctgttatgctagttcactcttgtatgttgatcttgaaaactagttcactcttgtatgttgatcttgaaaacttttgtcccttgtagagatgttgatgacgaggatgtccagcaacgcgggcagcccgagtttgaaccacatgcgtcgcccgacaatgtagaccagacccttgctacggggccagagatggtgacgacttccttaggttagtagtccattcatccctttctgctcctccgactagatcagctctgttcttgaaagaggcgtgtagcttgacttagttgttcccacactgagcagatctcgagagtgctcttggtggccaagatcgtcgtatccaatattggaagacaaaatttgaagtagcggatcttgagagaaccatgcttgcagtgaagaaagagcaggctgtggaaacgctccgaggtggtgaggtgtggttcaactcgtacttgaagagttgctgcacatccatggccagggtttgtagagaacttcgagtaccccatggagatcccgaggagtcagcagctggatacatctcatggctgaacggagcctgtgctcaacttgatggcgtcggcaagcgtatcgacgaggccttgaagcaggagtgtcatcgatcgagccgatatgccggagggcacgtgttggcttgcctacgagatctccgtgagggctttgctcgttctcggaggactccggcggagatagaccacctggcgaggtcgatggcgccgttcgcggagaagatcttccagtctatggactggcgttggccttcttggtagtcttcgtaccctgtggtagatatctcaggaaaaatgtgtaatatagctttggatttgtgtaaaaactgtaagaaatattttgtgaaatagaaaagaaatctatctttaacaaaacaaatctttcttactccagatgtcgtgtgtaagagtgtgttcttagttcacgactttagtcagtcgtttgagtcgtacactctccctagcccccagccttgtcgtcggaggaattttctcggaggataaggctcttggacctttgacctgccttggttgaataagctctgatcctagcccccagccatgaagttggaaagttaatttccgatttcacggcttggttaatacgcacggcgagaactcttacacgaccagatcttacatggtctttcgtctctacaggatctgacaaggccttatcggctctgggcgtccccagccgaagatcctttaggttcctcggaggccttgtcaagacagcgtaaagggacatgaggataggtttcaacgctaggtgtcatcagggtaagggatcatcgggcgggaacactttgattgtaatatgggcctaagaataggctttactgatactgtaaggtgtcttacaggtacggatggtattgagtcatacatagaatttacgtagttggttaatgttccaggaatttgctaactcgtgaccatcgccgtctgcaattttgaatgcgcctggccgcaagacttgtgtgatcgtgtaaggtccttcctatttgggtgagagtttgtttcgcgctgcttggctttgaacccgtcggaggacgtagtcgccgatcgaatgtatgcatactcggatgcgcttctcgtggtaacggcggagggcctgttgatagctggctgctcgaacgacaactcgttcgcgatgttcctcgagtagatttacatcgacgtttcgctgctcctcctggtcctcgtcggagtgcttctgtactcgtgtactctgatgtcatagctcgctggggagcatggcctcggagccgtacacgaggaagaaggttgtttccttgttacacgttgtcggtgtggtgcgtacggcccatagtactgatgggagttcctcgacccattttttgtcatgtgacatgagcctgtcgtagacgcgggttttgatcccttgtagtactatgccgtttgccctctcgacttgtccgttactttgagggtgagagaccgaggcgaagcatatcttgactcccagcccgatgcagtaatcctgaaaatcagcgctgatgaactgggagccgttgtcggttatgatgcggtgaggtagtccgtatctgcaaaatatccccttgatgaatttgatggcgttgacagccttgatttcccccatgggtactgcttcgatccatttagtgaatttgtcgatcgccacgaattggaacctatagccgccctgtcctcgtgggaatggcccgagtatatctagcccccagcacgagaacggccaagtaagagggatagtctggagcgcttgcgcggatagccttgtgtgtttactgtggaattgacaggcttcacatcgctggaccatgtcgcatgcatatttaagggtggttggccaaaaaaacccttgtcgaaaagctttcccgaccaatgtccaaccggcggcgtgtgacccataaatgccttcatgtatatcaaggaggaggtgtctgccgttgtcggacgagatgcttttgagaagtaccctgtttggcgctttcttgtatagattgttgccgaccatacagtagatctttgctttacgggttattttctcggcctctgtatcgtcctcgggcaactcctcgctgttgatgaatttgatcagtgggaagcgccagtcgtctgtggtctcgatgtcggcaacggcgcgttctgcctttgtggccttcgagctaatatcgagggtgaccggactaacttcgccactaacctcttttactgatggcttcgtcaggatgtccagaaaagtgccgggctcgagcggttcttgtctggacgcacgtcgtgctaggtcatctagctcgatgttgtctttgcggtagacgtgtcggacttctatcccatcgaaccttttctctagcttcctgacttctacgagatacttggataactcggggttagagcatttataatctttgtgcacttggttcgcgactagctcggaagcccctttcacgattagtcgcttgaccccaagtgtggctgcagctcttatcctggcgagtagtccctcgtattccgctgtgttattggtcaccctgaagttgaggtggattacgtgcttgaa

SEQ ID NO: 19254 - DNA, 23331 bp, Oryza sativa
  unsure (1)..(23331): unsure at all n locations
ggcttgaaagtagtggcgtagcttccttgatgtcataatgaccgcgtaaagcagcttttggatttgtggatatcttgtctttgcgtcatggagagcttcgctgacgtaatagactggtcgttgtactttctctctctcgacaacgatgatggtgctaacggaatatggcgtggcggcaatatagaggaataattcttcattaggttggggggcaacaagtacaggggggtttgataggtagcgcttgagtgcaacgaatgcctcttcggcttcctgtgtccatacaaatttgtcttgcttctttagcagagctaagaaaggttgccctcgttctcccatcctagcgacgaatctgctcaatgctgccatgcatccgattagcttctgtacttccttgagtcttgtgggtgacttcatgttctcgattgccttgatcttctcgggatttgcttctattcctctgccagagacaaggaaaccgagcagcttgcccgacggtacttcgaacgtgcacttctctcgattgagcataaggtgatatcgtcggaggttgtcgaacgtttcccgcagatcgtcaatcaatgagtcgcatgtcttgattttgacaacgatgtcgtcgacgtatgcctcgacattgttgccgagctgatcgctaagtgcgccctggaccgtgcgctggaaggtattccctgcggttatcagttcgaacggcatcttaacatagcaaaataccccaaacggcgtgataaatgttgtcttctcttcgtcctcttttgccatgctgatttggtggtagccagagtaagcatcgagaaagctcaacagctcacagccggctgttgagtccactagttgatctattcgagcaagagggaagtgatccttggggcacgccttgtttgaggtcggtgaagtcgacgaacattctccattttccgttggccttccgcaccatgactggattggctagccactctggatgaagtacttctctgatgaagctagctttgagaagtttgtcaagctcttctcgtatggcttgttttcggtctggtgcaaatctccgtagtctttgctttactggcttggcatcgggtcgcaccatcagtttttactcaatcacctccctagggacccctggcatgtcggacggctgccaagcgaacacgtcagcattatcgcgaaggaaggtgatgagcgcgagttccaatttctcgcttagtatcgccccgatcttaacggtcttgtcgtggttggcactgtagagcggaacgatcttgattgcgccgtccggtttcagcgtcttgtttgtcttgctcactttcttgggtggctcagtcgtgtcgggtgggctgggcgtttgctcgaccatgtcgaggctccgtttgtcgcattgcaccgccagctttgtgttcccttgaatagtgattgttcccttcggtcccgacatcttgagcacttgatacgcgtagtgagatgcggccataaacttcgcaagtgcagttctcccgatgatggcgttgtaagctgtatcgaattcagcgacatcaaaggtgatctgctctgttttctttgcacccccaacctctgtcggcagttcagaacttcatcagataggactgtcaaaaatccccatcgtcagtgaattcggtgacgtatttccggaagaactacccggtatgccgcccaagcgggagatcgagttccggatagattttgctccaggaacaactcctatgtaaaagcggccctaccatatggccgcgaatgaactggccgaagtcaagaagcagttggaagagctgaaggaaaaggggtacatacggccgagcacttccccccagggtgctcccgtgatttttgtggaaaagaaggacaagacaaagaggatgtgtgttgactacagagccctcaatgaagtcactatcaaaaacaagtaccctcttccccggatcgatgatctgttcgatcagcttaaaggtgccactgtcttttctaaaatcgatcttcgctccggatatcaccaattgcgtatccgtgaagaagatatcccgaagaccgcattcaccacgcgttatggactgtatgaattcacggtgatgtcgttcggtctgaccaatgctcctgccttcttcatgaacttaatgaacaaagtgttcatggaatacttggataagtttgttgtggtcttcatcgacgacattctggtgtactcacaatcagaggaagaccatcagcagcatctccgtctagtgttgggaaagctgcgggaacatcaattgtatgccaagcttagaaagtgtgagttctgtttgtctgaagtcaaattcttagggcacgtgatatctgctaaaggagttgctgtggatcccaaaacagtgaccgccgtcactgattggaagcaacccaagacagttactcaggttcgcagctttttgggtttggcaggatactaccggaggttcatcgagaacttctccaaaatcgctcaacccatgacacagttgttgaagaaagaagaaaaatttgtgtggagcccgcaatgcgagaaggcgttccaaactctcaaagagaagctggtttcctcgccagttttaatcttaccggatactcgcaaggacttcctggtgtactgtgacgcttcgcgccaaggattggggcgcgtgctcatgcaggaaggtcatgtggtagcctatgcctcacgctagctacggccccatgaaggcaactaacctacccatgatttggagttagccgctgtggttcatgctctaaagatctggcggcactatctcattgggaatcgctgtgaaatatataccgatcataagagtttgaaatacatcttcactcagtcggatctgaatcttcggcagagaagatggttagaactcatcaaggattatgatgtgagaattcactatcatcctggcaaggccaacgtggtcgccgaccctctaagtcgaaaaagccattgcaacactcttggcgtccgtggcattccaccggaacttaatcaacagatggaagccctgaacctaagcatagttggtcgtggattcttggctacgctggaagccaagcctaccttgctcgatcaaatccgcgaggctcagaagaatgatccggatatgtatggactcctcaagaatatgaaacagggtaaagccgctggtttcacagaggatgaacacggaaccctatggaacggaaatagggtatgcgttccagacgactgggaacttaaacagttgatacttcaggaagctcacgaaagctcctattccatccatcctggcagcacgaagatatacttggacttgaaagagaaatattggtggattagtatgaagcgggaaattgcagagttcgtggccctttgtgatgtgtgccagcatgtcaaggcagagcaccaacgaccggccagacttctccaacctctccaagtaccagaatggaaatgggatgaaattgggatggatttcatcaccggacttccaaaaacccaaggcggatatgattctatatgggtagtcgtggaccgactaaccaaggtagctcggtttattcctgtgaagaccacctatggagggaacaaactagccgaactttacttcgctaggatcgtgagtctccatggcgttcctaagtaaattgtatctgatcggggaagccagttcacctctcatttctggaagaaactccaagaagagttgggtacccgattaaatttcagcaccgcgtatcacccacagacagatgggcagaccgagcgtctgaaccagatcctcgaagatatacttcgcgcatgtgtcctaaattttgggaagacctgggataagagtctcccctatgccgagttctcctacaataacagctaccaagccagcatacaaatggcaccctatgaagcgttgtatgaccgcaaatgccagacaccgctattgtgggaccaagttggggaaagccaagtgttcgggaccgatatcctgagagaagctgaagttaaagtcagaaccattcaggagaatctaaaggtggcacagtctcggcagaaaagttatgcagacaaccgacgccgcaacctagaattcgcagtggacaattttgtgtaccttcgggtcacgccattgcgaggtgtacacaggttccagacgaaagggaagcttgcacctcggttcgtgggtcctttccgcatcattgctcgacgcggagaagttgcttaccagttggagctgcccgcctccttgggcaacgtgcatgatgtgttccatttgtcgcaactcaagaaatgtcttcgagtgccgtccgagcaggccgactcagagcagattgaagttcgcgaagacttgacctacgtagagagacctgtgaaaatcctggacaccatggagcgcaggaccaggaatcgggtaatccgtttttacaaggtccaatggagcaaccacgccgaggaagaagctacttgggagcgtgaagacgagctgaaggcagcccatcccgatctcttcgccagttcttctgaatctcggggtcgagattccgtttaagggggtaggtttgtcgcgtcccaaaaagaccctaaaatatatcctttaaattatgcctagaataattaaaatccgtgtgaaagcctccaaaaataaaaatgtgcaaagtaaaagaccaaataaggcttagaggatttttgtatatttcctaaaaggctaaaatgtgtaaataaattttagtggaattttcagagcacaaataataattgttaagaaataaacaaagttaaaaaggttttataaaaagaaaaaccctaaaaaaagtcccctccctctcttgggccggttcggcccatttccctccctctctcccttctctccccgcggcccatccagagtctccccgcgcgcgcgccgctgacgtgcgggcccgcccaccaccctcgctgacgggtggggcccacccgtcatccccgtcctcccgccgctcccgccgccccgcccgcgccaagcgccgccaccgccgccaaatccgccgcatcccgccgtccctgcgtgcattaaagtggggggaaatgtttcccccgattccctctccctttccccccaattttccctccctctctcccttggataagtttgaaaacccctcccctaatcctgccggcgccattgatggagcccgagaacgccgcgctggtttccttcccctccggccgccctctctcgccccggccctatttaaaccctccccgcgcttctaccgtccgtttccgcctctcgccacccttcctcctcgctggattcgagctcgcgacgtcgctctctctctccgccgtcgtcgccccggaccgcctcccacctcggcgccgcctccttcggcttcgccgcatccttgccgacctcgtccacctctccgtttcggtcgccgaccgccggagcgccgccgtccccgtcgacccgagccgcgccaccgcctccctccgctccggccgcctcctccgtagccgccgttgcctcggggtgagccgcggaccgccggctcgtttcccctttcccttcccctctctcggccgcctctccgccgtgccatggccaccatcggcgaccataggggcgcgggtgcgccacctctcaccgaccgcgccctcaggtacggctgacgcgtggggcccacggccccggccggtgtgagcccgggtgcgcccggtccaccgtggaccgtgaggctgcagcgtgggccccactcccgtggacccggtccgcgcgcccctccccctcggctgacgcaataaatcccttttaaattaaaatttaaatgaagaaattcgtaaatattcatttaaagagcatttaaacttcaaatggccataacttgaccatttgaactcggaattggaccattcaagtctctaatttttccttaagaaatcaagaacccatttttgtgctttattcctgcttgttatgtggagtttattagcgtaaaagcccttttcttttccgttggtcgtgtagacgctgcagcttcgaaagatccgctctacgtggaggttgaagccgacgtttgggaaagccagcaaggcaagtcacatcatccttgaatatattgaatcccagtttataaaattattttgatttaaattaatgcattatcgctttatttaaattcccgcgttatcactgttttatttagccatgcctatttacctttgttatgaccttattattgctattgttattattaccttgttcaccctagaataaataaaaccccaactagtgtatactctattcatggcaccactagtatgaatttaggtagatgcttcgttggttaattaggcaacattaggtggttttacaactctagactttgggaatattcatatcacctggacactatggaatggttggattatggtggaattggattcacacctccccctctattcaaaatcctcaaaatggttttaggctgggctcggggtgcatggttttgatagtagcacctcggccacataaggaccggtcttcgggcctctattgcaaagcactaccgtacttccacatgtctagtgggtaaggcttagtttgaggctcagtctggttataaacaaaagtacacagatggagatggacgaagtcgggggtcgatggacatctctagggcaaatgaaggctacacgagctgcggctcggtagtcgagatgtcatggcacagggctggtgtcctgctgctaggggctcagtcctgcctacctgtcccagaggttccggccgtaggtggggttgggttggtactcttgtctatggctaggatgggttggaaactatgtcacgtcttccgtccatataccgtggtggtatgtggcatgtggttacacgtgaggaagatgtgtcttgtgggtaaagatgtacacctctgatcagagtataacctattcgaatagccgcgccctcggttttgagcaagccgagcaatgtacccaagttagtgttttaattcttaaaatctgcttaacaactaaaatgtggaatggttggcctgggttggcttgggacgagctgggacctagggtcaggttgccaattcggtctaaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccccttatattataactcccttgtactcccttgcatttattctgcacttgtgggtgtgtcttgttgagtacggtggttgtactcagtcttgctcaattttttccaaacccagaagaggagttcctagaagatgaaggctttggtgtctagctcgtgcctgctgtcaagcgcctgtggtcgtcgccctagtcttccgctgttttttatttgtcttcctgtgtgctaggccttcgccgcccatgtaataaattaactatttacgcttccgcttgataaactttgaaatatatcaacttttggtgtaccttgcctcctgggacaaggaataatacacgcacataaggaacgcccgttgggttatttccggtcatgacaaacagacttcgcgttccactttcttgtactctcgcttagaggagtacgttgtggaacctccgaagatgtgtaaaacgtggaggtcagagtctggatatgctaaatccgattcctggggagccgcctccgcatccttttcgaccacgcatactcgtttgcctttttcagatgcaatgtgcttctcgagcgatttttttgaaaacaaggcaatcttccagacagtgtctgtccgtcttgtgtatggggcaccatgctttctttgtgtcaccactttgtgggtctgggcgcttgggagggttcgcgtattctgctgcgaggacttccgcttgagatttccttttcccagttgtgcgatttttcttcttgcttgactcaagtgcgtcccgtggctgggatctttctctcccccggtcttcggcttatcattcttgcatcttagcgcatcatctgcgtgggcgcatcgctcaacaatctcgaacaatcatcgagtggttgtgatgcgtcttgtcgccaactcctaggtagtatagcaatctctgacaccggatttgaaggcgtgaattacagaagcgtcggtgatttcggggattgtatttctgcactcgttgaagcgccgaacatattccctcaaggattcacccgagttctgtgtcaacgcgtgtaggtcgtcttcgatcgcgtggcgcttgtaggttccttggaagttggcgacgaactgttgccacaggtctgcccacgaagagattgagtagggcagaagatgcatcagccatgaacgtgcagagccttttaacgcagttggcaaataattcgccaatgcgttgtcgtctgctccggcagcgtagagtactgtgaagtagacttgaaggaactcttctgagtcggtgctcccatcgtacttttctattgctccgggtcggaatctctcaggccatcagacatcacgcagggaacgactgaaagccctacacccagcgctggggcggtgggttgccggcgattgtgtgtccttcgtggatgtctgtctgatgatgaggaagccgaggatgatgacgatgacgatgggtcgcttggttccggcgtacgatcacgaggatgtcggcctggatctcgagaatcctgtcgtcgtctcccgctgttgtcccggcgccagtctccatcatcgtcgtcgttatggcgacgtcctcaaccagtatcgtctggcacccgccgttcgcgatcgttgtgatcgtggcggttgtggcggttatcacggcctcggtcttcgtttgagcggtctcctcgatcttcgtcattatggcgccgtgaagagacatgacgccgggaacgattttcattgtctcgtgtgcgtcgtgcctctcggcggccgttgacgtgatctcggagatcgctagtgccgcaaggtggaggggtggctcaatgaggcgattccctccattcaggctcttcaccattggcatcgccagttggtggctgctccgggtgcgctgcggcggcggcctcttcgaacgtgttgctgaggttagtcactgattcccgtagtcgtgctgtccaacgagcgagatcgtcgttcagaacaggatcgtagggggtttccctcagtatagcgttgacggctctgatgtgctgggccggggtggccaattgattctctgcttctgcattggtgcgcgctgatgtgccgacatcatcgatagccaatacctcccgcagtgcgctcgttgtcgatgatccatagtcttcgagaaggtgcaagactgatggttcgtgaggatcgatatcgattaccccaacaaatcgatctgaagttggcgtcgctcctcgttccttgtctttatccctgatggggatgtgtgactgttggaccttaggaggtggcgctttcatggcgctgagaaggaccttgcagcttgagaggtcgtgattctttgtcttgtgaataggacaatagacatcacgagttggagaaatacgctgaattccacgctctttgcagatacgaatttcagcgcggacgttgaggaaaacccagcaggtttgcaaagtgtgtttgctggttttgtggataggacaccaggaccttgttgcttcggaagtcatcttcgtcggctcgcggttcatgtcggaacgacaaggtttggccgcattagaatccttctcgagctcggatgtcgtcgatattccgttcttcgcctcggtgggagtatctttcgacatggagtcgtctcggtttgtagccactgcgttctcgtttccagtcattagtggacaggttgagatcggcattgtggtgtaaaccgggaagacgatttcgccgacttgagtccacactagcatcgttgaagcagggaatacttggctgaggttggtgttgacgctgttgttgacgaggctggatgacatagtagtagaaccttgagtaccaagtgcccctacctggcatgccactgtcgacgggtgatacccgtaaaccggatatagagggtattggggtacgttggtacaaggatctacgtaatacgacatcaagcagacaaaagacaaagattatactggttcaggcccctttataggtaatagccctaatccagttgatgtgggattatatgatggaaaacacaggttacaaagggaacagtggaacttgacgaatccggcgagatcgtggtcgagttggctcgactacgatccctggcgatttggctccttgcaggctccgacttcgtaggctgtgtgggttgtgttggctctgagattcaatgccttaggtcctcccggggggtcccttttatatcacaggttaggcggtttccaagtagaactcggaaacatcaaaccttacccgatacattgatgacccagtcttgtccgagtaggactctttccatttgtaaactccgtgaggggtttccttaatatacgcggagagtatccgtctacgtgtgggtatactacatcggtatgcgacgtacgtcaaagggtaaagggtatacctaacccgtaaccctgacacatttaggaccgatctatcggctagatatgtttaattcttgaaagccgatatgttttatacaacgtttcatcggagtttaattctagccaatgagtcattttttatagtcttgaaaagtatggcaccgtcttatgttcacatcggtaaaatcagtaactaggccctgtttgtttcagcttaagattattgtaatctagattattaaatcagattactctaagctgaattataataagctgacatagaataagctgcgagttgtttgtttctctggattattagaggcattaagggtagtgggtctttagccactcaataatctggaaaaagctcattcagaggagattattagattatactaatctggcttatagattatgataatctagcatgataatctatttgtttgtttcagcttactcctaataatccagattataataatcctaagttgaatcaaacagggtctaagtcatcctttgttagtttcaatggtttggtcccagttttgtgaaggtaacttagctttggaaagtttaaatagatctttcattactcttgttcccaaaaaatcaacacctgagagggttaatgaatacagaccgatttctctccaaagtgtggctctcaagcttttaacaaaggttcttgctgataggcttcagtctgtaattacagaactcatccatcaaaaccaatatggtttcatcaaagccaggacaatacaggattgtctctcttggtcttttgagtacttacacaagtgccaacaatcaaaaaggaaaatagtgctgttgaagttggactttaagaaagctttttatactatagagcactctactattttggacatcatgagacaaaaaggttttgattcaaagtggttgaattggattgatttgatcttttcttcagcatcttcttcagttcttctaaatggggttcttggaaggaatttttattgcaaaaggggtgtaaggcaaggggatccattatcacctcttttatttgtgctaggtgctgatttactacagtctgttgtcaacaaagcttattctcagggtgttttgactattccaatcccaactcctgataatggctttccagttgtacagtatgcagacgatactctccttttcttgacagcttcctcaaaagagcttttctgtttgaaggttattctcaactcttatgcagattctaccggtttgaagattaactacagtaagtcatggatgattcctctgaatgtggatatagaaaaggtgcagcatttgtccaagatgtttggttgctcagtgggcactttacccttcacctatttaggtctgcctttgggaacaactaggccaaagataattgattttgcccccttagttgatagggttgagagaagattgtctgctacttctgctcttctgtcttatggagatagattaactatggtcaattcagttttatcttccctcccaacttactatatgtgctctctttcccttccaaagtcaataattgaaaacattgatagagctagaagaaattgtttatggagaggaactgatattaattctagcaggaaatctttggttctttgggaaagggtttgtcaacctaaaagtagaggaggtctaggagtcattaacctgaggctgcataataatgctcttttaatgaaaaatatgcacaaattttataataggctctcaataccttgggttagcttgatctggtccacttattatattaataaagttcctcatgctgatcgccctagagggtctttttggtggaaagatgttctacaatttgcagacatttttaggggattgtccacctgtaaggttggggatggaaagacttgtctgttttgggatgatttctggaataataaagtcaggtcagtaatgtacccaaggattcactcttatgctgtttctttgaaggattcagtgagtttaacctcttccaagagtatttcgcagcgttttaatctccctctgtctgagcaagccttccatgagtatgatacaatgtctgcagctgatcctttagatcaattatctgatgagaatgatgtctggtcttatgtttggggaaatggtttgttctcttccaagaaaatatatgacattaatttcatgcatatacatgcgcctagttatctagcttggatctggaagagtaagtgtgctatgaaggttaaagtttttggatggctcctgttaattgatcgactcaatacttatgacatgcttaacagaaggcattgccctcccaataattcggatctaacttgtgtcctttgctccacctgtgcaagagaaaccacctttcatctatttttttaatgtccttttagtgctgattgctggacatagtttggaattgtctgggatatttctcttgccttcatagatatgctgcatcagacaatgaattcttataagtctacgcactttatggtgaaaattcttttatgcagcctggaatatttggaaacagaggaactccctgattttctagaatttagcaccctcaatttcttcttggaaagctctctttaagagtgatctttcccttttagtttttagactaaatgtttctgagagatagtcccttttgaattggttatatcttttgtaatttattttctataataaagctatttaactgtgggggcttcccctacagtgccttccaaaaaaaaatggtttggtcccaactatcaaggttgttttaaataaagagttattcatgattggttatgttcagtttccgtaccagtcgatggctatgcattttagttacgttatttgattaattcactattccattggtcaagtagccaatgaccctaactctatcggtatttgattatttaagttatttgattaattcactgttctatgtattttcgttagttacatgataactaagtggcacactctaaatccgattgataggacctgcagtataactgtacgagagctaagcaaatgtctcgtgccttcgtgtgttagttgtagggtaaaactacactttcacatatacactctggcttctatcggtttatccgtggcgggattaggcacacatcgacaccgctgtaaatcgaaaattagttaggacgcctcaaatctggcctaatactagcttgtcactgcatttggtgctgatgccctaccggtagctgcctaaatcgttcacgtgctcggtgaaatcaaaagccccgctatggatagattccgagacgcggatccggacggccaccattgacgccgatacccattgaaatccccaggtcatcgcctccgtgacagcgtggacgccaccgatgctggagttggacgatgtcaatgcccaacatcggcatgctcttcttgctccccaatagttatgtattccatatccaacgaaacaagcttctagcggcaccaataacgaattcaggacactgcagactctgatcgatccattgggaagacgaatttatgtatgggctcacgaaaaggggagggatgatggggaattacagcgaggcactaggtaagtaggtggtgccactgagggaagtcagtggcgaatcgtggcgctgagatggaacaggaaaaatgttagccccatcgtacctatgccttgcctaatcaactgttagattttttttttacctcttggtagctagcaattggtggtatatccttatgaatggtaaaaagctatgaaaaaaatcgctcgctcagatctgagcatctcgctccacggagtatctgttagaaaattagccccgaaatcaccattgaaaccaaacaagaaaaaaacattatagaaaatccaaacacgttaatgataccgaggaatgatatttaataacgaggttaaattataaactgatccccaggacagtaattgagaggaagagcatttcacttagctttataactgctagatttagttcatgctaaatgacgattttacctctcaatgccttttttttttttttttgacagttacatctctttacgtttctactactgtcaactaagatggcagtagaaatagatggtagcatcatagcagaaagtaaacagatgaaatggagggaatagaaatgatggatccaaagttacttctaattagatgagtaggacttgttacttacttggtgatcccctcgaacaccatcccaaaggatccacgtcccaggaagctcccccgactccaggaccggaccttcctcctcctcctcccaacatcattactcccgttcgtcgggatgtagaacatggactcggtggtcgtcctcctcgtcgtctcatcatccgtcgactccgacagcgaagaccagcacgtgaagaactcaccggacagcaacaccgccaccgcctcctcctcctcctcctcgtcggccgccggaggaaatacggccatcgacggtgcagcagcagcagctagatgctgctgatctggggaggcgatttccacgtccacgcttggcgtggtctcctcctccgggaggtggggaacagcggccacggacatggccagctgcagcagggcagccatgttttgactgacggggagagagtcctgaagggggttgtgtaggaagcagagctggacggacgcggagttggatatctgccaatgttgactgactgatatagatgactagcgatgaaagccttgattggatatctggcttgggacgcgtgaactcagaaaatacttttcctctactgtgcatgcgtttccataaaaagaatatatcgacccactacagcaattatttactacaaaacttacacatcgtttatttttgagctgttggattgtcctgcaggtctcagaatcgttggggtcggcatttgggccagccttctcattcgccaagttccccaccactgggttgtaaattttggaaattttggacatttcggtgggttccgattgtaagtgaggtccggtcaaatatttcggccaaaaaaaagtttgacgtgattttctcccttaactctaaatcgccgttctcttccccctccgtctcccctcattgcgccgcaccgcatccagatcgaaaaaaaatcgccatctcgccaagtcgccagtcgccgcctcgatgtcggtcgccgccctgacgcagcccaccgccggcgcccctagccatcgcctgcagccgccctagctgtcgcccgtagctgccccaaccggtgcccccagccgtcgcccctagccaccctagccgtcggcccgtcgcccgctgctcgatgcccctagctgtcgcccgctgctacggggcgctggcgcgccgctgagcgcgggtggcggtgtgccaaattaccacgctccgggtgatggtggctgcgctctggattcaaggacggacaaaaacaatctgaattacaaaattcaatacaatgataagttgggattctgaagacaaatagacgggcggtctagccgacatgcttgcatcatctaagcgaacacccatatatgatgcaaggacaaaggacaatatactcaaaaacaaggacggcgcttcttctattcataattcaagaatacctaacaactaacctcgccatcacagctagtgtaatccatcgtctcatgtattcgcatcgccttgagatggccgatattattatatcgcccttagttgtttttaaactgtaatcggttgtattttgccgatgtacaatggccgatattggtatatcgctcttagttcaattttttaattttatcaatgcctttgtcattgcaaaagtagggggcacatatattcacaagttgcaaatttggaaaatttttaagcaaaaagcatgagttatattaatcggcacaaggtttgtcaagactagttacagaatcatcttagccgattacaaaatgtgctaagccttattacagaatgtcactgagacaagtatcgttggatagccgatatagctctttgcctaatttgttctacttctcgaatggcttgggcatcttgagcatcggttccanggatgacttttagggacttggtcatatccgcgacattcttgatagcgattttagtcttgccttctgttcttcgacagcttgtgggagatcggctagctttttatgttccatgtccagctcggtgttgcattcttaaagttgtgccaagagttcatcttgcgagcttcaagtcgatcaatattggatttgatcgggccctcagataactgatcaagcttggccttttcttcatgaacaagctgccgattagcctggattgtggcctcgatgtctttgcgctcccgacgctcggctagtctcagcttggccttctccagcttgaattgttgttgcttaagatagacagctggagtaaggacatcggctagctcatctgggatcagagcttgaacctcatgaagccgagtcctgataggcccacagtctaccaccaaactgtctagtgatgatgcttccatccgatgagagatatcatcaagagttctcttcacatcatcggataagggggctaaggctttgcttgtggtatcttcttttgtctcatcgaagtagtccttgatgtcaaaagagaatagatcggctaacacctgcaagaacaatttcaaggaagttgagagctaaatagtgttaacaaccaaatttggtaatatcagcatcggagaggaagatgggatcgaagcggaatcaaagataaggattgtcgtggaaacagagtaagaatcggctggagtccggatcagctacgattaagatcggctaagtcttggtcagactaggttaagtgattcagccgattccgacaatacgacttgtgtacgacatcgggttcaagttaatgtgcttcaagatgattgtcacaaacggatagagtcctgggaaggcaattgtatctattaattaggatattttatgtaaattccttatagataaatgtgggcaaaagtctgccgcaaagacttatggtatcttagagtttgttagagataatagtcatgtctagtatgggcatatcttgtaattctcgggtataaatagaccccgagccctatgtaacttttaacacacacgttcaatacaatttcggcgcattgccacccttttgctttagttttgtttcgacgagttcttgctttcgggttgagctgcatcggtttcgatcttcaacaaaaggtaaaacttgttatgacggcttatattcttgggattagtgcttccatctttatgatgctctaatcttttttatgtaattcgtcgagttatcatatatcttatataatctctaacaatatcgtcatctaacctacaatccgctaacatctgctaatagagggcagccgattaggttaaatatcgatgttggtttagattatatgagatatccaccactctatgaaacttccagcggcttgattgtctagatattgttcttcttttcatacttaatgctgcatcagttgagtttgatctattcagtcgtgtttagaatatcaatctctagcctgccttcttgttgccgattagggtagcatcagagtttcagccgatcttatttgatttaactatattttctctatatgcttcattgacatgttaaatctaccctttatatcaagatctggtcgcatctaagtatattaggcttctgcttgagtattttacttgctttaatatcttaatataaagtagtatcggagcaacttaaattatcagtatcagcctccatctccacaagcccaatattagccagggaggacaacccaacctcagtttgcttctcagtacagtcagttcgagcctatgcaacagcagcctcaaggagcagttcagcaacgaccgtgggccgacgtgatttccgacgtaatgagggaacagttcggcctcaaaccaaaagagactaggagcttgtatcggcagccctaccctgagtggtttgagagagttcctcttcccaatcgatttaaagttctggacttctccaaattttcgggacaggatggtgtgtcgacttatgagcatattagccgattcctagctcagtgcggtgaagcatcggctgtagacgctctaaaggttaggttattcaggttatctttatctggatcgtcttttggttttcctctttgccatatgggtcgatcaatagttgggccgatttggagaagcaattccatagctacttttacattgggattcatgagatgaagttatctgacttgacagcgattaagcagcggtatgatgaacccgtgcacgagtatattcaaaggtttagggagatgaggaacaaatgctttagcttgagtttaactgatgctcagttagccgatttggccttccaaggtatgattgctccaatcagggagaaattctcgtctgaagactttgatagcttatcacatctgatacagaaggtaaccttgcatgagtataggtaggcagaagtcaggaaaagctctaagaaggttaatcatgtttgtccatacatgtatgggtcggatgatgagaaagacgattctgaaatagctgcagccgaatgggtgaggagtaaaaaggtcatatcatgccaatgggtaaaaagtcctagaaaagagaagaagtatgacttcaatattaccaaagctgacaagatctttgatctactactccgagagaagcaaattcaacttcctgctggccatataatcccatcggctgaggaattaggcaaaaagagatattgcaaatggcataattctggatctcattccactaatgattgcaaggtttttagacagcaaattcaggttgccattgaggggggaaagattaggtttgatgattccaaaaagccgatgaaagtcgatgataatccttttcctgttaatatggtgcatacggctggtcaaatagccgatagggtccgtgcaaagggttttcaagtaaattcggctaagattatcaacaaatatcaaaggaaatatgacaagcagcaggagaagcattatgaagaatacgatgatggttttgatcctcattggggttgtgagttctttagattatgctggaatgaagggatgaggttatgtcacgcccagaaattcactagtaatttccgaacttatttgtgcataaaatcctcgtccaggaatcagccgaggtacacaaactgacaatttaatatactgattcatcaaattaactaaaacgataaatacttacttaataggcccttagtcctcaccatgaagaaaactgcagcgaaaaataaaatctagcgaagctccggctccactcccacaggcagctcaactggggtatatgccaaacgtcttctccttcgcaacttgtcttcaactgaggtttgattgattattgcaaggtgagcatatgacatactcagcaagctacacagcaaatatgcaagtgcataggataccaaaggatggcataatatagggctcatttgcaaaagcagtatttagcaaacatttaagaattgcaaaacagtagagtaattaatcatcaatattaatcaacactgaacagcacacccatgctgatcaggcccaaccatcctgaacaaccatacccggctgcacagatctatctccaaaccaggaatgtaccattccaaaccaggagctaaattaattaccatcaattatcacattattattaatgagtagtgtgggactaatcacgaaagacattgttagacccgcccataaccgcgggcacggctattcgaatagttttactctggccagaggtgtaccactgtacccacaagacacagccctacaacatgtcaccatgcgcctcaataccaccacggtaccacggaaaggagctgtaacagtactcatcgcacaacacaatccaccacagcgcactgttcctggatcataatcacccccttataaacaaggcatggactccccagcgacccccgtgggcttaactctgccacttctcagtctggtgctccacaatgaaccatgctatacaaaaggtaaagccgttgcctatgctggcttgtggttggcacggttaatgtttcacaaccgaaactcgtgaaccggtccttaattgtcatgaacacgaccatcaaaaccatgtgctcacaacccaccattatcaagttttagttggcacattaattaattcacaatcacgattgaccatcgtgagctacaattaaatatccatcattaagtaatagtgaagcattagttatcccaatagtgtgctaatgtttctaagcatggctaagcaattatgtctaacatctagctgaactaatatataaatccaactagtcaaattataaccccgaggtaatcaagaaatagggtaatcaatgcaaattggccataacaaaggaataagttcacaccacccggtgacattcaaaaataaatgcacagttaaaataaatagagaatttaaatataagatcaacatgctcaaaggaattgtgtttgggatctgtgtgacttgccttgcaataatcggtcttcaattaatcttcttgaatacttccgacgcacacgcgaaccatcgaaataacggaaacgacaagctaacatgcaaaacgaggaaaaagactaataaaaaccaaataaacagtacataaaagtaaacaaacatgtgtcatgattttagatgaatttagagacttgaacgacctcattccgatttcatatgaattaattacaaattttacaagattaaattccaattaaacctattgaagaaaagactattccaaattaattaaacaatttacaaatgatttataactgagataaaagattaaaacaacctccggaaaagattagattatatttggtagatgacatatattaaaaataaataatatgccactgaaaagagagaacggatttatatcaattttggacggctaagattaatcttgaccgagagttgaccaagatcggatggcttagattgatctggcaagcgagcctcacgagatatcgactcaacgaatcaattctacgtgacacgggatcacccaaatgttcaacctaaaccggcgaacgaaactggcggctctgaacggctctaaactaatggacaactcaacacggggcgaacgaacgaaacacagggaacacctcgttcgaacgaacgagcgaacgactcaaccacggctacggctaaaccggtggactaggaacgattcacggtaaagccccggtactgcaaatgataggctggtaggaacctagggatgcacctacggctagacaacttggctaccgagcaacagctaaagcggcggctaggttaaagcggcacacagctgcgacacggtggcactagggcaacttggtttggctaggcggctagcacaacggcggcgacaagcaacaacggcacaaccggtagcgacgatgcacagggcagccggcaagtgacgcggcagcggctgcgttagggttagagcaacagcggcgacatgaccgagggattgaaacctaacccgaggggtcacggatagaagtctcaccgaaccaaagcggtcggagagagatagatgacgacggtgaaccggcggcaacacatggagatgacggcaatgctagatagacaacggattagattgaattaagaccctagggaaaaactcacaggtgaacggcatgggagcggcggttgccggcgaaccacggcacagtaacgcaaacggagggcaccgggagcgagaggggatcaaagtgacccttaccaccacttacgcgacgacgaacggcaacggaagatggccggcgacgagcttcgaagggcggcgaggtactgtccacggaggcgacgactttccggcgatgtgcggcgacaacggaggggtggccgggcttcacttcgcagccgcgaatccaatgcaggcagcggcgaaccttggcgatgacgggaggagcagcagggcttcgccggagatcaaaacgcgacggcgagcttcgggttgacggcgacgatggagctccggtggatttcggcttcggggagatggctgccgggctccctctccttcttgcgaacccaacggcggcagcggcgaccaaaagcggcagctaaggcggctgctagctgcggctggagatcggaacatgacggcaacccactggttcatggcgaggactgcctccggcgaggtttcggcacaaggggaacggcggccggggtggagctcgaccttgcggagccgatggaggtggcggcgcaggaagcaggcagatgaggcggcggctagggacggttggagcggcgccggcgcttggagagagaaggagagcacggggagagcgtttccggcgacggcggcggacggaacttgaagggatagggagaggacgactagggggtcctttatataggcacgggagctcgggtccaggcccaaatcgacgagaaaaaaatcgggaaagtctaggttctcgccggaaaaaggaaggatttgatccgcgaaattggaaagaatttccatagaaaattttggggatttcttggggaaaaggaagaggagattgaggggattccattcccgcaactaatttggaaagaggagcaacggggaggacggattggtgggagggggcggcggcactgtgcacgagcacggctggctcggctctgtctggaagaggaagatggagtactgtagcgcgagggaggtaaatcagactttgtctggg

SEQ ID NO: 19255 - DNA, 4995 bp, Oryza sativa
  unsure (1)..(4995): unsure at all n locations
nnnnnnnnnnnnnnnnnnnnnnnnnnnnnnnnnnnnnnnnnnnnnnnnnnnnnnntgagctctgaaaaatccgagaaaattctagagagtataattaatcatggagaatttaataaaaattaaatccatccatgctttatatttaggaaattttatttcccacatttaacttcacttgtaaattaatgaacatttaatataaattctattaataatttattaaatgatttataaatcctgaaacgaaaatcaggctgtgacacccaatttcgggttgcggcctcctctgctgcttcacttcgtagacttgtgaattttggcctgattcatcgtgtcaagtctgcgttcttggcccatctatacacaagtctggttctcgacatcgtccgattaatttatcgtctatgttgatgtcaattcttctccactttattgtcattctctgcaaaaggttagtagacctaatactagtggaatattattgttctaacatatttatgcattgcaagcatcactagttctctcctgttttagtaatattgacggtcagaactgatcgataacaaccgtcaacattgatgtacttcacgtggattgccacacacagattgagtcctaagaaggtaattgtatctattaattagggtattttatgtaatgtctttagagataagtgtgggcaaaaatctgccgcaaagacttatggtatattagagtttgttagagataatagtcgtgtccgacatggatatatcttgtaattctcgagtataaatagacccgagccccatgtaatcaaatcaacacacgttcaatacaatctcggtgcatcgccacccttttactttcgttttgtttcaacgagttcttgctttcgagttgagctgcatcggtttcgatcttcaactagagttaaaacttgttatggcggcttgcgttctttggattagtgcttccatcttcatgatactctaatcttaattatgtaattcgtcgagatatcatatattctatacaatccctgacaatattgctatttaaccttcaatcggctaacgtctatcactggaaggcagccgattaggttaagtaacaacattggcttagattatatagaatatccactactctatgaaacatcaagcggcttgattgtctagatattattcttcttttcatacttatagttgcatcaattgagtttgaccttataagtcatgtttagaatcttaatccctagcctgctttctggttgccgattagggtagcatcggggtttcagccgatcttacctgatttaactactttatgtgttatatgcttgattgacatgttaaatccgccctttacattaagatcttgttgtaattagatacgttaggcttctgtttgacgtattttacttgctttaatatcttaatatagagtgatatcggagtattagccgatacatgctagatctatctgatcggctatgctataaacttatataatccagttgttaatatatatttcgatctaagtgatttatactgtctcggcatggcgaccgatctatcctaatcacttgatttcagtatatatcgacataaggattatatattgctaatatctacagccgatcgagtagatttaattctttattatttatttacgaccgccgatcaatatatatatgacatcggctcaaagataaatgatatgtcatcggcaattagccgatcggttgtcatttatggatttaaccgcggtttctatctttctttcttgttgattgcaggatcaaatcaactggcacgctcacgaacctaaaggcaagcttttggacatgcactggagttaagcagatctctcaggcctggtgtttttacatcaacaccggtaagttggataccatgttttattttattatatgcaggtattgatggtcaaatgttatgatttaagaaccgtcaacatacccatttcccaatcattgatgtaactgtaatgtttatttggtttttgttagtgtttttcctcgttttgtgctctaggttcagtttttagtcatttggaaggattgttagttcgttggaggagttcctgaagacgatttgaagacgcttgtttgcgaggcaagtcacacagatcccaaacacaattcctttgagcatgttgaacctatatttaaattctctatttatttaaaatgtgcatttatttcgaatgtcattgggtggtgtgagccttttccctgtattatggccgaaaattattttattttcctatggtttataatttgactagcttggactttatatattggttcagctagatattaaatatcattgcttagctatgctgaaaaacattagcacacttttgggataactaatgcttcacttatatatcattgatgattatttaaaggtagctaacaatggctaatcgtgattggttaattaattaccaactaaaacctgataatggtgggttgtgagtacatggttttgatagtcgtgctcatgacaattaaggaccggttcgcgagctactgttgtgaaacattaaccgtaccaaccacaagccagcgtgggcaacgactttaccttttgtatagtgtggttcattgtggggcactggactgtgaagtggcggagataagcccataggggtcgctggagaaagcataccataagggggtgattatgatccaggaaaggtgcactactgtgaattgcgttatacggagggtactgtcacagtcccgtttcgaggtaccatggtggtactaagggcatggtgacatgttgtggggctgtgtcttgtgggtatcgtggtacacctctggccagagtaaaactatttatatactcgtgtccgcggttatgggtgggtctaacaatgttttggtgattaatcccacactactcattaatggtaataatgtgataattgatggtaattaatttaactcctggtttggaatgtttaattcctggtttggaggtttgatctgtacgaccagggttggttgttcaggtttggttggacctatgcaacgggtatgttgtatattgttggattaatactgtttaattgatttctctactgttttacatattttcaactctttgctaaatgctgctttcgcaaataagccctatattacgccattcttttggtatccctgtgtacttgcatatttcctgtctggcttatggagtattccatgtactcaccttgtaataaacaccaaatctcagttgaagaaaaatgatcaagaaggagaagaactttggcttagattctagttgagctgcatgtgggagtaaagttgaagcttcgatagattttgttttccgctccagttttcttcgtggtgaggactaagtgcctcttatgaaagtatttttcgctttagttattttaaagaatctatatataaaattatcaatttgtgtacatcggctgatttctggacgagggttttaatgcacaaattagttcggaaattacttgaatttctgggtgtgacaatatcaatgcagcgactgcagtgggaccagagatgattaaacatcatagagaattacctgcccaacaacataaatggcaatgcacttcggacggtgccatctttatttactaattaccaacgtacacatagagtatacgcataagaattgctacctgcatcacaaaataaatttcattctatacatgagtctggatatagaccatgtccagatttatgtacaaaagtgaacttattttaagatggagatagaattacataagcattgtgtaagcacatagtttgctgcattgttgatagctcagttctaaagggtgacaggattcacaaacagattcccaacatttccctgatgatacttcgaaaatgtatatgcatctttcttcttatcgtaaaagaatggcactgctacggccaaattcataactcgttgcaccacatggaactgcttttgatgatcacaacgaacctgattcagggttctccattcactttcaatcattgattcgatcttgtctaaggcaacttcgcttgtaaccttgtgctcattgatatagcactctactgtgtttgcggcatctcctttgttctttcttccagactgcatgagtgtgaaaaaaatatatgttacttcctctattttacaatatataattaggttttcttgacaatttttgtttcaatattatatgctgtaggaaatagctagttatatacatataacatttcagctctccactaataatttagtaatgtaaagtgattaagtagctggaccacattcagcatccaattccagactgcatacacatttaggctgtgttccataaactatgttgggaacttctcccagtgtacgtaaaacaggggacttattagcgcgcaattaattaaggggatcttttagagtattaaaaacttgaaaaaattaatatgatttttaaagcaactttttatagattttttaataaaaaaagcacaactcaacagttcacgaaacttgagcatggaaaataagagagtagaagttaggaatcgtagttccgaacacagccttacatatttaaatacaataaattagggaagtacatggaattagtactctcaattttttttccaaaacagtaaaattgaattactgcatctataccttgaatgcagcaatgtcgttcatgaaacgcataatctttgcacaagctataacggcacttgaacgtactgttgtcaattcaaatgattccttcgttactgcatcaccctggccaactgcagcagtcacacagagtagtggaacagtactggacagggttgacaaagcaacccgctccttaaatgctggcttgtaattttgatgcaaccattcaaattcttgcaggtaatacgtggatagattttggaactgcacccatgcaaatcaaattagccaaaaaaaactagttagctacatcattataattattttaccgcactactac

SEQ ID NO: 19256 - DNA, 4174 bp, Oryza sativa
  unsure (1)..(4174): unsure at all n locations
tatctcttccgagtgtgggcccccccgggagaagaaatatctcctccggctcggcttgggaaggtaggtgacggcttcgagtatatatagtggggacaactaacctcaaacggtttagggtttgaacccgtttgaggttagtaaacctcacctctgacggccatccgattgcaactcgtcacaggtaactagtcacctgtgacgggccagaagtacaaaccgtcagaggtgaggattaactcacctttgacgggttccgttttcgacccatcacaggtgactagttacctgtgacgggtcgcagctgaatagctcaccgatgacggaatcttttaggacccgtcaaaggtgaccatcatcactgactaccacttatgcccgtcatagatatgtcgtcacaagtgtgaggatctggtgtcgtgtttgtggttgctaattatagcagaggaattggtgttgattatatttgttggatgtttgaactaatcatgttgcatgtatttgtactgtcaatttgtggcttgggagcaatgttgtccacactagtccaatatgcaaacatatgcaaatttttgtgctgctaagtgaaaaaggatggccaagtcctagtctaatgtaaaactatggtgaaaaaatctagtccattgtgcaatttactctatttttaatgataacgatatagaccatgtccagatttatatacaaaactgaacttattttaggacggagatagaattacataagcattatgtcagcacatagattgctgcattgttgatagctcagttctagatggggacaggattcacaaacagatccccaacaatctcctgaatatacctggaaaatgtatatgcatctttcttcttatcgtaaaagaatggcactgatacggccaagttcaaaagtcgttgcaccacagggaactgctggtgatgatcacaacgaacctgattcaaggttctccattcactttcaatcattgattcgatcttgtctaaggcaacttcgcttgtaaccttgttctcattcatatagcactctacagtgtttgcggcatctcctttgttctttcttccagactgcatgagtgtgaaaaaaaagtatgttacttcctctaatttacaatatatatttagcttttcttctcaaattttgtttcaatattatatgctgcaggaattagctagttatatacaaataacatttcaactctccactaagaatttagtaatgtaaagtgataaagtagctgaaccgcattcagcatccaattcctgcgtgcatatttaggttgtgttccataaactaggttggggacttctccaagtgtatgtaaaacaagggacttattaacacacaattaattaacgattagctattaaaaacttgaaaaaaataatttttaaagcaacttttatataggtttttttttagaaaagcaccactcaacaattcacgaaacatgagcatggaaaataagagagtataagttgggatctctagttccgaacacagccttacatatctaaacacaattaatcggggaagtacatggaattaatgctcttaattttttttttcaaaacagtacaattgaagtctataccttgaatgcagcaatgtcgttcatgaaacgcataatctttgcacaagctataacggcacttgatcgtactgttgtcaattcaaatgattccttcgttactgcatcaccctggccaactgcagcagtcacacagagtagtggaacagtactggacagggttgacaaagcaacccgctccttaaatgctggcttgtaattttgatgcaaccattcaaattcttgcaggtaatacgtggatagattttggaactgcacccatgcaaatcaaattagccaaaaaaaactagttagctacatcattataattattttaccgcactactaccatactcatcaaacaaagacatactccacccggttccaataattatcattttaggcaagttatacatagttaaaggttaacttcgtcgagttatttatgggtgagtggacagtgtctcccccctcctccacttgactatccttgtgcgctgccgtttgctttcgaggtcaaccaactgtaaggagagcatgtgccggccacccccttcccctcatcctcggcagtcaccacccaccggctacccgatcgagctagccagctagccatctttggaggtgagcgttgtttcaatgtatccacgctaatgtcaggttgatgcatctattttactttaaactaaccagtttgcttgtagccaaagccagtctattgtgaaatgcttagatgggatccttgtctgtaattttctttcgaatgctttttgtctactgtattaagtaaggtgcttgaatgctgagaggttgtgacttcatagtttcctattgtagaaaaaagccatggccttcccttggtttcttctaatattgttatgattaaaaaacaacatatttagatcgatgtatacacttaaagtctctagctagttcattattttgcgtgtatcttcagtccctgtccatcttgttaaggatatgtagttcgtgtgtcagtgaaggatatatattttgtgcaaagcccgctggaatacgattagattaagtataagctatgggttaattgtgcttcctgctagctagattgatatggcagataattccatttaagctattgggctaaataatatatgaatttcataaatagtatagaacattaaagcatgataatagcagccatatgattaatcagttatttatatccttggaattgttagactgacagttacttacatgtattcaatattatgctgtttgtagtatcctcatgaaccacaactttttaagcatatagcaggatcttattgatcagcttacaatattgtgtgtctcctataccttgatatatttttaccataatctgtagtattctcaaggcaagtaaagaggagaaaatagatagagataaaaatgcattgaaaagggataagatatctgcattcattgtctcatctagcttggaatattgctgccggaggacatgtagtaccataacttgtaacttatagtggtgaataaaagattcttgttgatgtgaattggcatgtacgtgtattggttatataacttacaggattgaagtttgcttaaaatttgatgctgaattgttgtgcatgcctatctgtagctttatcacttatgtatcagtaaaaaaaaaagagttcatttgcatattttgttgaaaaagttatgttcaataatccatatggatatgtggattgaattgttgggggggggggcgggaggttgtcttggagccattttattttatggtgccacatgatcttttttcctgacggcagcacgtcacaatttaggcgacaaaacccgatgccaatggaatttttctgtgttaaacacatagggaaacccataggaaaatctaatttctccgttgtgatttttctatcggcaattcttgtcggttccctcaaaaatacaatttctatggataaaccctatttttctgacaatttttgatccgtagggttggcacaagtctcgtagtgcatagaagtctacgtgtgtacagtatgaaatgagaagtttagtcctaccatgctaattttgggagggttacacaagtttacgtatctagttgtccaagttctagcaacacttactaaacattttacataaagtgaggatgaaaaagcacgtgtgttatcgtttaggcatggtttaacaaattcatgttgagcatacagctataagtattggtacctggattattacgattttctatcagtaatagatgttcaatatggtttcaaaattttaggtttggtggtgaaaagttagccctagattctatcccaaaattttctcattagtgatttaaacaaaagatttcagggatagaattttgggaactgttggtgatgctcttatattgaatatataataaatgtggatagtttattccaatagatgacaaatttcattggtgcacacgatcttttcttggtatatatcgataacatacagtaagaagaatccattaacgatcaatgcataatatgaagatnnnnnnnnnnnnnnnnnnnnnnnnnnnnnnnnnnnnnnnnnnnnnnnnnnnnnnnnnnn

SEQ ID NO: 19257 - DNA, 5982 bp, Oryza sativa
agacttgttaacattgagtgaaacgcgtgaccataattaattgagatgtatagtgatcgataaattcgatggtaactgtacaacaaatttatttagttagaggatcaacatggtttttcagttgtgctttactcagattaattgtttaggtgcattaaacatcaaaaggtaaaataaacaatttcttttttatttgctctaagtagctcgggttcatggaaattgttggttcatatcatgctggcagcaacagctcggtaacaagaatactgatgccagctacctttggtagttgtagctagctctacctccagttgcacatctctgttttaattaactaaaagttggccttagctgtttcttgatagaatgacagtagaatatatgtgtatgcatgagcggtactctgcttggtcattgcatagtagttggaaaaactcgcatgttttgctgctctagaattagaggtggaatgttgaatgctcggaaaactacttttataggcagttacaatataattggtacccccatttttggaagtgtttagccaaccaaatgttacatagggcctatagaaatcgacagttttgtgctagtggattgcacaactgcatgttaacaaatctatttttttgtattttaagttcgactttcaagtctttaattattgtaggcgcaaaaagtatttcatattttaattgtcacaagttcgcaattttttcacacaaaatatgcatctagtatgtaggattcaaatccgggatctctcccttcacgtgtatcttacttattaccatcttacatatgaagcactttgttaattactatgaaatagacgttgatcttctaatttaaactctcttaaacttgtaacacatattaaaaccttaaagatttatgtagtgttcatttgaagtgcgattgaggtgaactaaagttatatatgatcccaacaattttttcattaaatttgtaaggtccatattttggtaatatcattgttcacttatgtcaagttcccactgtatgttttgatgtgttatgcaacttgacatttgtgaatgttcataataaaggaaatataaaaaaaaattgactaggccatatttgaggaaatattgtaaggatctcatagaactttggattaactcaattggacttaaggtgtattttctatgaattttaaaactttagacttcataaagatctgtttgtaaaatcatccttttttaaaaagtagattccgaatttgaaacgaatatttcggcacctaagtgttcttaaatgaaataactttgactagaaagttacaaaccttgtcgagcgctatattgttttatagaaattgtacccgtcaacgtatgtaacaaaaaattctaatgtagaccttaaagcttcttataatgaacttttgatcccattaactacctaaaatagaaaaacattaactacaacatctcaacaagaactacaattgtcacataacatttgtcattaggcgacatcataggaaagagttacaagtggtttcctaatagaactgcccttaaaaatcaattttattgattttttcttatgagatccgtatataaaaatgaccccacctttcaaattacgcgacccatttgtgttaatagacctattttcacatgcaatttttcataaggagctatctgtaaaaatagttttcttttgttatatgaccctgggcggcattagtcatcttcatagggacacggaaatggtttgtagtggttacgatgaaaaatgtgcatgtgcctattattgaaataaaaagactgccagcttttggccatctagacaatgcgtcagagacaaccatcccaatctatcccctccccatcccatctagaagtaaaagtataggtagggtcttccaaaaatacacaaaatattgaatctgcatgggaggggcagagggtagctaatgaaggggtgggagaggtgcagaggatcgatgggcacgcgtgtgacacattgcttagttaaacaacatgctacgtgttaggcaatagcacgttctctctctctctctctttctatctatctctgtatatttttccatagaaattactttaagtatatgaggttatatcacacggtcatgcatagcgtttagaagtttcaattgattcagatttacaggtataggggtagaatagttaaattttgatttatttttgggcttctgatttgatcatctgtacctttcaattttgaaaagcctgatctttaacatattataatattctgtgaaactttagaacttttaaatataatttgttgtgcggttttcttgatttctcttacaattggtggctcgagatgaaggatattaatttctgttgtttttgacctattaattaatcgtacctttgtatggcttcattcagcttcctgcattcctcgatggtggcatgatcatcatatgtgtcatccataaggacaatgaatacaattatcttggcaaggatcatccgtgtgagtgttaagttttcttcatagaatagcgcataggaccaaagatatgactccactgcacgatctctaacatgacttagctcgacatatccataaagatctttccaccacctgaaaattaaaatgatcgattgttttaggtgcttgttttgaagtatatttaagatatatatattagatcattagaagcaatgagtattaattgatttatgatagtaataatatgtacatagcatatcaggcataccgaaaacactaacaacatgaagagccatattgctagttatttcagtatatgtcactagttattggatgtttaaagccgcataaaagcctctagtgtattgctgctgcaaatgctgagacaaagattgataaaatattcggatattccttgaaggctagctgtccttcttttttatctgagagtggacaaattatatagtagtataaaccttaattttctattgttcaatacttgaaactacagataaagcgatacctaaactcggatacactaactacctcattaacatgacatatattgactacttctggacaaaacataaagttgtacatgtattttgtgattaattaacattaaattggttgcacaaacaaagcgtcaatttgtctaaaacgaggtacacattttatgtatttaccattcagtacatcgaaggaacacaacgtctctccagaattttgcacttatctatatctgtctatcctatatagtcagagctaaaatatccacatgtattgattaagttcatctgaaatacaacagcctttggattcctcctttactttgatcatagctacccacatgtcatgtgtattcagaattaaccacttagtataattgctttagagctcaagatgtattgagcaacatctcacctagaaagtaaaagccatcgaatccctctcatacttgtcataactattcatgaggtgaaattacacatcaacttctacgtagctcaaattatagtccttttaggtatgacgagtaaataatttccaataggtttttatcaagctttcctagaaaacaaatacttctaaattctccactgtaatgcacggcccattcactaataactaaatgttctctaaattatctttactaactgtagagcgaagatcgaaaaacatattttggtagttgtatcgtgcacatacacagatttgagattattacagtggtttgtttctgtcctaaagggcacaatcaattactttcatggtatatatttacttattatatatataaatatcaaataaatactctttttttagataaaggaaatgaataaacctggtatctacatccacaagacatgtacaaagacaaagcaaagaaagactcttactgagaaaaagctttgagctccttcaagtggacatgctgcagaaggttaaattccagctttgcaagatctaaaagaacaacaatacattcttcctcctgtccgtactccagcatgtaatgcaacatttcaactctcttgtaggttctcggtaatggtaagtgtagggcacggttgatttgattatctagaggggccttgagcctacttccatccctcattgattcgaggtggtgccttgcaaaagacatagcttcttcaagttctggctcatcatggacaaggaggtgagctgcattgtacaaacttaataatgcccttggttcatcagctattgtattgatgaacctcccatcctctcctttgaatttttcgaatacatctgcaaggcagctaaattaaatgtggatttttccttccaaaagatactagattcccttttcatacaattttttaatacatcggatattcttgactaatttttatgtatatatatactctaatttggatttatattgaaaaattgtttgacacaaaaaataattacgaaaatgaatgaatacctacaatacaatgacttaaaattttgtgatccaaagaaaaatacaaaaatttgtatatgcaagtcatcaccaatataagaaatactcgcactattgaaaattgggcctatctgtcatgcacacagtggataaattgttactccctccgtttcatattataagtcatttgacttttttcctagtcaaacttctttaagattgaccaaatttattgaaatgaagggtgtattttgtaataaacttgtttggcattattgtagtttgtaaaatacatagtaatggttgcagtgagatatttctgaccaagttgcaattttgtgaaaattactctgcaagttatctcctatagtatttattagtacctggagatacccaaatgccatgctccctaagtaagcgaaagtggagagcaacctcgtggaggctagagctagtgaattcactttctttgatgtcacttattacattgtttatctcatcttggaaaaggtgatctattccaagacgttgaactgcatctactaagtgcattttcttggctgtatcattgtgggtctcaaacagtatacggacgtcctgttttagtttatcagccttttccatcatccaatcctccgatctctgtttatttgcatgcaaaaatttgatttgttagaatcaaatgaaagaaatacaggaacaaatagttaggtgaaataaaatattccttttagataacttgttggtctgttgtggatttgaccaatttttttcttgccaaaatcagcattaaatcaaatgtaataaaaaaaatatgataaaactccattgatccgctaggaaaatgtgaactatgtcgcccctttatccttttaagttccaaatatgtgccgttctacaatgagtgcttgcaaactttttaaagaaaaaaaatttgctaatatacttattttttttaataacttacatttatatatctacatcagacgatttgcaaaaatatcgggacggaaacgcgggcctgtgatggtcccgcagctctaaaacgcgtgaccgctccaaaacgcattaccggctatactacaaaacgggtgcgcgggacctcgaaggtgccgggggctcaaaattagcgagcgaggcagccaatgatttttaacgatgtctaccactatcgacactgtgtagacctgtttgacacaattttgtaaggcagtaccgccagttcaatgtgcggaactggccataaacatgtctacacagtgatgtaaagtggcagacacgccccgaaacattgttaaacagtgccgactcagctaatgaatcgttggccagttcgctcccgcgttttgggaccatcgcggtcccgcgcgaccgttccgtgggacatcggtcctgtgttttagaactgcgggaccatcgcggtcccacgtttccgttcctcgaagcgggtatatttttgcaaatctcgtgcaggtatataaacgtaaattattgaaaaaatatgtatatttgtgtttttttcactttttcaaagtacataattagatatagaagtattaatt

SEQ ID NO: 19258 - DNA, 5486 bp, Oryza sativa
  unsure (1)..(5486): unsure at all n locations
gtggtgccttgcaaaagacatagcttcttcaagttctggctcatcatggacaaggaggtgagctgcattgtacaaacttaataatgcccttggttcatcagctattgtattgatgaacctcccatcctctcctttgaatttttcgaatacatctgcaaggcagctaaattaaatgtggatttttccttccaaaagacactagattcccttttcatacaattttttaatacatcggatattcttgactaatttttatgtatatattctaatctggacttgtattgaaaagttgtttgacacaaccataattacgaaaatgaatgaatacctacaatacaatgacttaaaatttgtgatctagagaaaaatacaaaaatttgtatatgtaagtcatcaccaatataagaaatactggcactattgaaaattgggcctatctgtcatatgcacatagtggataaattgttactccctccttttcatattataagtcgtttgacttttttgctagtcaaacttctttaagattgaccagatttatagaaacgaagggtgtattttgtaatagacttgtttggcattgttgttgtttgtaaaatacatagtaaatgttgcagtgagatagttttgaccaagttgcaattttgtgaaaatcactctgcaagttatctctttcagtatttattagtacctggagatacccaaatgccatgctccctaagtaagcgaaagtggagagcaacctcgtggagactagagctagtgaattcactttctttgatgtcacttattgcattgtttatctcatcttggaaaaggtgatctattccaagacgttgaactgcatctactaagtgcattttcttggctgtatcattgtgcgtctcaaacagtatacggacgtcctgttttagtttatcagccttttccatcatccaatcctccgatctctgtttatttgcatgcataaatttgatttgttagtatcggatgaaagaaatacaggaatgaataattaggtgaaataaaacattccttttagataacttgttggtgtgttgtggatttgaccaaattttttcttgccaaaagctgcattaaatcaaatgtaataaaaaaatatgataaaactccattgatccactaggaaaatgtgaactacgtcgcccctccatccttttaatttccaaatatgtgccgttctacaatgagtgcttgcaaacatttttaaagtacgtaaatagatatagaagtattaattatataatttgtcatgtgaatattgccgttgattttacagctaaaatatgccattcttactataaaagtcaagtcttagttgaagttgtgttgggaaaatctgcacgtcagaataccaaatgagaaacattggagggagtaattgcccacgctataaagaactattttcgtgaacaacccgtatatttttataggcggcctaagtaagtacctacctgtgaaaatgcgtaggctctctggtcaaggctctacgatgagagtcaattttcataggcaagcatgctagctaggaggcacatagaaaaataggatcattcttttaggtgcccatcttaaaggccgagaaaatcgtattttttaatagaaaatacccagagctgtctataaaaacaattgacaggtcggcctcataatagcaccacgtgtgaaaagggcgaaacctaaataatatgcccatcaatctgcccgacctctagtgactctttatctcacatcatctcggccttattccttaattatgtcatctcatatcgattgccacgatgcttgtattggatcaagatagggtttctacaatatgaaaataaaaaaggtatacctgtagtggctttgggtcatagttgataaagaaatccccccatacagagggctcaaagctagatacttcctttacaggagtgattgattctgaggacacaacatgtgcagcatgtcgatgcgcactgctttgtcgtcggaaggagacttttgccggggcaccagcagaaagaagcccaaccgatggctggattggacgatggcctatcctagcatgcacaacaccatgagagaagaagaaagggagagggatggaagttgacatactagtatatttcccttgggagggcaatagcagttcactgatactattgtagtgtggtagtctgatcgttgctttagctagctagctagctagctgctttatataggataaggcatagggcttctagaatgtactcttaaaaaggatactctctttgtcacaaaatagatactttctccgttcaaatattaggtgggcatggatattaaagaaataagtaaaaataatagggcttccacagtgaactcttaaaaggatactctctatcacaaaatagatactttctccattctaatattaggtgggcatggatattaaggaagtagctaggtaaaaatgattggatgaagtttgtgattgattgagaagaaaaaataggtagtaaaataaatagatagtggttgctatgtgtgggatgtgtgaaaaataaacttattttgcgagcagggtgtaataagcaataaatacatcccttataccaaccagtaaacatgatggaggcactaagcaacaaatatcaagcaagactataacctgctagtaaggaataaaaaacattaattcttttagcaagaaataattgcattgtcatttgagaaagcaagtgtattattgtctttttgttttgtattggtgcatgtgagatgtgtgaaaaatgaacttattttgggacgagggtgtagtagtaagcactaaatacatcacttatatcgaatagtaaatattttggaggtagtaagcagcaaatatgtgacaattgcattacaaccagctagtaaacaaaacttattttagcataagggtgtagtaagcgataaatacatctcttataccaagtagtaaacattgtgaagatactaagcaactaatatcaggtaatagcactacaacctcataggaaggaataaaaaaagcattgttactcttagtaatgaataatggcattggattttgagaaagtaacggtattctagttgtgttggttatgtattggtaggtggaatgtgtaaaacgaacttatcctggaaggcgggtctagtaagtgataaatacatcccttataccaaataataaagaaaaaggtatgaattaccccccccgaactatctcggtcgatcgaattaccccccgagtgggtggcgagccgctgtcagcgacgccacctcctcgccgcagccgctcctccccttcccttccccttcttcctctaggtccggcggtggcagcggcggaggaaccacttgggggggggggggtagggcaggcaggaaaagcggtgacagcggtggtggcggcatcagtgacagtggcggtccctgcctgtcactcccgcctccgaccagggccacctagccgcgccccttgccaattgccgctcactgccaaccaactcctcctccccgccatgccggagacgcgcccgccgccgctcggccagttgcgcccatagctgactggaggcaccgatccgtgtccgtcgccgctcatcgctcgccgccgactagttcgccctccttgccgcgcccgccgccgatcggaaccgcgctcgccgacgtatgctgaaccgcacccgtagtcgaccggagccacccagctgcacccatcgccgctcgccacttgctgccggccgattccccctccctaccgcgcccgtcaccgcttgctactcgttgcgagtcgcacccaccgtcgctcgtccaacagtgccagtaaaggggaattaatatgattggatttccatgtcagcgcctcgtaggatcgagaaggtgaccagtgtcgggactaactgctcctgtatcttccttgcttatcatgaccagttctcaagcaaggtgaccatgattgagagctgcgcgctaactgctgcgggtccactcgaggcaatttatacggtcttgtgtggaggagaataacctgcaggcagaaattccggtgcttggtgatgtggatcaacagtataccaccgtactaattcgtggattcgtctgccgaattccctcatctccctatcccagctgtcccgttctgacgttcacttccgtagcgttcaattaggattagacttccctatgctcaatcaggaatcagactcggtacatccaattggccattaattttgacaatttgaccctttgcaaaaactatttttacaaatgaatcgctgccaaaacttatttcaaatctgacccttttgctcaacgccaaatcgtgtggcgctgaacttagacagaggccgggttttatttaaatctattattaaaaaaatatctaattccacagatgaataatctgaacataagttcatctttggcgttagactttttttgataaagggagtagaagtagtacaagtactaataaatacacgcactttttccttccctatttttttgtttttcagatcgacaatcgaaacgactactaaaatataaataaatgaaactattcttcgatcaaagcaatatttaaggtcagcacaaaaatgacttgtaggattatatcactgttgcacaaaccatcttttaaccccggttgcaaccccttggcggagttatgtatatgggactaaagattactattttaagttccgattcaaatacctggcactaaagatcaatctttagtcccgattggtgccaccaaccgggtataaagatttttttttcatgctgcttgttgcatgtttatatattatgcatatatatgttccaatatatatatcatatataattatatatatggtggcgctacgtgaagcgacaaacagacgctgcgtgctatgaaacttcgtagcgctactcatgacttcccccaccaccgaggcaaccaacctctctgtggagttaaaatttaaatatgatacagttggttggtggattgagatgacattgttgtggagtaaaaattgaactttacaatgtgagttgttgaacttggagttacgtaaactcaaaatatggatgagttaactattaactttaaatcgatgtgataataactgacattaaaaacatttgttttattagttaaaaaatatgaagttgtagaaatacttatacggggactgaatatgtacttaaagtttagcttgtaaatataagatcttgtaatagtagttaaaaactaatttatgaaatttgtgtgatgttataattgttggatttaatagttaaaaagcaacttatagttataaaaacacctatatgatgtttgaaatgcatagttaaaaaataacttttagtttaaaaaaatgtgtgatgtcataattgttggatttaatagttaaaaaataacttatagttttcaaaacacctatatgatgtctgaaannnnnnnnnnnnnnnnnnnnnnnnnnnnnnnnnnn

SEQ ID NO: 19259 - DNA, 1245 bp, Oryza sativa
agcgctactcatgacttcccccaccacgaggccaaccaacctctctgtggagttaaaatttaaatatgatacagttggttggtggattgagatgacattgttgtggagtaaaaattgaacttttccaatgtgagttgttgaacttggagttacgtaaactcaaaatatggatgagttaactattaactttaaatcgatgtgataataactgacattaaaaacatttgttttattagttaaaaaatatgaagttgtagaaatacttatacggggactgaatatgtacttaaagtttagcttgtaaatataagatcttgtaatagtagttaaaaactaatttatgaaatttgtgtgatgttataattgttggatttaatagttaaaaagcaacttatagttataaaaacacctatatgatgtttgaaatgcatagttaaaaaataacttttagtttaaaaaaatgtgtgatgtcataattgttggatttaatagttaaaaaataacttatagttttcaaaacacctatatgatgtctgaaaaacatagttaaaaagtaactttagttttaaaaaaatatgcatgattgaatggagtattgattcggtgttaattgaaaaaacggttagacgaggtgcccaaaaaaggtgctttttttgtgcaataattcctctgaacaaaaccggactcttcgtttggatctgcaaaaaatgatgttacacatttttttggcgtgaattaagggaaaaaaaataggttgcgtaattgtcacgttgtattcattagaaacccgttttttacatgggatgcagcttaataatgttaaaaacataggggcgactatgtaaaaaattaacttggtatccttcctgagtaaaaaattaacttggtatgacaaaaaattttttactcaacatatacatcctcacaatctataagcataagttaaattttaattggcacttgctccggacatcgacggcggcgcgtcgtggaggtggccgcagctgttcctccatatccatcggagtccgagctcgccgccgcggaggtcacgtcgtgcgcgtgggggcggaatggtggcccgatccaccgtagcctcgccttccgcctgtcacagccgcgctcgccgtcacccgtgcaggatccactccgcatcctccgttgcgccgcccgcatccatgcttggatacgctccaccgcaacaggatccgcgcacgtggggcacgggagcggcagccggatgcg

SEQ ID NO: 19260 - DNA, 704 bp, Oryza sativa
  unsure (1)..(704): unsure at all n locations
nnnnnnnnnnnnnnnnnnnnnnnnnnnnnnnnnnnnnnnnnnnnnnnnnnnnnnnnnnnnnacgttcttatacatgtatgttcgcttaaaaccggcacaaatatgacccatttctcatccaactaagcctcattgactcgttcaaattaaaatccttcacctatgactactcatttgtgatgatttaaaatacagagctaattaatttttttagataatacagagctaattaatagtttaatcaagtaataggtgcctatttttataataagcgcgcacatataaatgccacatacggtgtaagtaggttgaaaaaaccgacacctatttgtataagtggcacctgtaagtaccatcattagctccattatattggtgttggttttggaagtgatatctatgaggtttttctactaaggactacaccaaaaatatatttcttttgttgaatcaggttaagctaagctacacatgtccacttttcatgctactgtagagcaaccattagaggagccaattactaaggtttctttgtgacaagttgatttatttgttattccttgtggtaaagaagagttgtgttataatacttcacttatatgcatgccacaactaatgaatgaacatactattcctagtgttcttttatgtgctgattttaagcatgttgttcataattgcgaatgaagttgaagaatgtgaat

SEQ ID NO: 19261 - DNA, 869 bp, Oryza sativa
  unsure (1)..(869): unsure at all n locations
agtctgtgtagcttaagctacacaaagtaccattcctagctaccattccaagaaatttagacaaaattccagcttcatctcctactgcctgattgagatcattgcactgaaccacaatcctaagacctttcggaaggttccaaatatctttcagttttgtcttcccacgtgtttcaattgttccattttcatctgttcaatgttaaattgcaaagataaaagtgatgctcaacagtccaggataagaagaataatttcattatttcttaccatcaagatttagtatttacctcgaacattaattttaacatcatcatcagattcttcattgccttctccagcattcatactagcatcgtcatcagtatcttcattgacttctccaacatcgtcatcagtatcttcattaccctcttgaacatcactgcatattgtttctcttcagatggtgtggcaagctgtttaggggcattttcttctgcaatgtgttcctctgacaaatattcctcatggctttgaacaatgcaccgccttctactccttgccatatctgctgcaccaaaacaaaaatagcataaacctatgtattgcagtctgagtaccacttttctctactgctctagaagaataatttcagaattggctaaaactttaggcattttactctactgttgtccaaaaaagtaccactatggtttgtattgatgagaaaggtgctagcctacaggttattagatacctctgttagctaatgaacaattttcaaatagaggtgtcaacacattaaaaatcgaacaataaatttactnnnnnnnnnnnnnnnnnnnnnnnnnnnnnnnnnnnnnnnnnnnnnnnnnnnnnnnnnnnnn

SEQ ID NO: 19262 - DNA, 675 bp, Oryza sativa
ttttaattttatcaatgcctttgtcattgcaaaagtagggggcacatatattcacaagttgcaaatttggaaaatttttaagcaaaaagcatggagttatattaatcggcacaagttgtcaagactagttacagaatcatcttagccgattacaaaatgtgctaagccttattacagaatgtcactgagacaagtatcgttggatagccgatatagctctttgcctaatttgttctacttcttcgatggcttgggcatcttgagcatcggttccagggatgacttttagggacttggtcatatccgcgacattcttgatagccgattttagtcttgccttctgttcttcgacagcttgtgggagatcggctagctttttatgttccatgtccagctcggtgttgcattcttgaagttgtgccaagagttcaatcttgcgagcttcaagtcgatcaatattggatttgatcgggccctcagataactgatcaagcttggccttttcttcatgaacaagctgccgattagcctggattgtggcctcgatgtctttgcgctcccgacgctcggctagtctcagcttggccttctccagcttgaattgttgttgcttaagatagacagctggagtaaggacatcggctagctcatctgggatcagagcttgaacctcat

SEQ ID NO: 19263 - DNA, 1177 bp, Oryza sativa
cgtcaatattactaaaacaggagagaactagtgatgcttgcaatgcataaatatgttagaacaataatattccactagtattaggtctactaaccttttgcagagaatgacaataaagtggagaagaattgacatcaacatagacgataaattaatcggacgatgtcgagaaccagacttgtgtatagatgggccaagaacgcagacttgacacgatgaatcaggccaaaattcacaagtctacgaagtgaagcagcagaggaggccgcaacccgaaattgggtgtcacagcctgattttcgtttcaggatttataaatcatttaataaattattaatagaatttatattaaatgttcattaatttacaagtgaagttaaatgtgggaaataaaatttcctaaatataaagcatggatggatttaatttttattaaattctccatgattaattatactctctagaattttctcggatttttcagagctcaattcctaattttaataatacaaagaatatttcagtaattatttaattaataaattaatcatgaaatggtatggttttaatatttttaaatactttgagtgtccaagtatgttcaagatttttcttggaattatttgagcattgaaagtatttttaacaattgaaagatcatctcattggttaatttatttggaaaagtaataaaaatcctcctcctcagcttgggccgaattcagcccattctctcccttcctctcagcccagacaaagtctgatttacctccctcgcgctacagtactccatcttcctcttccagacagagccgagccagccgtgctcgtgcacagtgccgccgccccctcccaccaatccgtcctccccgttgctcctctttccaaattagttgcgggaatggaatcccctcaatctcctcttccttttccccaagaaatccccaaaattttctatggaaattctttccaatttcgcggatcaaatccttcctttttccggcgagaacctagactttcccgatttttttctcgtcgattttggcctggacccgagctccgtgcctatataaaggaccccctagtcgtccccctcctatcccttcaagttccgtcccgcgccgtcgccggaaacgctctccccgttgctctcttctttatacaagcgccggcgccg

SEQ ID NO: 19264 - DNA, 1144 bp, Oryza sativa
gaaactacacgctggcacgcaaaacgagaaaaaaactctaataaaaaccaaggaaacaggacataaaaactaaacaaacatgtagagctcaattttagatgaattttgcaagttgaatggctcaattcggagttcgaatgaattagatatggattttagaaattttgagccatttaaatgaatttctagaattaaaccgaattattgcgcaattaataattaatttctcaaaggaaatgacaagtgctgacgtcagcaaagggccggcgccgacaggcgggccccacacgtcagcgagccaagggggcggcccacggtggactcggtccaccgcggcacaggcgcgggcgcaccacgtggacggccacgtggcggccacggcggacatgcggcagaggtggcgccgacgtggcgccacgagggcaccgacgcgggcggcgccgaacggccacgtggacggcccagattcactcgaggtgcatcgggcggcctcaggcgggcgcgagccggctcgccgaccggccgaccggggagcggcggagtgcggcgggaaaagggagggggagctcaccgagtagcatacgacggaaggaggtggccggcggcgagatggcaacgcgaggcggtgacggcagagctcgggacggacggaaacaacgacgctccgacgacgggcggcgctcgggaagaggcggatgagcggcagctgcaccctaggatgggaggggaggtgttagggaggacggagcggcgacatggccggctggagaggaagggaagggaggaagggctcaccggcgcacgggaatctggacgtccagtgagtttccggcgatgggaagagatggccgaggttctcctcgtccttgtggagccgagggaggcaacggcgtgggtctgcaatgactgtagcagcggggcgacgcggctggagtcggccagtggtggtggtggctcgggttgacgggggaggtgtggatacggtggcgatttgggaaaacggagcgaaggccggggtagagcttggcacggcgttgccgacggcgcaagcggcgaggtgcagcgacgactaacgcggcggcaatggccggctgaaggcggtgtgtggcggtagtggctcggcctcgcgatgggagggtggttc

SEQ ID NO: 19265 - DNA, 10233 bp, Oryza sativa
  unsure (1)..(10233): unsure at all n locations
cgataatctccgcatatagatgtctaacatctatcctattttatcatgataaaaagtgagactctgctatggcaaacccatcacttatgatcacaatcgtaataggtgcaattattggaagagcataaattacacttaatttttgagggaatctatcctaccatgtcatatcctgaaaaggtcacggggtacacagatctcatctatgattcgccatatgaaaaccttaacggtgtaatcaaattgtgccgaaactgagtcaatctcattgtctcgtttttctcaatgcgtgcggttccagtggacatcggactatccgatgaacacaatcatgctcggccgtggtgagtaccagacattctagtgaagtcaccaacacatatactgattgatctcatcaacccatgtgcctatcggtccatcttatgttccgatcatctaagtactcatctactacaaaatagatctcatctactacgcccgcatatcaactatatgcaatgatctaaatcataaattatacaaggcggctctgataccactgttaggatacgcgaaggctacgatagcataaatcaaaattttctaccacgtaaactaggaaccatgcaagtattagatcatagatcattaccactcgacgtgttgcgcagcggaagaaagcgctaagaaggcaaaggaaccctcgcgatgtagcgcgcgtcgatgtagaggaagttgtcgatcgcaccaggtcgaccttctccttcccgtgcattctcctcgccgtagtaccacgccgatcagcaccgcaatgcagcggcgcctctactgtacagagacggaacgccacgcgcagatgcgctagcacccgcgcgcggctagggtttttctcgggaaggagagtagcggctagggtttctcacgtgattcaatacctccaccagtcacacccctcacgaatatataggatccatgactcgggccttcaaggcccgtaggactcctattcagacccctatccgaattatgctcatattggatctccatccaatcctcttattccgacctattaagcgtacgaccctataggttcatgcatactcggctgtaacccgaaaattctttttcggtccacgtgtcaacagcggcccctagcagaatgtactgactgactgggcatacacaaagatcatatcggttggacctctattgtatacttgtatgaaccctttgactcacgatatctattaagctcaaggctagatatgtgccatcctataatagctcaatcattcactcgaacttgtgatagattatgtaacttgtgattgactcttcagtcacctttggtatggctatgcacttctataatctataacatcgaggggcccagagatatctctccataggaggggaaaatcccatctttattattcatatcccactacatgtttcgtagcatacccgaagaatacttttataactacccaattacggagcatgctgcgtttagcagttactaagtaagctactacacatgttgggagtcatgataatctaagatctaaggactcaacaccaatactaaatgaaatcattgatgacacggcacatatggctcttgcactgtctcatgttggggctatccaataacatattccccaacatgtgtccatattattaatttaatatctcaataccatgatccatgagacatgatcatcaattaatacatgtgttgatcatttaaacatatttgttccatatatgatatttgatcagcgatcctttataaatagtaacatacaacataaagattctcatgaaagaatcacatattcattaaccaataatgaattatctatttcaaaaaacaatgtcggataaatatgtaaacatagtatgtcatacaatcacttttctccatggtaatgcgcatgactagtaaaaagaaagaaacattatacctacccgcacaatggttgttagagtagtgtgtagaattaataaatgattggctggagtgtccatgtactactaatcaaaagtctacttcgaaggagagatttaattggtttctagttatctaatttaatttaataattcactaatacactgcgtcacatatgtaacgtccttatacatgcatgttcgcttaaaaccagacatcatatattaaaaaaaaataaagcctaaaattgcacactcctaagtctaaaattgtacttggtatgcgtgtgtatgtttaccttttttaacagtacttatgatgttagatatggctttactttatttttatctaagattgaactttttgtaactagttttgtaaaggttatgagctgtaatttttgttattatttctatatgttaaaatatattgttcatccttttcgataagaaaaaaaagatgaagcaattgaaatcattgaatgtcatgtgtgagaatcacctagacagtcctaaaactaaaaacactactttacattgtgaaatggagcgagcatatataattaattggatctatgaacaatataattagatctgccttttgacgttaccttgtcacaaattatggtgcaaatatacggatcgagctacaaagcactactgtccgtctgccatccctgaccatttctttattgtccttagccggctggtgacatatttggtgacgcctaacaacaaattcaggtgatcaccctactgttcatcaagacactttagcagcacacactacagtgcaatggcgctgcatcttctctcactacgggagaaaccatctttggtcggtcaatcaaattccacaatagttccggatgcaataaaaaccgggactaacgatattctttagtctcgatcaaaaggttagagctactttttttataccaatcaagactaaagatcaatttttagtcccggttaaaaaacggtaggcggtgtcagacccctctattatctttagtccactaaagatctatttctagtctcggttgctaaacaaccagaaaaaaagattggcatgcgcggagaggaccaggcatgcgcgcgtgatcgaggaggaggcgcatgggatcagttaataagttagtctccttctcctccctcacatttatctcctcctctcctcactcaccccatcttttcctcttcctcctccggatccgccccctcccctctcctccccctcctcctcacatctcaggcggccgggcggtgatggcggtggcctcgcgtggcagcggccgggcggcggcggaggcagcctcgcgcggtggatccaggaggggaggcggccagaccacccccggcagctgcaggcggcggccggcacggaggcgcgcggcggcaagcggtggaggccggcgcggctacacggatttttttcttttttccttcttaaagtgtgattcgatctgtgttgagaatgaactatattgttctgaatgatttatgttgaactatgttgctgtgaatgatttgatataatgggcgtgagatatacaaaatagcaaaaaaaaaaaaagaaaaaaaacttggtcccaggtatttgaacttcgtagtccaggggttaccaaccgggactaaagatcgatctttagtgtcaagtatttaaaccttcgtagtctcgattggaaaaccgggactacagggggttaccaactgggaatacaaagcatttctccaccagtgtatgagaatgatcttttcttccgtggaattgctgtatatctgtcgacagatttcgatttcttcaccgtcaaaatgttctgaacactaaaattaatatatcttcctggcccatgcacatggataggatgtaaaagcacaaaaaaatgagtttgaaaagaaagtataatatatactcgctccacttttttaatgttggaccttaatttgtatatatatttaaccatttatctttttagaaactcacataattattatttattttgatatgatctagtttatttttaaaggtgctttaagcttggcttacaatttttacgtaattgtataaaagttttaaataaaatagcagttaaatgaatgaacaacagtcaaactgaagggagtatatcacagtccgcataggcagaaacaagtgctcaagttttcaacaaacttggatgtgttaatatgcagatgggggagctgaagaaactggttgaagagggaaagataaagtacattggactgtctgaagcgtcggcatcaacaatcagaagagcacacgcagtgcatcccatcacagctgtccagcttgagtggtctctgtggtcaagagatgctgaagaagacataatcccaacttgcaggtcaacataacaaacaatatatattaatctgcccagagtgaattttcataatattttcaattggacatatgtttctgaacatttcagggaactcggcattggaattgtcggctttttgtccagtggcccaaaaatagtaggcacaatgtccgaactagagatgaaaacggatcgaatacgctcggaaactagctctatcatattcgttttcatattttttctcgaaatcaaaatcggaatcggaaacccggatacgaaaacagaatcgaatattatcgaatacaaatacgaagcgaatatgaatcgaaacgaatacggtaatgtataattatcaaaatatcaagacccctcaaaataagcttcttaaaacgaggaagagatgtagccattagttttcaaaaacaaaacatcagtattctcaaattttatcagtattcttaaatgttatgtttattttccatacaaatttatgttatcatgaaacaaataaattaatgtgtatagctgaaattttcgtaagcacattgaaatttttgaaaattggttgaatattttaaattttgggttgaacatttcaattgaaagtttttaaaaatttgagtggttctttttcagaattgaatttttttatttgtttgtttgtggaccatttaaggacccgcatggaaaaatcaatttttccatacggatgacttaagaagccgtatgcaaaaataaaatttgaaaatttgaaactaatttatctcactcatatgaactccaaattggatgatttttttttcctaaatgtttttaaaatcatgctctatcatgttattgtgttcttactgctattattttggcaatttttttcttgtgactttattttatcaattaaaattttgaatttcaaaacttcaaataatattttgaagctgtaattaatttcagctgaaaaagtcatgaacataaaagttatagagctcatcaagacatacaacttttattttggtcatttcttcatccgataaagtgatagtagtattattcaaaaagtttacacatctctcttatagtttatagaaacaaatgagatagatgtaaattttatgaacaatgttactatcactttgtcggatgaaaaaatgaccaaaataaaagttatagatcttgatgagttatacaactttattgttgatgactttttcagttgaaatcatttagtatttcaaaatattgtttgaagttgtcatattttgaaattcaaattcaaacggttcaaacaaagtcatatagaaaaatgaccaaaacaaaagttgtagatgttgatgcgttatacaactttattgttgaaaattttttcatttgaaatcatttactacccgaaaaattatttgaatttcttatatttttaaattcaaattttatatggtttaatcaaactcggatggagaaatgaccaaaataaaaatgatagatctcaataagttatacaactttgtttttaacaacttttttcatatgagttgatttagtgcctttaaattcgttttaaagagccacatgtaaaatgaaaattgatttttacattaaaaaaatcccccattttcttcaccccaaccttatcctcttgactcttcctctcctctctctcacacacacactttctactctctctctctcacttcctctcatccacagggcgcaggtcgggtcgggcggcggccggccgagagcggtgcggagcggggcaggcggccggccgaatcggaaaattggtccggacagacggaaagtatccgaaccactttcatccctagtccgaacaagattaccggaaggtttcttttgcccatatatattttctctccgtgtttttaatagatgacgccgttgacttttatacatatatttgactattcattttatttaaaaattttatgtaaatgtataagatataaataaaactttaagcaaatgtataagatataaattatgcttaaatactttgtgtgataaaacaactcacaacaaaataaagtataatcagttaaattttttgaataagacaaatgaacaaacgtatgataaaaagttaacggcatcatgtattaaaacacggaggtagtatataacaatccatttgaccaccgtcatctctcttaaatcaatcatgacactatccaaaatttgcaaactcaatgaatggccattttctgtttcttccaggatctaccaagattccagccggagaacatggagaagaacacggtgatcttcgagcgggtgagcgtgatggcgacgaggaagggctgcacggcgtcgcagctggcgctggcgtgggtgcatcatcaggggagcgacgtctgcccgatcccgggcaccagcaccaccaagggtggccaacttcgaccagaacgtggcggcgctgggcgtgcgcctcgcggcggaggagatggccgagctcgagtcgttggcggcggcggacgtgctgcgcggggacaggtaccacgccagcttcctcaccacctagagggactccgagacaccgccattgtcgtcctggaaggaataagattgaatgataactacacaagtgtggctatgcctccattatccttcttggcgttgtgaaatatgcacttgtgttgtgtgtgttaataaattcttaatatgagatgttccctatacaaggtttgctatggtccaacagatagtacctcaaggtannnnnnnnnnnnnnnnnnnnnaattgatgggggcacgattggaaacgaactcaagccctctccctagcacaaatgagcacttgtatatagatgcctttcaatcttctagtcctcgcgtgcccgcatcgacaccgtaatctctagctagccctgcctacgaaaaaattcttgatacgatgctgtccacttgtctgctcctgtgaggtaccaaagttttgatgggcggtaaaaaaaaaaactctccccatatagtttgatagtgtaaactcttttatttgacggtatgtaatcacagttctccatcttacctctgccagagattttatagcttataataaaatcccgttgttcaaaaatttggggtttgagagttgtgctaaaatttctattaattatttagttccataaacataatgcagagatcagcagaaaaaaaaaaggagagtgtgctaattggtacacagttatacttcttttagatcaaatcattcattgatctactaaatacatgcacggttaccaaataattaacaaccagaattcctatttggacttttgattggaaattaagcataaacatacatagtattttgagtacatatgttttgaatttgaagcagaagaaaacagtgttttgaaattatgtgtttctgtagtaacaggattctaatataattggtgacaaagtaatttcagttatttctagtatactcaccatattgcgtgcttggtgagctcggcgtcaccacggacatttccatgcctacttaatttcattgacgctgcttcggtgtaacactaatctatctgctcatccatgttgctcagaagtgcatttgaaatccccccacaaatttttgatgcaaaatttgttgtattcaagcctagagctgggacatgggctgtgcattctggggccgaggcaggcccagggaaggcagcccggcacaacgaaaaacactatagcctcaggccgatttgaacctagccgggcagttgggccgtgcctgtgcctgaaaatttggcacgatggctgtcatgttaaagtcctattttggctccactatgatctggaatcatagttatgaggatcagaccatacgtcaaaccgttgaagccctcgatttagtgttcgctcagtctgaccggttcgaccactcgttcaacacgactcaaatatactagtactaatggccgtccttgatattttttttgtctgaactctaatgaaagaattgctttcgcccacacgtttcctaccaataacacgagggggaatgtgtttttcttttgctgtagggatgtggaaggatctacttgcaaaaagaagtttcatgaaggaccacaagaagattccaccgatgcaacaatccaacggttcgcatcatctggagtgaagatctgacgacctttgttttagacgtggacatggtaactttgcaataaaggattcttctttcacttatttagattagcgatttcaattaaattgtcaactgatacatagctcagtggtgtaagacaacacctgggccctaaggtcagggggttcgaacaacacggcaagcaccacaaagggtaacaattctgaggcgtttgtcgtctatatacataaagagagcagggtgtcatgggtctagtagtcgatgctatgcaatgaggctaaatagcatgtccacgtagccatgtattcaataaggcagtaaatgaaatgaattgaatttgattcctctcctgttgttcttcttcttcctttgtctccttctattctgcactagattccccagtctctttccatattatattgagttctcattgtattcgatcttgtggtagtttgtgtgattcgatctctcacgaacttgggtcataacaattggtatcaaagccgttccgatccatcgtctcttggtctgagcagtagatccaagcaaggttggtgtttatccttagcgccgtgattctgttccatggtttgagcagcgagaagatgagtgaagacggtggttgtcatgctcatggagacggtcatgtatgctttgaacaacacggcaagcaccacaaagggtaacaattttggtgaagctttgaaaagttagatgtcatgcttcacaaaggaggccatgtatgctcgaattttggtgaagctttgaaaagttagatgtcaatttggaccataccctcggttgtgcatcctcttccccagccggcctccgatgtaaattaatgcttcaccagcatcctcggatatcaccagtaatgtgaatggttgcaggagaaagaaagattgaggagattcagagagaatatgatttaggggggcaacgtagatatttcacgtcatccgttcacactgggacacctaagaaaacaatattaagaatttagaggttatatctccattgacaaaaacatctaaggccaaacctaaaaatggacattttcaaaagttgtcggtttttattgcgacaactagtggaaattcccccttggctacaacatttccactgttctcttttttttcttcttctttcctctctggctcagcttgctcggcacatctgttattttaatattttttaattcccagcttgcatcagtaaccacggcagcaacaaacgaagagtagaccaggcagcaggcagcagagcacaaagcagcagcagtagaaaatagcaagcaggagcagggatgggcagagcaaaagctagcgggggtggaagccagctagagcagatcgatccatctctttacgcctcttttttatccgttctccctttatttatttttgagagtgaatcgaacattagtctagatatcttaaccatgtactttcgtatcggatcagggacagtggcggacctaagatttttttatcttgggtgtgcccacgtaaaccttagtatacaaattgagtatttcattaaggttttaatctgaagatagaacggtactagagaggtgaaaaactacttgatgaccttatctaggctatgtttagttccacgataaaattgaaaatttaaagaaattaaaacgatgtgacgaaaaaattaaaagtttatgtgtgtaggtaagtttggtgtgacaaaaagttagaggaagaaaaaagttggaatctaaacaggaccctaagtcttgggacaaactccaagccccagttgcttgtcctggctgccaatgacccaatggccttaggcagcggcgtgcctttattctcaacc

SEQ ID NO: 19266 - DNA, 2442 bp, Oryza sativa
cgccctctggccgggcggcaggcctgccgcccagccccgagccctcattcctccccctcaaatccaatgaaaaaaaaagaagaaaggggaggagaagagaagaaggggcgaagccctgccggattcagacgccgatttcaggtaatattcatagatcgtatatgtgactattgagttaaatagtgtgtattttttaaaactttgtttgaataaatgcattatatttttagggttttagttgtactaatctagaagtgcgtattgtagatatcggtaactacgtagatctactagtttggaatcaatacattaccgttgcattggcatacacaagaagatattacgttttagattgcttcagcatgaaagagtaatatgatctagttattttgttgacagatatgtcgaacaaacaaatattccaagtttaccatggaccaggaaacgtccgttacgggccaactggggtagatctgtcagattttattgtattagaaaggggaattgatagaccggctgagagaagtgtaccttctataaaaggatggttaatgaggggcttgaaagttgatccacagacaagtgacatatcaatcaatattatagtaagtcgggcaactgagggtttttattgggaactaatgccagttcaaaactctcgagtgtgaaaatggtatgtggaaaatgcattgcaacgcgggtggcctttagctatggttccgtttgttcacccgaaggatccaggtgtgcagatgaacatggatgatggcgagggaccaagtgctgaagtaaatgagacttctgtggaggaggtcaacgcacgagaggatgggggcgtagtagctccagtaggcattcaaccaggtggagtggccgacgagggggagactgtcggtgccattgtggatgaaatagacagggaggattctgacaacgagcgtgtagagaaaggtgattcgtcagatgatgagacggatattaatccagcagaatgggctagtgaggatttttctgagatggtcgtctctgaagaggatagtgtgagatgggagtacaaagaaaatgaggttattcagggagcgatttatagtagagcagaagatatgaaggaggcggtaaaacattttgcagtgtcaattcatagagagttttgggttgccaagtccaaccggtcgcaatatgaagttcggtgtgttaaggaaaaagatggttgtccctggagagtgcacgcgtataaggggaaatggaaggattattggacagtgtcagtcgttaccaagcatacatgttttctacctggtgtttagaaataccacaggaacattacatgtgcatttgttgcaactgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaaggtggcattcatgaactgtcgtcctgttctctgcattgatgggacattcttgacaggaaagtattggggccagatactaacagcaataggggtagatgggaacaatcaggtattgcccttggcatttgcttttgttgagagtgagaataccgacagctggtactgattcctgaaattagttaaaacaaaagttgttggtatgaggccaaatgtgtgcctgatacatgataggcacgctagcattctacgagcgatagaagagttgcagtttgggagtatggaacgaggataccctggtgtttgggaagatgtacagagtaggtggtgcatgcgtcatatgggagctaatttgttcaagcaattcaagaacaaggagcccatgaacatgttcaagaggctatgcaatcagaaccaggagaaaaaattcaatgagctttggaagagattagatgagttgacagccaaatgtagtgatcagcgtgcaacggctccatcgaccgccgttgctgaccctcctgaagctcttggacctctcccaatgaatagtccaacattggttagaagaactggattggagattcggaaattttctcagtggattcttgtaacgccccgattttcgttcgggattaaaaatcatttaatgatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcg

SEQ ID NO: 19267 - DNA, 761 bp, Oryza sativa
  unsure (1)..(761): unsure at all n locations
atttgccacgcctgcttggtgttatcgaggaaagaaaccctgggagctcttacgaagtgaagaaattcccctcaattgaacatcctggcaagagtgtgctgcaaagggcgttcttagctctacatgcatgcaaggtggcattcatgaactgtcgtcctgttctctgcattgatgggacattcttgacaggaaagtattggggccagatactaacagcaataggggtagatgggaacaatcaggtattgcccttggcatttgcttttgttgagagtgagaataccgacagctggtactgattcctgaaattagttaaaacaaaagttgttggtatgaggccaaatgtgtgcctgatacatgataggcacgctagcattctacgagcgatagaagagttgcagtttgggagtatggaacgaggataccctggtgtttgggaagatgtacagagtaggtggtgcatgcgtcatatgggagctaatttgttcaagcaattcaagaacaaggagcccatgaacatgttcaagaggctatgcaatcagaaccaggagaaaaaattcaatgagctttggaagagattagatgagttgacagccaaatgtagtgatcagcgtgcaacggctccatcgaccgccgttgctgaccctcctgaagctcttggacctctcccaatgaatagtcccacatcggttagaagaactggannnnnnnnnnnnnnnnnnnnnnnnnnnnnnnnnnnnnnnnnnnnnnnnnnnnnnnnn

SEQ ID NO: 19268 - DNA, 3835 bp, Oryza sativa
  unsure (1)..(3835): unsure at all n locations
nnnnnnnnnnnnnnnnnnnnnnnnnnnnnnnnnnnnnnttggtaaccgtgagtaaagcgtatggcgatcttttatcccggttgatgttatcaaccgggactacaaatagatctttagtatcggttggtaactaaagattgaaaagtgccctggagcttttaaaccgggactaaagatgtttttagtcccggtttttaatacgaccggaactattgtgaaatctggtcgaccgaccaaagatagtttctccaccagtgtagcggtagccaaggtggacgaggtagacagggcgaggcgcacaacagcaacagccgaggcagatgcaagcgatggtgatgatggaagaagctacggcgaacaaggagtagccgagatagacaagggcaatgagtgtggtcgcaggcggataacggtcgtgggcaaggcagacacaagtgatcgcaccagccgcgtgaacgagcatgagggaaaaggtctgacatatgtaggtgacggcggcggccacagtggaggagggaggtaggcatggctcacgcaggcgatgatggcatgcaatggccgcggtgacgatggcttgcgacgcggctagcgcaggtgcactattgccatggtaggcccacaacctcaggccacgcgtggggcgagccggtcgactaatttgtcgcccactcattttcgctattcccttctctctcctctgggtcatccaaaaccgtaagtggagctcctaatgtctgttattgcaacttattgtacctactcttactgttttaattactttctaagataaatatcttgccgctttcttatcatcttcgtgacctgtttttaagcctcaaataatagagaaataaaaattaaatttataactttttttgtttgtttttgtataattttatgtggcttaacagcacgactatgagatactctagatttagacttttctaactttctagcagtaatgagagtgactttggaactcaatatgtagtacgccgtatatattaggcagagaaaggttaaatattgatattggtaactaacacagtatgtagatatttcttggacagatggggcatttcttagtacatgatttgttgtactagaaaatatcccatccatttaaaatttattatattttaggaccgaaggagtatagtccctaattggagtggacagatggaaatgggacaaactggagctcaccgggatggagcgacggctgcttgcctcccacacacatttcatttccttggacgttctctgcacgttctactgatagtgaaggataattttagaaggtattggtggtaccaaacaaaatagatagtattttatccgttttaaaatgtatgacatcgttaacttttcacataataattaatcattcgttttattaaaaaattagtataatatgcaaaagtaaaagttaacattatattttatttgatgataaaacaagttataatgaaataaatgatatttatataaattttttaataagacgaatggtaaaatattgtacgaaaaattaatagcgttatacatttcgaaattgagggagtaattagtatattaggtaccaaaggttttactagtatacaattctgctacctactagtcaaacggccggtcaaggtcacctgagagaaattaggcaggcagctagtgacctttttttttttttcggaagtcggcagctagtgacatcggacacctatccgcatctgtactcagagactgctcatttgtcctacaaataagctatactagccgggaccccgcgggttgccgcgggcataacaaatatatatatatttaaaactgtgaggtaagaggagaaggttcccacgattcatattaagcttcaagctttcaaaatatttccatcaaacttataccgaataacatcattgaatgccatcacaaagattttggccatagttaatttaccaaacttttaaacgattatatcatttgcaaccacaagctctgtagcacacatatgcccgttacgccatttacaaccacatacaaccgtgttgaaggctctggtcaatccaccccaaaccattttgttatcaattggccagcggataaaccaaacaaagctattttgcatacaaattggccttctgaaaaccatccatagatgaggctgaaagtttcttaaccaaaggccaccaccgatatggaacttttgttacttccatatgcacttgattgtgaaggattgacaactaattgtaaaatattaacataatcttgactatcttgtaagtgatatttacatgtatagttatggtatggagtagcccataggctaacacggtgtttaactaagctgcctttttgttttaactttgaggaaaccaaactgacctaaaatggttagattgcggcaatttgtttctagaaacggttgaaatcaatctgcaagagtataggagaatgtgcatatgtagctgtagaaatcctctatttcaaaagtagctctacaaatccaatagaatagttggtacacaaaacgtattgtacgcttgcaactaaatgagtatatgtaaattagaataatactatactctatagcctgacaaagggaactattaagactgcaggattctaaataatgatgagcgccaataacagtgttaaggatctttctgcacagtcaacatatgcattatgaccaaccactggataaatggcgaggatgcacacatgacattcatcctttttcaaaattaataactgagctatcccaaagaaattaaacgattgctaaaatactttgaatataatttgtgctcataattacaaatggtgttaccacagataaatgtgttattttcttcagagagaagaacctggaagacttgtggtagtttactcccttggtcataaacatcggttactgaaagaaaatgcagaaatgttagaacaaattttattattaccttgatggttattatgaattgaagcctcatggtgatgaactgttcatatggcctcatttgcacataacagcagagtttgtactatacaaaatgaagaaatgccatcaacttatgtgtattcactcaaatgaaggccctcatcatcccataaatgctacaaaagcatatgcaaagccatggaacctataaaagctaggtgttacacatgcagttcaacaaatatatcactgattgaagaccatgaacctgacagtccatacataggcctcgtaatgtaagcaatcatggcatcatactgcagcaagcggttgcgatcaagttgaattgtgtgccttttgtactaaacatcaatattatctatgaaataataaattatcttccagcttgaatcaacactttattcttctcatttgtatcgccatgaagccaattaggaacactgaaggaggtagcaaaaaacaatcatcttatgtacaccaaagcagtaactaattattcctgtgcatgcacaaatagaacatgtgcaagcggacaagtagcacactgatttttttataggttgacctttcatggtgcattgttttgtggcatcctgcactaaccataggcatatggtcacatcgtacaattatatagggaaaaaatcaggccaatatctctttgtacatgatattttgctgtgtgtaaaaaatgaaaatatgtgctataacaacaaatggctgctaaacaaatggaatcccagcaagatatataaaactatcatgcatccctgaaacaatggggaatcatgtattttgaaagaaataggaaaacttgattgttgtttgcactttaggccaattgtacgggtagcaagcatatcagaagaaatatttatg

SEQ ID NO: 19269 - DNA, 504 bp, Oryza sativa
gctgatggatggtcggatggaaccgagatggcgagatcgcacggtgcatgcatacgctggtactgtgaccctgcagcaaaggatagctgcgctgtggttcactggtagtgggttatgaaaactaaggatttaatatgatatcttgtgcgtacaaaccggatttcagaacgtttacctggtagttgtctggcgatcgcatggtattgtccaatgttagtcgcatagatttcggccgtttcgtcgatctgcggttcttcgaagacgttgctgaggtcctatcagtgcgagagcaaggcaagtcatgcattacaaatgatcatgatgtactcaatttacaaatgttccgttttctattaaatgttatattattttacaatatcatatgggatgggtcctattactcagccatatgttgttcaccttatgccattgataatttgggtattaatcggataagatgttggtttagaaaatgcttagccatgcttagatccactagctcac

SEQ ID NO: 19270 - DNA, 734 bp, Oryza sativa
tactcttggaagaggttaaactcactgaatccttcaaagaaacagcataagagtgaatccttgggtacattactgacctgactttattattccagaaatcatcccaaaacagacaagtctttccatccccaaccttacaggtggacaatcccctaaaaatgtctgcaaattgtagaacatctttccaccaaaaagaccctctagggcgatcagcatgaggaactttattaatataataagtggaccagatcaagctaacccaaggtattgagagcctattataaaatttgtgcatatttttcattaaaagagcattattatgcagcctcaggttaatgactcctagacctcctctacttttaggttgacaaaccctttcccaaagaaccaaagatttcctgctagaattaatatcagttcctctccataaacaatttcttctagctctatcaatgttttcaattattgactttggaagggaaagagagcacatatagtaagttgggagggaagataaaactgaattgaccatagttaatctatctccataagacaaaagagcagaagtagcagacaatcttctctcaaccctatcaactaagggggcaaaatcaattatttttggcctagttgttcccaaaggcagacctaaataggtgaaggggaaagtgcccactgagcaaccaaacatcttggacaaatgctgcacctttctatatcccattcagaggaat

SEQ ID NO: 19271 - DNA, 361 bp, Oryza sativa
tatgccagaaccaaaaatagcaaatgataaaactactagtaatttttctcagatggacgaaataaaaggcctaaaattagcacagagcttcacctggctcctgaagggttcgtccacggtacctacaagagaggccatcagacaccccaagtgacggcgaatgagataaatgggaatagggagcatgtcggattaggattcggagcctcaccggctacggcagcggagtcgacggggaagacgagggcggcgacggcgtggatcgcgcggacgacctcgccggcgctcgacgcggcggcgaccgcgtcggccgcctccgccaccttgtccagtgctaggtcttcgaggcgcgcgccaccat

SEQ ID NO: 19272 - DNA, 1160 bp, Oryza sativa
ctcctggcgcagctccaggatcttcatgttgttctcgaccatcccgcggcgtaccatctgatggaagtcgatacgagccgcgtcgtacgcctccaccatgcgtgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagggtgccgatggcgaggagagcggcgctctggcaagcggcggggaaggagtctccacccgcggtgactgccaacgaagcccgctcagaagagccggcgaggatcactgcggtgacctcccacccagcgtggggctccgcgtcgtctccctcctgatccggaagcggcctggcctggtagtccactccgtgtggataccccaagaccacgcacatgcctcgcaactccaagacgaagccagtcatgtccaaaccatgacgggtgacgctgccggccatctacaaacaaaaacaaaaagagaaacaacattttaaaggtcagattttgatgataagtgaagcagcaagacagagagagactagacagttttcacaaataacaaaggatttttatttttgaaaatattgctaaggcttgggatctacggctcgtcctagggtcaagggaggctctgataccaacttgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaatattattaatc

SEQ ID NO: 19273 - DNA, 474 bp, Oryza sativa
  unsure (1)..(474): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacatcatcataccatttgccaacatgatgtgatcgatgtactagattaagttgtaaataagcatatattatcttgccatgtaatattagaaattccaggtcagctaattctgattaggcttgatattgtcatattacagggttttttaatctgggatttgaaaatgctagaatttttgtcgattcgtgtggagattgtatggaagttgtcctgatccagattaaagaga

SEQ ID NO: 19274 - DNA, 675 bp, Oryza sativa
aaaagacttttagggatttttctttttataaaccttttcaactttgtttatttcttttcaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattcctttttgaaaatgatttttattttgggatgaatttatcaggacgtgacagtttgagccttttcttttccgttggtcgtgtagacgctgtagcttcggaagatccgctcttcgtggaagttgaagacggtgtttgggaaagcgagcaaggcaagacacatcatcttgatcatattgaatcccagtttataaacttatgttgatttaaattattgcattatcgctttatttaaattcccgcgttatcactgttttatttagccatgcctatttacctttgttatgaccttattattattgctattggtattattaccttggtcaccctagaataaacaaaaccccaactagtggacactctactcgtggtatcactagtatgatttaggtagatgcttcccaatttaattaggtaacattaggtgggtttacaactttagactttgggatattcatatca

SEQ ID NO: 19275 - DNA, 740 bp, Oryza sativa
aatactcaagcttccctttcgtctgaaacctgtgtacacctcgcaatggcgtgactcgaagatacacaaaatcatccactgcgaattccaggtcacggcgacggttatctgcataacttttctgccgtgactgtgccacctttagattatcccgaatgattctgactttagcttcagcttctctcaggatatcagtcccgaacacttggctttccccaacttggtcccacaggagcggtgttcggcatttgcgcccgtacaacgcttcatatggtgccatttgtatgctggcttgatagctgttattgtaggagaactcggcataggggagactcttatcccaggtcttcccgaaatctagtacacatgcgcggagcatatcttctaggatttgatttagacgctcggtctgtccatctgtctgcgggtgataggcggtgctgaaattcaatcgagtacccaactcttcttggagcttcttccaaaagtgagaggtgaattggcttcccctatcagatacgattttcttgggaacgccgtggagactcacgatcctagcgaagtagagctccgctagtttgttccctccataggtggtcttcacaggaataaatcgagctaccttggttaatcgatccacaactacccatatagaatcatatccgccttgggtctttggaagtccagtgatgaaatccatcccaatttcatcccatttccattcgggtacttggagtggt

SEQ ID NO: 19276 - DNA, 886 bp, Oryza sativa
tacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctacgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacagacatccttcccgccgttgttggagcggggaggcgcttggccttgctgacgccttggctttgggcatttatccgcaaagtgcccgggctcgaagcagttgaagcacagacgctgctgaccttgagcgtccctgcggccttgaacgggctgcacagctggcgtaggaggacggggcgcacgagtcccttgctgattctgctgctgctgcggctgtgggacgcgcaccacgaattgaggtcggggcgctgggcgaggttgctgctgctgctgctgctgctgctgcgaggaggatccccctgggtagggattggtgtagcgaaccctctggttagcaccctgttgattgcggaaattcgccaagcggcgcttgtgcgatttcaacttcctgtgcttggcttccaaacggatgctcttgtccaccagtcgtggaaaatcaagatagtc

SEQ ID NO: 19277 - DNA, 8387 bp, Oryza sativa
cggagagagaggaggacggcgctagcacgaatccgacggcgagagcgaccggcgagcggcggaaacggaggagagaggcacggggagcaaatatatagcgccgagagggggagagcgcgcccggagagggaggaaacggccgcggagatctcggctccattgaagacaccggcgacgattgcgggattcaaatcggacgaatccgagggagagagagagggaaaagagggggaaacgggagagggaatcacggggagtgatttccccctctttaatgcgcgcggggacggcgggatgcggcggaatccgcggcggcggcggcgctagggcacgggcggccgtcggcgcggcgcgagaagaaagatgacaggcgggacccacccgtcagcgagggtggcgggcgggcccacccgtcagcggcgcgcgcgcggggaggagccgatgggccgcggggagaggagagaggggggggagttgggccgagccggcccaagaagggaaaaggggaggaaaaggacttcttttagggttttctttttataaaccttttcaactttgtttatttcttctcaattattatttgtgctctgaaaattccactaaaatttatttacacattttaggcttttaggaaatatataaaaatcctccaagcctcatttgacttttatctttgcacattttaattgttggaggctttcacatgaattttaattattctcggcacaattttgaggatgaattttagagtcgttttgggacgcgacaaacctaccccccttaaacggaatctcgaccccgagattcggaagaactggcgaagagatcgggatgggctgccttcagctcgtcttcacgctcccaagtagcttcttcttcggcgtggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaagacatttcttgagttgtgacacatggaacacatcatgcacgttgcccaaggaggcgggcagctccaactggtaagcgacttctccgcgccgagcaatgatacggaaaggacccacataccgaggtgcgagcttcccttttgtctggaacctatgtactcctcgcaatggcgtgacccgaaggtacacaaaatcatccactgcgaattccaggtcacggcgacggttatctgcataacttttctgccgggactgggccacctttagattatcccgaatggttctaactttagcttcagcttctctcaggatatcagtcccgaacacttggctttctccaacttggtcccacaatagcggtgtccggcatttgcgcccgtacaacgcttcataaggtgccatttgtatgctggcttgataactgttattgtaggagaactcggcataggggagactcttatcccaggtcttcccgaaatctaggacacatgcgcgaagcatatcttctaggatctgatttagacgctcggtctatccatctgtctgcgggtggtacgcggtgctgaaatttaatcgggtacccagctcttcttggagcttcttccaaaagtgagaggtgaattggcttcccctatcagatacgattttcttgggaataccatggagactcacgatcctagcgaagtagagctccgctagtttgttccctccataggtggtcttcacaggaatgaatcgagctaccttggttaatcgatccacaactacccatatagaatcatatccaccttgggtctttggaagtccggtgatgaaatccatcccaatttcatcccatttccattcgggtacttggagtggttggaggagtccggccggtcgttggtgctctgccttgacacgctggcacacatcacacagagccacaaactctgcaatttcccgcttcatgctaacccaccagtatttctccttcaagtctaagtacatctttgtactgccagggtggatggaataaggactttcgtgagcttcctgaagtatcagctgtttaagttctctgctatctgggacgcatacccgatttccattccatagggttccgtgttcatcctctgtgaaaccagcggctttaccctgtttcatattcttgaggagtccatgcatgtccggatcattcttctgagcctcgcggatttgatcgagcaaggtaggcttggcttccaacgcagccaaaaatccacgaccaactatgtttaggttcagggcttccatctgttgactaagttcgggtggaatgccacggacgttaagagtgttgcaatgactctttcgacttagagcgtcggcaaccacgttggccttaccaggatgatagtgaattcccacatcataatccttgatgagttctaaccatctcctttgccgaagattcagatccgactgggtgaagatgtatttcaagctcttatgatcggtatatatttcacagcgattcccaatgagatagtgccgccagatttttagagcatgaactacagcggctaactccaaatcatgggtagggtaattgccttcatgaggccgaagctggcgagaggcataggctaccacatgaccgtcctgcatgagcacgcaccccaatccttggcgcgaagcatcacaatacaccatgaagtccttgcgagtatccggcaagattaacaccggcgaggaaaccagcttttccttgagagtttgaaacgccttctcgcattgcgggctccacacaaatttctcttctttcttcaacaactgtgtcatgggtcgagcgattttggagaagttctcgatgaatctccggtagtatcctgccaaacctaagaaactgcgaatttgagtgactgtcttgggttgcttccaatcggtgacggcggtcactgtttcgggatccacagcaactccttttgcagatatcacgtgccctaagaatttgacttcggacaaccagaactcacacttgctaagcttggcatacaattgatgttcccgcaactttcccaacaccagacggagatggtgctgatggtcttcttctgattgtgagtatatcagaatgtcatcaatgaaaaccacaacaaacttatccaagtattccatgaacactttgttcattaagttcatgaagaaggcaggagcattggtcaagccgaacgacatcaccgtgaattcatacagcccgtatcgcgtggtgaatgcagtcttcggaatatcttcctcacggatacgtaattggtgatatccggaacgaagatcaatcttggagaatacagtggcacctttaagttgatcgaacaggtcatcgatccggggaagagggtacttgtttttgatggtgacttcattgagagctctgtagtcgacgcacatcctcttcgtcttgtctttcttctctacaaaaatcacaggagcaccccatggggaagtactcggacgtatataccccttttctttcaactcttccaactgtttcttgacttcggccagttcattcgctgccatacgatagggtcgcttgtacagaggagtggttcctggagcaagatctatccggaactcaatctctcgcttgggcggcataccaggtagttcttccggaaacacgtctccgaactccctgactatggggatttctgacagtcctatctgatgaagttctgaacttctgacagaggctgggggtgcaaagaaaacaaccggttgttctggccctcggtacagagtgacagtgcgtctcgcgcaaaccactactccttggaattgagccaaccaattcatcccaaggatcacatccaacttcttggtgtctagcagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaacgaggaacgtaccaacgatgacgtctggagttgtcagcacgtcctcggccgtcacgtgattcacacgaccccgaatgacgtccttgccaccgttgttggagcggggaggcgcttggccttgctgacgccttggcttcgggcatttatccgcaaagtgcccgggctcaaagcagttgaagcacagacgctgctgaccttgagcgtccctgtggccttgaccaggctgcacggctggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgttgattgcggaaattcgccaagcggcgcttgtgcgactccagctccttgtgcttggcttccaagcggatgctcttgtccaccagacgttggaaatccggatagtccccagagactagacggacggacagctcggggtccattcctgccaggaacttctcttgcttctcctcatcttcccgcacatcctccggggcgtaacgggccaggttgttgaactcatgcaaatactccatcacggagcggttgccttgcttcaactctcggaattcccttttcttgagggccacgactccggcgagcacatgggttctccggaaagcggcggtgaagcgagcccatgtaataggctgtccctctggctgcgtagcttggaagtggtcccaccatagagatgcgggtccctgcagctggtgggcggcgaagatgactttctcttcatcactgcactgcacagtgtccagctttttccccacggcatgcaaccaatccaacgcatccacggggttgttggagctagagaaggtaggtgggcggatgcggaggaactcggcgagtttagagtgttggggaggtggtggtggagcattctgttgtggcggattttggaggtggtggaggaaagtagtcatcatgttggcttgctgggcgaggatttgggtgagaatggcgttggtgtctggtggtggtggcggaggcggaagaagaaggtggaggtgggttgccctggtggttgtggttgctgccttcaggttgattgccatcaccggtaacagcatttctcctggtcgtcaccatctgaaaaccccacacagaaccagcaaacagagagagagaagctaacaattaaaactaaccacccacgactaccataattcttaaatttattactgctattaaattggttcattaaagttcaagttgcttaggcaaataaaataagacaggctccgacacagttatgccacacaccggcataaccatgccccacacgactccaaaagaagacaaacgagaaagaacacacgcgcaagcctactaactgctcgtctactgctgcgacgggccaggacggaaggtgagcaacagcgcatcctccgtgctaccaacgccggaggcttccccctcctggggaaccacgggcgcaggctcggcacgaggggtctcgacgaagcaggtccacgccagggactgacgaacaagctcaggcctggaggtgctcttgcgggcggtgatcttctggctgcggcagacgcggcgacgcttggggcggcagatctctccctgggcgatcttgagctgatgcagctgcgcctccaccgcgtcgaggtccttcttgagctgcaggttctcctggcgcagctccaggatcttcatgttgttctcgaccataccgcggcgcaccatctgatggaagtcgatacgagccgcgtcgtacgcctccaccatgcgtgccaggtgcacgatggtagcgtcatcctccgagctagcatcccggaaggtggcgaagtcgcgggctcctccgcgacgagggtggtagcggtagggcgagtgctgcaactcgtccgggtagcgctggtgaagggtgccgatggcgaggagggcggcgttctggcaagcggcggggaaggaatctccacccgcggtgactgccaacgaagtccgctcgggagagccggcgaggatcactgcagtgacctcccaaccagcgtggggctccgcgtcctcaccctcctgctccgggagcggcctggcctggtaatccactccatgtggataccccaagaccacgcacatgcctcgcagctccaagacgaagccagtcatgtgcaaaccacgacgggtgacgctgccggccatctacaaacaaaaacaaaaagaaaacaacatttaaaagatcagattttggcgataaatgaagcagcaaggcagagagagactagacaattttcacaaataaccaaagatttttatttttgaaaatatagctaaggcttgggatctacggctcgtcctagggtcaagggtggctctgataccaacttgtcacgaccggaaataacccaacgggcgttcctgacgtgcgtgcattaatccttgtcccaggaggcaaggtacaccaaaagctgatacaattcagagtttaacaagcggaagcgtaaatagaattattacacgggcagcgaaggcccagcacacaaagacaaacgaaaaacagcggaagactagggcgacgaccacaggcgcttgacagcaggcacgagctagacaccaaagccttcatcttcaaggaactcctcttctggacttgggaaaaattgagcaagactgagtacatccaccgtactcaacaagacacacccacaaatgcagaataaatgcaagggagtacaagggaattataatataaagggttagggttgcagtaaacagcatttaaagacatttagttgctcaaggctattttgtaaacgcgatcttagcactatacaatattattaatcaaggccgtgaacccacacgaacctgccttaacccaaggcctatgatgattcagaccgaactggcaacccgaccctgggtcccagctcgtcccaagccaacccaggccaaccattccacattttagttgttaagcgggttttaagaattaaaacactaacttgggtacattgctcggcttgcccataaccgagggcgcggctattcgaatagattatactctgatcagaggtgtacatctttacccacaagacacatctttctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttgggggcttttgaatagagggggcggtgtgaatccaattccacaataaaccaacaattccatagtgtccaggtgatatgaatatttcccaaagtctaaagttataaaaccacctaatgttacctaattaaattgcgaagcatctacctaaatttaaactagggataccacgagtagagtgtccactagttgaggttttgtttactctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatatgacttgccttgctcgctttcccaaacaccggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatcgcatttattgcgtca

SEQ ID NO: 19278 - DNA, 5280 bp, Oryza sativa
acagttctatctgatgaagttctgaacttctgacagagttgggggtgcaaagaaaacaaccggttgttctggccctcggtacagagtaacagtgcgtctcgcgcaatccactactccttggaattgtgccaaccaattcatcccaagaatcacatccaagttcttggtgtctagcagaatcagatccgagggaaaaggaatcccctgaatttctatagggacggcagggctataatactttgctgtcataacccctccaggggtggtgatgagcagagggtttctaagcctttctacccccaactgatttctccccacgaatcgcacagatataaacgagtgggaagctccagagtcaaacaaaattgtagcagggatggaatgaacgaggaacgtaccaacgatgacgtctggagttgtcagcacgtcctcggccgtcacatgattcacacggccccgaatgacattgtcacaccctgaaaattcaaaatatataaattgttgtttaaatggaatttttagaaataattttaaaagtcttgaaaagaaaatctatgtttaattaataaattccaatataaaattgggccagataaaatttcattaaatactttgcttaattctataattcctagatttttctgggatttatttgagctaagaaagtatttttaataaatggaattgcatttaagaaataattttaattgaaaaaggttttaaaaagtcttcttttggctttgggccgaaagtcggcccaaaacctctcttctctctctcctcggcccagccggcccagtccgcagccgcgcgcgcgcgttcggccgctgacaggtggggcccacccgtcagtcgtcgtcttcctcgggccgaaaccctagtttcgcgccgccgagctgccgtcgccgccgctttccaaatccggccgcctctttccttctccggccgaatcaatagaggggaaatgatctccgggatctcctctaccttttctcctttggaatctttggttaaatcgctttggaaagctttggaatcgagttcgattcggatcggttttccctctttccaagccgcgagtttccttcgccgttgccgtcgccgtgggccttcgccgccgcctccgagcccctttaaaaggacccccggtgtctcctctacccgtcgcagccctcgccttcgcctctcgtcgccggagtagctctagcgctgtgtgccctagcttcgccgtcgccgccgccgcttcagccgtgctccgccgtcgctccagctgtcgccgccgctcgggaagaccgccgtcgtcatcgccaagtcgccgccgtcctcgtccgtcccttcgcagccgtcggaacccgccggagcttcgtcgccgtcgacaacccaaaggtagccgccgcttccttctcgtcgccgtcgccgtccgttgcttctccgccgtcgttttggtcgtcggtgtgttcgccgtgccgtccgctacccgttggtgtcctccgttcgtgccgtagcgccgccgttcgccggtgagcgtgcgccgcccgagccgtctgcctcgccgagccgccgccgccgtcggtgacgtcattgctggcgtcatcaaggccgtccgccgtgaaccgccgtggactcgatcaatctcagccgtccgatttggatcggatcaatctcggccgtccgttagcgtgaaccgccgcccatgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagccctgcttagaaacattagtacacttatgggataactaatgattcactattattttatgatggcttattgatagttcacgatggtcaatcgtgattagttaattaattattgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggcttaatattgtttaattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctacgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctaaaaatattggaaaagtagaactgttctcctccctttctcttttaattaaccaaactaatggcacatgcacttcataatttttttttggttctcattaaaaatttattccagtgttattagtactgtacatctattactgtactaatggctcatttatcagcaaaagttttacaatattgttttatttaatcttgctgcaataaaataaatttaccatgttgattttataattttctttcatttcttttgaaaccagttattcaaaattacaaaatttatgatctcgtttccaactgttttaatttatttcgcaaagcttggtttactttaattacttacctttttactttgattttcaaactttattcaaattaatccaaaaacttgtgctattaattggatagatgtcttaactctctcctttcacttgtctttagatgccgtgttacaagcctgagtacctgtttggagttgaaggttttgtccaggagttgcgtacgatgtcctttgtcattggatttgggaatgctcctttttatgcccagattcgtcatgatcgtcatgaagaaaagtgccgagtcaaagtcaccttgaacagcaatagtgaagatatcccctcagtgatgtttgaagctggaggaagaaactacatccatgcatgtcaggaggtggcaaggattgccataggagagcttcgtgatcgctacagtgatcagttggccgacactgagtatcgctatcatcctcgccaaccccagggaagtgaccgtggcagttaccttgagactgaaggaattgagaatgatgttaccacaagacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggctaggattcgtcttaccgcaagaaagagagctttgtttgtccctcgctatcaattggcgccaaaggtccgcgtggtggagaaagaagttgccccagcaaatcctccggtcatcatcataagtagtgatgaagaagaagaacccaagcgcaacaattccaagtttgagtgggtagctatcaaagatgaggaagatgagccgaacgagccttcaatcgacctcctatgctcggaagaactagaatgacttgttaagtcgttgtcttagatcgttgtgttagcttgtgtcgcgtcccaaatcgactctaaaatctatcctcgaaattgtgcaaagaataattaaaattcatgtgaaagcctccaacaattaaaatgtgcaaatgtaaaagtcaaatgaggcttggaggatttttgtatatttcctaaaagcctaaaatgcttaaacaaattttagtggaattttcagagcacaaataataattgaaaagaaataaacaaagtggaaaaggtttataaaaaaaaagaaaatcctaaaagaagttctttttccccccccccttccttcttgggccggctcggcccacttctccctccctctttctctctcctccccccgcgggcccatcgggcctcccgcggcgcgcgcgccgttgacaggcgggcccgcccgccgctctcgctgccgggtggggcccacctgtcatcgccttcctcccgccgcgcccgccgccgcgcccgtgccctagcgccgccgccgccgcggattgc

SEQ ID NO: 19279 - DNA, 21470 bp, Oryza sativa
cttcgcttctaaggctgcaacgaaacctctattgacaattcccaaatttaatctttcaaattccttgcataattccaatggcaactgtcgtccatctgtcacattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtatgagtaccgaaaagataatgacgccaaatctttaatgcatgaacgactgcagctaactcaatatcatgagtagggtagttcttctcatgcggacgtaactgacgagatgcataggcaaccaccttcccatcttgcatcagaacacaacctaacccaagtttggatgcatcgcaatacacttggaaacccttctttggatcaggcaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccggtaatatcctgcgaggcctaggaaactgcgaatctctgaaactgtctttggttgcttccaattggttacggattccacgttactaggatcgacggcaactcctccggctgagatgacgtgaccaaggaatttcacttcggacaaccaaaattcacacttgctaaacttagcatacagttgatgttctcgtagcttctccaatgcaagacgaagatgttcctcatgctcttctttggttcgagagtagataagaatatcatcaataaagaccaccccgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgataataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcatacccggtaaatcatctgggaacacatcaggatactcccggactataggaatctcttccaaagttatctggttcagtcttgaccttaaagactcagatgacaatgcatgaacggttacaactcgaccatcatagctggtgagagttacttttttgttggcacagtctatcacacctttatgtctggctaaccagtccatccctaggatgacatcaaggtctttggattctaacaagataagattggccagaaatggtactcccttaatttctattctgaccgaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcagtaactgagttaacaaggaacgtacccaaaaccacatctggagcatcttgagcttctgcagcagcaacatgattgacacgggcctttgatgctggtacagcagagttattctggacagggacaaccttcacgcgtcggggcttcggacacttgtcagcataatgtcctggatctccacagttgaaacacaccacgggcttgctgccttgctccctcttggcaggttgttgctgtgctggagctgcaacaggacgtggagcttgattacggatgttgttgccagcattgttgttgaagaactgacgttgcggacgaacaacagacgaagaacctccctgtggcatggactggggtcctaaggtaagacgcggcttttgattatttccctgttgtgtcttgaattgagcaatccgacgtttcttctgctccatgcgattgtacttgtcctcctgacgaatagccttatccactaatttctggaaatcagggtaatctccaaccataagtgggtaagaaagctcatcattaagtcctcccaaaaacttctcctggcgctcttcatcattgcgcacatcttccggagcataacgagcaagacgattgaactcgtgcagatactccgtaacagagcgagatccctgggtaagcgacctgaactccttcttcttgagagacactactcccgatggtatatgcgtctttcggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgtagccaatcactagcttcaacaggattagtggtactagagaaaacaggcgggcctcacacgaagaaattctgctaacttgttctgtggaggtgcatgattattcccttggttttgctgattctgaaattgctgcatcatcatgttcataagctgtgtctgttgagcaagaacttgggccagagtgggattctctccattgttgttattattggggttgttgggaccattcccattgctacgagtgttcaccatctggtatggacaggataagaagagaaaacgggggaaactacttagggcagagaattcctttaacatttattgatcttaactgagtttcattattacaaactgaagactctcacaccactaaactcacccacttcctaacactcaaaagcaaacaaacgcatgcacttacatcccaccactgatgtaaatcacatgcgagacccacacacacaaacaaacttaaaacaagcaagctgtcacgaccggaaatcacccaacaggcgttcccgacgtgcgtgtattattccttgtcccaggaggcaaggtacaccaaaagttgatacaatacagagtttaacaagcggaagcgtatataaaattattacatgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtaaacgcgatcctagaactctacaaagttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggcgcggctattcgaatagattatactctgatcagaggtgtacatctttacccacaagacacatctttctcacgtgcaaccacgtgccacataccaccacggtatacaggcgaaagacgtgacatagtttccaacccatcctagccatagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttaagactagactgagccacaaactaagccttacccactagacatgtggaagtacggtagtgcgttgcaacagaggcccgaagaccggtccttatatggccgaggtgctaccatcaaaaccatgcaccccgagcccagcctaaaaccattttgggggcttttgaatagagggagcggtgtgaagccaattccacaataatccaacaattccaaagtgcccaggtgatatgaatattcccaaagtctaaagttgtaaaaccacctaatgttacctaattaaattgcgaagcatctacctaaaatcatactagtgataccacgagtagagtgtccactagttggggttttgtttaatctagggtgaacaaggtaataataacaatagcaataataataaggtcataacaaaggtaaataggcatggctaaataaaacagtgataacgcgggaatttaaataaagcgataatgcaataatttaaatcaacataagtttataaactgggattcaatatgatcaagatgatgtgtcttgccttgctcgctttcccaaacaccggcttcaacttccacgaagagcggatcttccgaagctgcagcgtctacacgaccaacggaaaagaaaaggctcaaacactaataaattccacataacagcagaaacaaagcacaaaaatgggttcttcacttcttaaggaaaaattagagacttgaacggtccaattccgagttcaaatggccaagatatggccatttgaagtttatatgctctttaaatggatatttgcgaatttcttcatttaaattttaatttaaaaatcgaattattgcgtcagccgagagagagggcgcgcggaccgggtccacgggagtggggcccacgcgtcagcctctcggtccacggtggaccgggagcacgcggctggcggcggtcggcgccgtgggtcccacgcgtcagccgcacccgcgggcgcgggcggctgacggccgggtcccacctggcagccgcggggcgcgcccgaaggcggcctcgccggcacggccgacgggagggggcgcgcccgcgccccgatggtcaccgccggcgaccaccggcgcggcggagcggcgcccgagagagcggagagaagagggaaagcgaacggcggtcctcggctcaccccgggacgacgagggcggcggaaacgacgaccgaagcggcgagaggcggcggcgcggttcgggatgacgaggacgacggtgctccggcggtcggcgggcgaaacggaggcgcggacggggtcgacggcaacgcggcgaagccgatggaggtgacgccgagtcgggaggaagtccggagcgacgacggcggcgaaccggagcacggcggcgacggcggagagaaagtgcgacggtgcgggctcgattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcctgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcgaggatgtattttagagtcgatttgggacgtgacagtggcggaggaccgcccaccaacacctaggtgctgccgtgccgtcatgaccaagttggctacgtcgtccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagagcttgtgcgcttttgcttgtttagccattgggctgaacaggaaaagcttggcgcacacgaaagagtatgagagcttagaaaaacacacgcagaaccccctacatggcgcgtcagatgacggagcgtggggctcctcaccgggagaccgcgcaggtccccctttgccggttcggccgggggccctgggtgaggttctaagctcctagtctgtggaatgttcgcgaaagtggaaacacacaagacacgggcaatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccacttccgccggaagcaggtgcgacgtgggaacatggctgtctgccaacgacatgaccagtgtcagaccggtcacaaatcggtcattcttgtccaccacgcgtcagtttatcaatctgcatgttcacccttcttcatacaatgtcttgcttgtaacggttgggatgaagcctggcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagtggtccgatccctcggggagacaaagagaggggcggcctcatcaccttcgggcccgacccccccgagggggtcaggccacgtgggtgattgctcctgcccaaacctctagtcatgatactcccggtcccatgtcaccgacatcatgcttcccgaagaaaccatgatgaatttatcatggttacaacagaaacatccacatctacataatggtagtactagtattgttctattctgcacgtattacattctgtgtgcggaactcaacacgtactgctcgagtacaatttctgagcagaggacagggaaatgaaaagaatgcctaccaggtatagttaagttaagggtgtgtttagttcacgtcaaaattggaagtttggttgaaattgaaacgatatgacggaaaagttgtaagtttgtgtgtgtaggaacgttttgatgtgatgaaaaagttgaaagtttgaagaaaaagtttagaactaaacaagggttaagaagaaataaaataaaactatgaatatatctgctagtattgtacagttatgctacgagatgttgaattcaaatctcacatactattatttttttttacttagtatgcatctttactacatgttgtttcaattggtactaattaaacatcaaaaagtttagtctcgattactagtctcgaacaggtattaaagatcgtttctcgtgcatgagcaataaaaactgatataacaagaggaagctccacgagaaaagcaaagaagacggaaagagaatctcatatcacctgtgccatggattgatgtcacaaaatcgccgttgttcgctctgaatcgcccgttgacaacctgatttatcgatcagggctgtcgagagggatttatatgcgagctcaacattgtttcgattttccgattaccgcggacggaaatttgtccaccgcgtgtggatccggtaacgggcttcatcggggcttgcttcgatggacggtcaataggagcgggagtatgtactccctaggagtacccattttcatatatatactgtactcgaaaaattggctttgagttgaacctgactcttattttgttcttctggattttaatattttgtaaactattttctcaaagataatttaccaagttgagctatcattcatagcaagatctctcgctgcaacacccagggtccttttagagaaaattgcaatattgggacaacaaacattagggcttcgctgtcttgacactccgagtggatgacaaatgggtccatatgtgtctatgaaatatgtgtccagtatcattatagcaaaggtcaatgtttgcagtgtcattattgcaaatctcccgtcatttttaccccgtttcatagaaaaatattatatcttatgaaattaaatcttataaaattaatagacgagatatagctacattggtgtacatctttaatgcatgccatccaattttagattaccatattactttcgaacgaatggagtaagaaatgctcatctggttggcatcaatattttaggcgactggtgatatggaagatgttctccggggttgattacagccgtagttcctcgttccatgtcgtagacacacagcgctttcccattgaaccccgagtagtagatacagttccctctcaagcctgttgtccgtgcatcaagtgacgctccaaaacagcctatctgaacgaagaacactctgccacctagcgaatccaccttcacccacgctgatctttgctcctgcgtcgtcgccatgctcagcctgtaaacgccaacaccagcgacaatccgatcacatccaatcgggtgagagaagagaatggagtgcagctccccgttcgattccacaaagatgctggtacgtttcatgtacaccgccggcctcctgtcgtcgtcgtctacggcggtcacggtgaacgccggctccagtgagaactcgaggacggcgacatggtcgatgagatcggtgtagaactcgccgtccatcgccgtgagctggcgtaacgccaggatgacgatgccgcggtgctcgtggtgaggcggcccaggctggaggtactggtgctgatgcctcttcacccagtggttgtcgccggggcggcaataccagagcaccgtgtcggcgtggtcgatgacgagcacgacgcagctggccgggtccatgggaccgcagcacgagaggaggcacctccggcgatggctgctgccttcggcggcgaggacggtgccgtcgtggtcggggggcagcccgacacggcggccggtgaaagggtcccacaggaaagtgcacggcgagccgcggcgcgccatgagcagccagccctgcgccgtggtccaccaccggtggcctctcatcatgtcgtcgacgccgccgtcgcccaccctccttggcagcagtgctctcgccggcacgctgtacagggacgtggcgtcgccgtggccgaacagaagcagaggagcaagcttgggatccagtactgctgcagatgcatcgcctgcctcctccatgattttgatggccgactgtcccacaggtaggatacggccggtcaattgaaaacgaacgaatttggcggtgctttataaacgaggagaggctttgagcagtgcaattactggcatataggaaagagaagcgaagaaatctgcacgcctacgacctacgattactagtaccaattaggacatgaattcctacacgacatcaaaattcaaacaaattatagtactagtactttgggccggtaaatcagtaaaaggaaacagtaatctgggccggggataaagagggatcaccacatatgcatctatggagattggatagcaaccaacaaaaaccaaccgtgccgggtatacaaactacaagcagaagcggaagccgacctatatatgagtccggaggaaacacgtcaagaaagcagagctccgtagcagcacaaaacgcagcgcgccaagcaggccattgcggtgcacgaaccctcgagattcgccaagcagatagatggaggccactgcgacggcggcgcagggactacgggactggtcgtctctcccgttggacatgctcgtgctcgtcctggatcggctcgggtggtcgacccacccgagcttcgcattgacgtgccggcactggcgctccgccgtgtcgcccttctacccggcgtggatcacgcctctcctcctgagcgccgccgacatcggcgtcacgaacgtcaggtactacagcccctactaccacaggtgtttcgagatcgccgacacgctcctcaaggtgcccaaaattgcggctaggatctgctgctccagtggacaacacctcacgctgtgtctacctagattgatcctccaagccgatctcgtagccggcaccatgtatgagctgccagagatgcctttctattcattcgagtttattgtctacgatgagcacgcgcggaggatgtattgcgtcaacacgacgtacgcgctacagctcgcccgtgcgacccaacaagacgacggcgagtgggggccctgggaattaacggactttgacgtggaaggaccgcaacttctggcggcgccgatcagcaacccggtgctccatggtggtttgttgtatgttcttggtgaagacgggaagatggcggtgtatgatccatgcaaccacgacaataattttacagttcccgataaacctaagggctttggaatcaaacaccaagttgatagccacctgtttgagtccgaccaaggcgcgctcatggctgtcctcgtcggctacagtggtgcgcctatccatgtcgtcaagctcaacgaagagacgatggagtgggagaagatgcggtcattggaaggacatgcgttgttcaccgggacatacacgacaatgttgaggaagactaagcttagattgatgcaaaacaaggtgttcctcccgaggctgtatgactggcctgagactatccatgtcgacattgttacacgtgatggcgaaacagcatttgtaccaaagtcatccagttcgtctaacaccaaggagatcacctcggacataaatatttggttctacgagtttgggcagcaagacgcaagagagttttggggatcggagagagtagattatagtatttgggttgattttagtactaattgacacaaattgacgttgttagctcttatattttcatatagtgaatcatctcacaatgaagttactcttctttcaggccaaaatcaaaatcgacgcaaatgaaatttgatataatatttctttgttggttgaaacatggcgctattaatattatgcactcagccaatgcaatttttgcatgaattgatattgatatttgtgcacagtaatttatgaggatttaagggaataataaaattataggcttggatgattttctcggaaaatttgaatttttttgggagggaaggatttagggtttgggtgattcacaaggatttaggcaagttttgaatttcaaaattcgaaccttgggatttgtaatggaactttgggatgaagtttttgggatatcaaggagagacccaccgagatcttttggcacacttaagtccttgaggatacagaaagatctaaaatttttgcaattaggatttcgttttatacaaaataagttagaaaaataattcattcgactgtgagttgctgaagatatggtggtgttatcggaagacttgaccgaatagccatcactgctaaatggtggcatggatctacttaatccacaaatagactttcccattaaaccaaccatatgactgattactcccttcatttcaccaacatccattatccaatgcatgaatcgatttaaaaccaaaacgtatcacatagagctagaagaatgaggaaaacttcaccaaaagcaaagtagttaacgtacaggtgcaagtagttaacgtacagtatcaatgatactggttggtgacgttggctttcatcatatacttggttatcttcttcttcgccttcttgtcttccgactcacacgtcttagcgtgagccagaagtgggtttctcgccctggccgaagaaggttcaagaagaatcttcttgtagccttttccgcagatccaacacttctttgggtcgaattcctcctgctgacgcacggccacctgatggcccgttgcagtggcatcgagggcgacctcgtcggactcgatgactgcgccgagagaaggtttgggagcgccgtcgtcagcgtcggcattggcgctggagttgggatcgaccttgtcgtcggctgcgacagtgccagtgggatcgacctcatccgtgacggtgttgttggcgctgggagtggggacgagctcgccgctctcagccctggcactgccgctggtgtcagccgtggcgctggagtcggccatgacgccctcgtcgcttgtgtcgctggcaccagccggcgcagcactggtgctggcaatgttagagacggcagtgccaaatccagcgggatccaccagctggtactggaaggcgccgggcttgaactgaaccaggatgacggtagtgttctcgcccgatgccaagccgaactcaacaacctcctcacagatgacacgcagctctgcaccctcctgcatagcaatattaattggtcacagcattattggtaacagcagttttaacagcgaaagaatcgaagtcaaagcagatggcagtttgtcagccaggcatgcatattcagtgctaaactaacaaatggttttgtgaggtttagggcttacacagtttttttttaaaagaaaagagaaaatcaggatatttacattgcttgattgaagtcatttcctagaacagatagcatgattaacaccactaagatatcttgtcctgccaagaagacaaactgagggaaagaaaagactcaccaccgataaacggtcatgtatgtaagaaaccacgtccgcactgtccacgcaagacctgcagggggaaaatatacagtagtcaatgcaattagtatggaactatgagtgaaactatatatgaaccaaataggaggaaaaaaaaaaaagagaatgccaatgagtactggtgacataaaaatgatccaatagttattgacaggtattttttgctgaagagttaccacttaccagagaccttgacttgcaataacaagaaactccatgtcatcagttatgtcatcctgacattgaaagggcaattttccatcagatcccaacccggcaaaactgaacttcatattctaccaaacggacctatttacacttagttacacttacagcgaggatgtccggatcacataccagcatttgtttttcacgatctaaatctttgttcttcttgaaagcaaagtcacctgaaatgtaagtaggtaaaacgccaatcacagtgtaatgtgcttctttttgtgctattacatgcaatcaatgaaaaacagatccagacaagactataccaattgatcttgagattgttacacctcccccaaaatcaccgaggacccattgttccttgactacataattccccattacttgttcacacctaagtccaagagatctccctcctgcattttgaactctctctctttcagactcagttcttgtgcatggtttgtgatcgaaggataaatcaatagcctattgacaaaatggaaacaagcacaaatgttaggcaccacaatgaacgagcttgcaaattaggtattaaccagaaattcaatagggaaacaatcactataccaggccaccctgtcttgagagtacgcaacgagaatcaccaacatgtccaacaatcatttggttacctctgatgacaaccacacatgctgtgctcccttcatacgctggcccagtatatgtcgcctgggaaaacaacaaccaaactgaagtatataacacagaatcacaacattgttagaaggaaaaggctaccaaaaaatagctcaagaaagccaacaggtatagaaaaacatttctgaaaaccaaaccaatgtatgaaagaaataaccatcgaagggatatcgcaaacaatacctcaatttggatagcatagtatgataagaaccaaggtgcaatgagaacttaagaacctgttggcctccaactcagtaaaccagccaattgatatgtaactaattgaaccttttttaataggagcaattagtcgagattagggttaaacatatctcctccaactccaaagtacatcacaagaaagaacaacagtctcgatatcaaacacattcttccatttcctttttcatagatacaatatgcacactgtccaacaaatacaattttgagtaacttcttcacgatatgaatatttgaggatgctaggggttaaaagattactacctgtgggaaaggcttagcacagacaccagccttgagaaaatacatacatccattatcatgaggaataactaactctctccaagcatcggactgttgcaggttctcatccatgctgcagcaatcacacgaacaatgatatcccacatttccaagtgcagctataaacaaaattatgtaaagtaggccaaaataaccttaaaaacacattgtccagtgcattaatcagatcgttgtgatagtcttcatgattgcatagctcaatgtgaaattgttttgcgcaatacaatgctacttcagctcctgagatagaaaaaaacaattcagtatggcgtctcgctcaatacgatggatcaagattacttctattgcatagaagcttataaatcaaaacactgttgtgaacattagtagcagaacaacacttgaataggcatcattaaaaaaaaactaacctgttaatctgtaattatcctctaaattatcatcaccatttatattactagtaactcatattcatgcagtgttttatctctcatgaattaaaatttctttttatgtagttcatgttatccttgcaagcatgccacacgaatgtgattactgattagctaacttgttcattatccataactgtagcatcatatttatttgaaaattgacaggtaaatgtttcaacatataccacaaagttttcaaaacatgcgcagagataaacaaagtgatacacacagacaaacatagcatgacataacagttacgccaacaatttggagggtttgaaattaaaaaaaaaatgagaatgaaagcaaacctccatggccatcataaacaccaaagaaagacgtggacgtggcatcatcaagatttagaatagctgcatgctagagaatatagagggcatatgtcagtcacagtattttgcagaactgtccctttttttttcatacaaaaggctgcaagtttactcacagcatcttccattttctcaccccatccttgcatagacgacacaacatacttaattctgtcattctcttcttcaaaagtgaacttcgattctacaggaaggctgttacccatagcggaacttgctttgctgaaaatttaacatgaatacaaatataaaataacattattaacaaaaacggggaaagacacttaaacaataatacagatcaattaaatgccagaaagctaggttacatatgaaataaagtgaagtagaatcatcaaacttgatatggcactacttatctagctcaaagcacagggtgtaattggtgctttcattcagggcccttaaatgcttaaatgcatttttgagatatataacatggaagtatcaatcttcagttgcagtgctgcattattttacacctaaatcttattttattactgcgaacaaaatacacacaaggttttctacaaacgcgatataagctttactgacacatatcataacaccaaatttcaaagtgagataagaagaggaaacgagcgcataaagtgtactgtacaagaatgatcgatttcctttagatatggcactgcttcggcgaatcaaaacttaaacaattgcaaacagagaatgaagaacagaagaaaaaaagcaagaacaacctaacagtacagtacggcaccgaacgccatcacagagaagtgaaaaacaggttacagacaaaaaatgcacaatatctcggtaagggagaaggaagccaaatcaagattcaagagatggaagtttctttgataggtaaagaatcagaagatttacaagtaattcaatggagcgacacatgcagaaatcattgaacgaaaaaatagcatcgagtaaacaaagccacaataggacagagagttctttcgaggcagaaaacagagagacgtgtagagaagaagcatcctgcatattgcatcaggagcagcgaaatgaacagaagaaggcatctagctaatacaaattcagaaactggcacttccgcagcataccaaaacagaacaaactgaaaagagaaacgaattgatgtggtttaatttctcgagcttgcactggtagaaatagagaaacggaaggcaagatcaagaccaaatagagaaacggaaggcaagatcaagactaacatgttccgaggagaggcgaacgagatcaccatgaagcttccgtgctcttcaacctcctccaagaaactcacacacccaacttcaaaagcatcaagcaacaacaacacgggaaagggaagccaagaacaggaggaaaaaaatgatcacggccaggtaaaatcttagcaaatttcggattccgaaacgccttaaaattcgagaagagaacgaggcgccgttctacttgatcaatacgtaaggaagacgggcagattgcatcaggaacagcaaaaagaataagaagagggcatttggtttatacaaattcagaaactgacacctccgcaacacaccaactgcaaaacaggagccaaaaaaaaaaacaaagcagagaagagaaacgaattcatggcgtctaacttctcgcgcacgcattggtcgcgccaggaaccgtcaagatcaacgtgctccgatgggagagaggcgaacggagaccaaccatgaagcttcggtgctcgtcgacctcctcatccaactccgagaaaaccacgcctcaaatgcatcaagcaacaacatcacgggtacgggaagcgaagaacacgaaaaaagaggaccagaccgcggtaaacaggaaccaaccaagacgcagggtgctgctcgattcagcgaagacaagaacgagagaaaccgcgacaccaaacactccaagcaaacaaacaccaccaccaatggagcaagatcgaagaagagtagggagaagaatctcacggcgctttcggagaagaagtagggtttagggatggaggcggcggatgaaaccacagaggagaggaggatgaagtgggagagagatctcacctctcacctttgccgctgctcttgagacgcgagagagagagagatgcggaaaagtggttgtgctgcgaagcgcaaaaagttgtgcttaaatacctggaccggacgaatctcctccgtcggatcgtccctcgcggctgatccaacgctcgaggagtggccccatcctgtggctggtggtccccacggatacctcgcccctgcatgactcgtccaattctcttttactcatcatcatcaactattagtcagttcatcaatctgggtacaattttcatcaattctctttaatctggatcaggacaacttccatacaatctccacacgaatcgacaaaaattctagcattttcaaatcccagattaaaaaaccctgtaatatgacaatatcaagcctaatcagaattagctgacctggaatttctaatattacatggcaagataatatatgcttatttacaacttaatctagtacatcgatcacatcatgttggcaaatggtatgatgatgttatcaagcttagaaggtagcgacctgctgctgctgctgctggccttgctgtgatccgccgattccagtgctcgtgatgtctgaagggccatctcagaatgaagccgcaggcaggtcatagccatcttgaagacaaacatgccaatgggaggagttagatgacagtgtgaaaagttactgagtttccagcttatactgaattggtctcttttaagtaaaaactggtttccagcttataagtaaaaatatgtcctgtttttcgttacaaattgctgaaaagagctgggtcactgaatttgtatactgaaggaatgagagaaatgagtaggttacagaaaactaaagcatataagggtaggttactgaaatgattaggcgatgcagacaaactttgatacaaaaccagcataactgtactcctttgttcgtcaaaaaatgacctattattattgtgtgtggttttaagaaacaaatgtcatcctattataccataattgctctctacgtcgacgaacaaaacacgaacaagtgatcgataacagatatagaccagagtacttactgatgtgcattctgtatcaggatctgtttctgcaacatgaagagcccatgtgcgtatccattccaaaccagtagaaacatcctgatttccttctataagagatgatgcaacatacgacggatgcagcgctatcagtatgcaagaagctgcaaacaacacagacctcctgacgtatgcttcgggatgttgcgaaacagccctgcagaaacaaaatccaatgtcaaaatcgtaccacttggttataactaagaaagtctttaacacggaaatgcttgttttaggcttggcatacctagatctgatcatatcaagaagagctggggcaacagctgatgcttctggatgcattgccatgcacttcatacagacaccaagcatgtatatcaatttacctaggacaacaaagtcccgattgagcaagtcaacaccatgtgatcttttatcatatccttgcataacagggagcataaaagcagcagcatataaaggaaatctgttttttgaccactctgtctgcaaatctttagcttttccaagaccccatttacgagattttcctgatttaacttgaccagatctagatggaacttctctttcataccggtgtgaccaattcagaagtgttcctgattctgagacttccctccaaggacctgcaccagcaggtccctgatcactaggaactagccaagagggagaggtgtcggatatcaagtttccatgccgcagctctctccttacaattttagtttccgcaagctcctgtgcggcctcagtcataacatcaataatcaaaatgcgctgacttacatccacgcttgatgagtacagcaacttggtgagaacatctaatggttcaaatgtgcaggttaccagcaaggcaactaatgccttctgtctcttttcttcagcagaatcttcctctccttccattgccacgtcagaacatcgaacatgcacaagtgctctaacaagatcacctgagttgtggcgtagttcatcaggtgatgctctcacaagcttttcggcagaactcagagcgttttcaaccttgggtaaaaaaaaagggaggatgatcagaattttacaataatttgctctggaaagtacaggtagcactagatagaaacttacaccgtctggatcatcaggttttcgtagtgcagcagcaagatcttttaattgggtgaatttcttctgcaaatctgagtcatcgtctgacagatcatatggctccagggatgaatcactggaggcatcaatgttcattatttcctcatcacattcttcctctccgaaatgcccattcacagcagaaccagacgtttcacaagaatctagtgatttgatctcaatgatttttgccctgttctctgaagtatcatgtttaatagcctttgcccttctctcaccagcatgtttcttgttctcaggcaaagatggtttcagtttgcttataagttctacatcctttgaaggggctgtgatttccttcggagataaaaccccaaagtcccactcaacattctcacaacagttatcatcaaggtatagaggtttgtttggatcaccaactttagaaaatgtcaatgcaatagcactggccatcttccggattaaatcaattggactctctaacctacctacagcaaaagagcattcagtattaccataataataatatgataagctaatgcagggggggtggggggggatactcacagcttacaccttcaagaatattgttcaatacatctttagttgtttctaattctctttttgacatcttctccaaacacaacccaattgctgcagtgatgtctgagtgttgtttaaggggaacaagtcaaatgataatttgcaaataaaaagtgtgtaatgtaatacagttttgagtgcctcaaaggatacaagcttgttgctccactgagtatgcctggacaaactctttcttggaccaaacactgactaaagtgtgcagtgtaccaaggaagctcgatgtcctttgcttctgtgtttctatgcctgaatttggtggcaattcaaagacagcatagtgaagaatccatctcagacaacatagagggaatgttttccaacgcaaaaatttgtcaacaaacattgccctgaagaaagcacagagaattaaaggatgaaagaaaagaaaagaaaagacgcgttgaagattatttgatcaatcgctgcatgccaattatacgctgaatagac

SEQ ID NO: 19280 - DNA, 513 bp, Oryza sativa
tgacatctcaagcattgcagaccccaagtctactgtgattgccaaaagtgaacactggataaaaacccaaaaacaggctaccttaaatgtttaaaatttcagctgaagggactattagtggaccatcagagaaaaccaaatgtgtaccactgtgttgtattagtttgcataaggattaaagattatatgaggacaaaaaaggatctgctccatcaccctagtagcagaccatcgcaaacataaatgttgagttgaatacactataatcctaccagacacaaatgcattgctaaaccattactgcaccaactagaactgcccccattagtaaatagaaatgtctaaacagataaactaacagcacactgcacacgtcaagctacatcctgaaggatgaatactcaccagtagatccacgacggctaacacgagatatcacttcacccacgaagaggaacacagaattggaggcatctagtccattagcatcttcgccagcagccaactccatag

SEQ ID NO: 19281 - DNA, 5668 bp, Oryza sativa
gtagggggttctgcgtgtgtttttctaagctctcatactctttcgtgtgcgccaagcttttcctgttcagcccaatggctaaacaagcaaaagcgcacaagctctctccgagtgttagcggtgacgacggggagccgaacccacgccgtcgagctcgtactccaccgccccctccacgccaaagtcctaggcgggaggaggcgctcgagagggtcgaaggatccgcgacttcgacatccacgggtgatggagaagggcgccgagatggggagcgtcgcctcctcgtctacggcgacggtagcacgccccagggcgcgctccaagctgcgggcgcgctcctacgtcacccgcccgtcgtccctgacccggagtctccagcccaacgttggctggatgacgtagccaacttggtcatgacggcacggcagcacctaggtgttggtgggcggtcctccgccaccaagacctctggcgctgctaccaccggctccgtgtcgtcaaggcggagggcgcggcgagcggcggctgttgctcgccgttcggctgccactccctcgtcagcacctctgacccgggaagatcagcgtggggggccagatgcccgcatcggtatcgagcgccggcgtaatggtcgacgtgctacccacgcaacggagggtgcctcctcgtccggagtgtcacctcaacacggacgcggggatcagccctccgtgcccccggttggtggtgtcggctgtagagcctttgtagcgagccttcggaacgtccgttggcccccaaggttccggcccaccatcgccgaaaaatatgacgggagcgtcaaccccgccgagtttctccaggtctacacgaccgggatcgaggccgccgggggtgatgacagggtcatggcgaatttctttcccatggccctgaaggacaggcgcggggttggctaatgaacttgccacccgcgtcggtccactcttgggaggatttgtgccaacagtttaccatgaactttcaaggcacatatccgcgcccaggtgaagaagcggacttacacgcagtacagcgaagggatgatgagtcacttcgctcatacattcagcggttctgtcaagtccgcaacaccataccatgcatccctgcacacgcggtgatctacgcgttcaggggggtgtgcggcacaaccgcatgctcgaaaagatcgcctccaaggagccccagactaccgcggagctttttcagctcgcggaccgagtggctcgtaaggaggaggcctggacctggaacccctccggttccggtgtggcaacttcggccgcccccgggtccgctgctcagacagggcgacgtgacaggaggaggaagaagaggtcggcccattccgacgacgagggtcatgtcctcgctgtcgagggcgcttcgcgggccacccgaaaggggaggcctgcgagcgacaaaaagaaggaggccggcgctcccagcagggagcgcccaaccggcaagtggtgcatcgtccacaacacctccttccacgacctcgcggactgccgcgcagtcaaaagtttggctgagcggacgagaaagtgggaggaggagaggaggcaggagcgccgagagggtaagtccccggcggtaccctccggcaatcggcgaagtgaggccaagcagaaggcccccgtcgaggacatcgatggcggcgatgatgacctaggctttcaggagcctggggccaccattgccactgtcgatgggggagcgtgtgctcacgtttctcgccggagccttaaggccatgaagcgagagcttctggccgcggcccccactcatgaggcgacgcgtcgggcgcggtggtcggaggttgccctcaccttcgaccagaccgaccacccaccgtgtgttgcccggggaggacagatcgcgatggtggtttcccccaccgtttgcaacgtgaagttggggcgtgtcctcatagacggggggggggggggggggcagccctcaacatcctttcccccgcggcctttgacgccatcaaggccccggggatggtgctctggccgtcccagccgattatcggtgtgacgccggggcacacatggccgttaggtcatatcgacctaccggtcaccttcggtggatccgtcaacttccgcacggagcgggtaaacttcgatgtggcggacctaagtctgccctacaacgcggtcctagggaggcccgcgttggtgaagttcatggcggcggtccattacgcttaccttcaagatgaagatgcggggccccggtggccccatctctgtccatggcgacctcaaagtcgcgcttgcttgtatggagcagcgcgcggatcacctcgccgctgcgtccaagcccgagggtggcgacgagaggcttggcacctccgttcccgccgccccgaggcagcggatgatcacatgcgacgaggtcccggtcaaggaggttgccctgggtgacggcccgtccaagactacacgaatcggtggtcttctggatggcaaataggaagacgcgctcgtctccttcctgcgggcaaacgctgacgtcttcgcatggagaccggcggatatgcccggggtccccagggaggtgattgagcaccgtctcgccgtacggccgggcgcaaggccgatccggcagaaagtgcggcggcaggccccggaacgtcaagccttcatccgcgaggaggtggcgcgacttctggaggccggattcatccgcgaggtcatccatccggagtggctggcaaacccggtggtcgttcccaaggcgaatggcaaacttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactacattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtgaagacgcgcgaccaagaaactttactttcagatctggcggaaactttcgagagtctccgctccgcccgcataaagctgaaccccgataagtgcgtgtacggtgtacctgcgggcaagcttctcgggttcttggtctctgcccgaggcatcgaggccaaccccgagaagatacgagctatagagcggatgcgcccccagcaagcttagggatgtgcaatgcgtcaccggttgcatggccgccctaagtcggttcatatcgaggctgggagagaaggcgctacccttatttaagctcctcaaacgctccgggccgttcacttggacggaggaagctgaacgtgccctcactcagttgaaggcgtatctcagctctcccccagttttgatcgccccggagccagatgaacccttgctactctacttagcggcgaccccgcaagtagttagtgcggcgttggttgtggagcgcgatgaggacaatcctcattccgcgcatccccaccctgtgctggcttggcccgggagagagcagggaggagaggcccccgagccgaacggtggcccaaggcccccgacgaccggagctggccctctgcccgcttgtcagacggtgccaggtgcccccgacccccaggatggcccgggggccactgcgggaaggccgcacctatcgccctctgacctcgaggttaaccctgtgccgactcgacccgggagagagcagggagaagaggcccccgagccgaacggtggcctaaggcccccgacgaccagagttggccctttgcccgcttgtccgacgatgccaggagcccccgacccccaggacggccccgagcccactgtgggaaggccgcgcctgtcgtcctccgaccccgaggtcgtcggcacagaagacgagtgcgccccgcgaggccgcttggacgaagagcgccccagggatgcggcccctggcgaagaggatcggccccaccgaaaggtgcagcggcccgtctactttgttagtgaggccctccgggacgccaagacccgataccctcaggcccagaagatgctttatgctattctgatggcttcgaggaaactgcgccattatttccaggcgcatcgggtcacggtggttacgtcttaccccctcggccaaatcttgcataatcgagagggtataggacgggtggtgaaatgggcaattgaactttctgagttcgatttgcactttgaaccacgtcacgctatcaagagccaagctctcgccgattttgtggcagagtggaccccggctcccgaacccgtctcactccccgaggccagctcgggcccctcgcagctgcctcacaccgcccgctgggtgatgcagttcgacggctccctgtctcttcagggcgccggtgcgggggtcacgttgacctcgccgagcggagaaatcctcagatacctggttcgcctcgattttcgggcgaccaataatatggcagagtacgagggactccttgcgggacttagggtggcagctggactggggatccgccgcctcctggtgttaaccaggtctgtatggagtaccggtgctctgacccgcagatggatgcttacgtacgccaagtacggcgtatggagcgccatttcgacgggatagagcttcggcacgtgcccagacgggataacacgattgccgacgaactctcacggctcgcttcctcgcgagcccagaccccaccgagcgcctttgaagaaaggcttgcccagccgtcggcgcgacccgaccccttagggagacggacgcgcctgaccggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccgacagctctcaatgatgcggtcgacctggtccggcgatgcagagcgtgtcaattccacgccaagcaaatccatcaaccggcccaggccctgcagatcataccactttcatggccatttgctgtctgggggctcgatatcctgggaccgttgtcgcgtcccaaaacgactctaaaattcatcctcaaaattgtgccgagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgagaagaaataaacaaagttgaaaaggtttataaaaagaaaaccctaaaagaagtccttttcctccccttttccctt

SEQ ID NO: 19282 - DNA, 1441 bp, Oryza sativa
aacctttgaagattcctgaatggaaatgggaagaaataggtatggattttatcactggtttgcccagaacgtcatcgggccatgactctatttgggtgatagtcgacagacttaccaaagtggctcatttcattccggtaaagacaacctattctggaagtcgcttggcggaattgtatatggcaaggattgtgtgtttgcatggcgtccctaagaagattgtgtctgattgaggcagtcagtttacttcaaatttttggaagaaacttcaggaagagatgggttctaagttgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccttacgaagcactgtatggtcggaagtgccgcactccgcttttgtgggatcaaacgggagaacgtcaggttttcgggacggatatcctaagggaagcagaagaaaaggtaaagatcattcaagaaagattgcgagtggctcaatctcgtcataagagttatgccgacaatcgccgcagagatttgagttttgaagaaggagattatgtgtatcttcgtgtcacgcctcttcgaggagttcatcgttttcagaccaaaggaaaattggcaccgcgttttgtgggaccttataagattgtcagcagaagaggagaggttgcttatcagttggagttacctcaatccttggcaggagtccataatgtgttccatgtgtcgcaattgaaaaagtgtttaagggtacctaccgaagaagctaatattgaccagatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattaaagtcagctcatccgcttctgttcgccagttcttccgaatctcgaggacgagattctgtttaaggggggtaggtttgtcacaccctgaaaattcaaaatatataaattgttgtttaaatggaatttttagaaataattttaaaagtcttgaaaagaaaatctatgtttaattaataaattccaatataaaattgggccagataaaatttcattaaatactttgcttaattctataattcctagatttttctgggatttatttgagctaagaaagtatttttaataaatggaattgcatttaagaaataattttaattgaaaaaaggttttaaaaagtcttcttttggctttgggccgaaagtcgaaccaaaacctctcttttttctctc

SEQ ID NO: 19283 - DNA, 5881 bp, Oryza sativa
  unsure (1)..(5881): unsure at all n locations
ccctacccctttatattataattcccttgtactcccttgcatttattctgcatttgtgggtgtgtcttgttgagtacggtggatgtactcagtcttgctcaatttttcccaagtccaaaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaaccgtttaggcaggccccgggcgggtttgagtatctgtatgtcgcgatcgacaagttcactaagtggcccgaggcttatccggtcgtcaagatcgataagcactccgcacttaagttcattaagggcattacagcccggtttggggtgcctaaccgtattattacggataatggcacccaattcactagtgaacttttcggcgatcactgcgaagacatgggcatcaagctctgcttcgcctcccccgcccaccccagaagcaatggccaagtggagcgcgccaatgcggaaatcctcagaggccttaaaaccaagaccttcaacatcctcaagaagcacggcgattcgtggatcgaggagttgccagcggtgctctggccgaacggaaccacaccaagccgagcaacgggggaaacgcctttcttcctagtctacggcgcggaagcggttctcccatccgagctcaccctgaggtcccctcgggccaccatgtactgcgaggctgatcaagatcagcttcgcagagatgacctcgactacttggaggagcgaaggcggcgcgcggccctccgagccgcgcgctaccagcagagcctgcggcgctaccatcagcgccgcatccgggcccgatcactctgcgtcaacgacctcgtcttacgccgcgtccaaacgcgtgctggattgagcaagctctcaccaatgtgggagggtccgtatcgagtgatcggcgtcccccggccgggctccgttcggctagccgcgggcgacggcacagagctgcctaacccgtggaacatcgaacaccttcgtcgcttctacccctaatagggttcgggtgtcaggtttcgggctcgggccaaccccgtacccccctcgggcgtgcagggttggccgggggctaccacacatgcatattcttatttctcttctatctgtatttcaataaaagcattttcgatttcctaaaggctgtgtctgtgctgttgtttccttttgaagaatcttgacttgaaataggtcactcgtgctcgatcctgccctcgggggctcgagtcggctaaaatcgccaaaaggggcccagaaccgagccgtgccccggggcgtggtgaactccgggggggaatcggcaaaaacccacaaccgggtcacccataaccctcggtcaccacgctcccggcctggccagtctaaacacgtggatctccccaggcactagccccgacccgagccatttgaggactgggacctgggcacgagcccttgttcgagctaagacacaaacgaccatggcacagatcatcctcgttctcatacacacagtaaaatgaaattgacacagaaatttctttattttgattgcagagtaagttaatctatacaaaaaggaggcccgaaggcttcggaagaaagaaaagaagaaaaaactatttaaagattggcggggacctggaggctcactccgatgcacccgggtcgccagcctcgtcgccactgtcgcccacaccgccgtcatcgccctcctcgtcggagctgagggcgaacgcgagccgaggggccgaaccctcgaagctgtgaacgatatggttggcggcgtcctggaaccgcgcgcgcgcgccgtcctcagtcccgggagggaactcgtccagcgccatccatggggagaagtcggggtccctggcctggtaactcgccagtacgagctccaccgctcctcgggcaaggtccctcgaggatgacttaatcgtcctctcgagctcctcggggagccgttggagagtcccggccatctccgagaggcgctgagcgaggcccccctggttggcggcgtacttcgcagtccgcccgccccagagacccgcctgccgcccggcgcggtctaaacgggacacggcgtcgcgaagcatgctgggccctatctcgcctgccagacgaagggcctcgacctccccggtggacgaattcagcgcgccctgcagatccgcgatggtgtgttcggcagctgcgaggcgggcggctaagtcgctgtcgcccgtggccgccccaccggtacgcgcccttgcatccagctcccttgcctgcgcctcgagttcagcggcccgttggttcagtgcggccctctcggcgcgggcaccttccagattgcgacgcgcttgttcctcttgcgcagcttcgcggagggacgcgctctccgccagcctttgcgctgcggcctcggcctcctcgagggctcgctcccgctcggtgagcgcatcctcgcggaggcggagtgcggattcttcttcggcacaggcggcttcgtgcgccgccagtgtgacctcccgaatggcaacggcggcctcgcggtccgccaggtccctctccacgacgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagcttcttccctagctccgcctcccagctcccgtattgaaggcggaggtcgtcctgcgcctcgttcatcacggtagtggcgatgagggcagccccccgctcctcctccacctccctggcgatctcctccagcaccttccgacgggcttcgagctctgaggcatgccggcggtgtgccttgcggctcacctccaccatggcctccaccgagtgtcgcccctcttcgacgcgcgcccatgcggcgtcgagctccgcccgctctgcttgcagggcttccatctgggcacttaacccgtccaacaccgtggtgtttgcgacggccaaggcctgcaaaaggggctctgcgctcagtggggcaacggaaggcgtggggaagagccgcctcggtgaggatgccgcgcggcccggcccgccgatggacgtgccgggctcggggacgtcccccggacctggcttgtcctgagtgttgcccgagggagtgggcccaagcgatgtgcccgcggcctcgtcgcgagctgcctcggaagttgtcgccgcctcggcttggcgaagtctggcttcctcccgagcggcttcttcagcctggcgagcccggacggcctcccgggcggcctcctcggcttcccgtaggcgatccgtggcttctcgccggtcagattctcgcctccgggcctccgcggtcgccgtatcctcggcctcagactggccggacttggaatggcgggagggacgcgacgagatctcgctgaaacagaagaaagaccagaagacaaacaagatgggtgagtgaaaactcgcgttgggagaatgaatacagccacaatgggcgtgggacgaacctgcgagggggtcggttaaacgactaccttggaggggaaataaggtttccccgggatggttctgtccccccatcttgcgaagccggttcttcttccgctccccctcgggctgcggcgtcggcgcggccccctccgggcgcctgctgttgacacgcgcccgcccgccccctcggggaagagatggggaggaggaaccctcttgcttcctcttcccttcggcgtcgcagggcggcaagccccccgagcccccgtcacgaagcccggaagcacgaccccctcttggggtagattgttctcccntcaagctcccgccggcgccatcatggcctcgaggagcctgctcctctgaggccccgaccgccttcatgatggtcaggatggtggcgcgatctggatcgctgcagaggggnaggactccttgggggatgagcgatgcctccgcggagctgagattcagcacccgttggatcattaccttgaagtcttcagggacccagtcccatttgaccccccggtgggtcctcatacagtcctcggacccggtgtactcccaggcaccccgggcgcgccgctggagtggtgcgatccggcgacgaaggtagtccccgtacaccatggcccctgtgagcccctgggatcgcaggcccgccaggcggtcgaggacggcgtcgtagccatctcccagatctaccggcgcccgccagctggaggcctgcgccgggggctggttcggaagtcgaaggcgcgcttcgtcggcgaggggggtgtagaaccagtcgctcttccagtcatcccacttcttgtggagcacgcaaggaatgtagcggttcagcaccggcccccgcggctggaagtagcagccaccaaccaccgacggcggcgacaccggctgtacggtgaagaaccaccggaacaaccgaagggatgggcgcaccccgatgaacatctcgcacaagtgcgcgaagatggccaatgtcattaccgcgttgggggtgaggtgcgccatctgaagatcgtaaaactccagaacatccataaagaaagaagaaaatagcggaacaagccctgccattgcgaaaggaaggaagaaaacggtccgccccgggtagcgtggcgccgggcgtccctcgcccagcgtaactatctcctggccggtggcagattccggcaggaagcggcgcggcagcccggcctgcctctcgctcacgatgcgggaaagcggcagcacgctaccatcgagtggagcagagccccgtgccatgacgccggaagaagagatgtttgagagcgagcgcgtgtggcgagggtagggcacaggaaacaaggagttagggcgcaagcggcgaagacaaggggaataatggcgagaggaaggaagcaaatctcttcctcggtgtctttatacccttgccaacgctgtgcccggctcctcgcttctcgcgcccactatctcgctccctcgtttctcgcgcccacgcttccactaatcccattcgcccgcttgcggcgcatgaggtgaatatgcggctgtggcagtcgagatggaacatatcgtgcgcgcgttaattgcactcgccgaccgaagtgccatcaccatatctccaggcaaaacgaaccggctcgtcccgattcgtgtgctactcgagtaatgtggcagtcttgaagaggccgctcattattgacagtcgagttaccattgccgatgtgcgtgatttgcgaccgttgggtttctgcccaactgtagagaccagccccacttgtcaccaggcctaagtaagtggcgtcacgcccgaccgcttccctcgaggagggtgatcgccctggcataacgccgggggctactgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccgctcccgtttcggccccgagggccgaggcgccccgaccccttgtgggttttgcgccgcgtgtataggttaggtgagcacggcggggctcacctaaccgcatttattgagggttgaacgagcgcgtcacgccgcatgtaacgcaacgcatcgcgctcgaatatcccgtctgtgaccggacacagaccgg

SEQ ID NO: 19284 - DNA, 2460 bp, Oryza sativa
  unsure (1)..(2460): unsure at all n locations
aaaggcgagccaagttttagtgaaaagaggatgggtccccaccaaaaagagaaataggtagaagtggtgcatgtggtatccccttgagatataaaaggaggaccttgcccacttagggaggggatccggaccagaggaccaggggaggagagattggagactcccggaggatccaggagaagatcccacgagaggcaaaaaggaggaaaggggtttctagagtttgagctctctggttctccagctctttgtagcttcttcgtacacagatctaccagaacacaggagtagggtattacgcttctcagcggcccgaacctgtatacatcacccgtgtcttgtgtgtttccactttcgcgaacattccacagactaggagcttagaacctcacccagggcccccggccgaaccggcaaagggggacctgcgcggtctcccggtgaggagccccacgctccgtcacatgatgtcaataatatgaaatcgaaatgtttcttggttgtaatgaaagcgttcgaaagttcgagcttgttttcgaatcttatagagaatcatgcactcatgcttcgtatttggcagttggttatactcgctccttccgcttttgatgcataattcgactactgagaaaagttagttaattgctgtatcgaggaaaagaagcaagttagttttatagcaggtacaatagcatactataagagtaagtttaatagtatagtccactactagctccaattcatccatagccaatctaatagctcattcatacaatagttgcttactatactattaatatatgggcccagtcatacacacactcgtgtttggagtccgtgctgcagctggctacagatctgtagcccgctgctattctttttcattttttatctcataaaaatatgtttatagctaactaatgggatgctattggacctgctctaagccagctatagacatattttaaaaagataaaagaggatagagaagtgcagggggctacagaattatagtcagctggagtatagtaacaagaggcaatgngagtatgacacgcgggaccagatattaatagcgggggatatgtttctagttaactattggatgaattactattactcaatccttcccaaattgatcacatgtaaaagaatctaaaaattcttaaattgatcatcatataactgcatggacacggatttcagcagaatacagttaatacagcatggaagaatgtgtgcatgctatggtggaagtggcatgaggttttaatcgatgcatggtgggagaatgtgtgtatgttgtattgattgatgtgatttaaattatccttggttttggtgtataaaatcaatttgggaaggaaggagtagattgactatagatgatttagagctagtagttggctatactattaaacttgctcttagcagctccaattctatccttataaaaaaacttagaaataataggagtaatatactactggtatcatgaataaaagtacaattgacattcgacattcttaattccttcaattatttttttggtatctcaaacacatcttctctaacaaaagttcatttgcaaattttgatattctcaaacataccccaaaattttatcttagccaacggcagtcaagccgggtaaaactgttatttctcctccaaacaaaaccccctaattactcttgctccaaaacctccccttctcaagcgctctctcttaggttcgtcgtgtgtttcccttcaccctcccatggcgagcaacccaagcagctccgcggcgagggctgcgggctcccagggcggcggccatggtggcgcgcgcctcgaagacctagcactggacaaggtggcggaggcggccgacgcggtcgccgccgcgtcgagcgccggcgaggtcgtccgcgcgatccacgccgtcgccgccctcgtcttccccgtcgactccgctgccgtagccggtgaggctccgaatcctaatccgacatgctccctattcccatttatctcattcgccgtcacttggggtgtctgatggcctctcttgtaggtaccgtggacgaacccttcaggagccaggtgaagctctgtgctaattttaggccttttatttcgtccatctgagaaaaattactagtagttttatcatttgctatttttggttctggcataaacaatgatgtgtgatttctaataatcatggaaggggtctgtgataaaaaaaatggggaagtcttgagtttttgttttgacctgcaatcacaaaggactgtatgccgaaatggagcagtaattctgccacaaaaaatagaaatggagcattaagatatcatagtgaactattggttatgtggacaatgtttcagccgctgtaatgtcataattgtggtgcatatatttgaggaaattgatctctggaaggaattactccgaaactggattgataagatc

SEQ ID NO: 19285 - DNA, 1254 bp, Oryza sativa
gtgctcccggtccaccgtggaccgagaggctgacgcgtgggccccactcccgtggacccggtccgcgcgccctctctctcggctgacgcaataattcgatttttaaattaaaatttaaatgaagaaattcgcaaatatccatttaaagagcatataaacttcaaatggccataacttggccatttgaactcggaattggaccgttcaagtctctaatttttccttaagaagtgaagaacccatttttgtgctttgtttctgctgttatgtggaatttattagtgtttgtgtcgcgaccgggaaaattgccttttcccgaacgctagtgtattaatccccgtcccaggaaaagccggggtacaccacacaaacatggtataaaagacacatctttattatatcgataatatttacattattacaaaggcacttaaggcctgacaatcaaaaataaacagcagcggactagcgggcctacggctcaatcttcacaggcgctcaactggggtataagccaggactccacctaagacatcttctccaaagcttctcttactgaagaggggaaagattgagcaagaataagtacaaccacagtactcagcaagccacaccgggagatgcataattaatgcaagggagtacaaggggataataatataggggttaagttttgcagtaaacagcatttaaaagtcacttagttgccccaaagccattttataagacaatcctagagctacacagtattattaaacaaggccgtgaaccctcacgaacctgccttaacccaaggcctacgatgattcaaaccgaactggcaacccgaccctgggtcccaggtcgtcccaagccaacccaagccaaccattccacattttagttgatgagcaaattttaagaattgaaacactgacttgggtacattgctcggcttgcccataaccgagggcgcggctattcaaatagattatactctgatcagaggtgtacatctttacccacaagacacatcttcctcacgtgtaaccacgtgccacataccaccacggtatacagacggaagacgtgacatagtttccaacccattctagccataaacaagagtaccgacccaataccggctacgggcggaacaccccggacaggcaggcatgactgaccccctatcagcaaggcacccaaccctctggcatatgacatctcgactacccggccgcaactagggtaaccttcatttgccctggagaatgt

SEQ ID NO: 19286 - DNA, 557 bp, Oryza sativa
cacggatctgacgtaaccacttcaaggcaacatctggacaaccaaagtgtgagaatgggattataactgaaggaactttgcaactgacctaactgtgatgaacaatcaagaagttttgagtgtatagtaatcaaattgtagagatcgataaacaatacaaatgaagtatgacttgtatgactggcagataacattataagcaaacaggagagttgtacatgtaaagaatatcaatggtacaaagtatatatgcagtgatagattcaagagtaaacttacggccaagcaaaatcttagatatagtaggaaatgctggaccatggtaaaaagcatgcctccaagatccccgttcatcattgctgaggcttacgccattaattatctgaaagtacagaaaataattctccctgttacatcatggcctaaaaggatggaactccaattggctatttggctgaatcatattgaaggaagcatgtgtctttgaatatccatactaatttatctctcaagcatgaaacatgatcttctgtattctgaatgcattatcaaatgac

SEQ ID NO: 19287 - DNA, 200 bp, Oryza sativa
tctctttttctccatttcgccgagttcccccatgccctccaccgccctagcgccgtcggcctcctctccgccgccaccgacaccactccggttgccgctagccgccgtcccgagccgcgccgtcgacgccatctcgttcgccgtcatgcgggccgtccagtccacccctcctccgtcggaatacgccgccggaacccact

SEQ ID NO: 19288 - DNA, 540 bp, Oryza sativa
  unsure (1)..(540): unsure at all n locations
acagacgaaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataactagactgagccacaaactaagccttacccactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19289 - DNA, 465 bp, Oryza sativa
aggatgaagagttttgagaattaatccatttgattagggaattggtaacttatatcaattagtcctaattgatggatggttgatggttgtatagtggaggatggttcatggctagttgatgacaattagttgctctattcttctttctattccattggtaacttacatcaattactcctaattgattgttggttgatggttgtgtagtgcccatgtcgccccccagtgatacgagctttgtggggtcggcatcatcaatctgcacttttgttaccttgccgtgaggggtgggcttcggtgtgtgcttcagccactcatgcaggtcggtctcaacattgtgcactgctctgttgattatggctagatcgcgttttgaagcggccaaaggctgaagccccttgactactatcacccctgttgggcctggcatcttgagcttgaaataattgtggtgggaaatggctt

SEQ ID NO: 19290 - DNA, 954 bp, Oryza sativa
ggttttacttttcttgtcattaccttaaccaacccttgaagcaagggtcctagaaaaaaaaaattcagtatgactcagctttttggtcatctgtgtatgatgccatgggtcttacccatgttcctctagagaaagattatattcttcctttgttccatcttcttgttttctcgtccttcattattttcgataataatattgctaaaatcagcactattacttgcacatgaatactagtagctagctcatgtgtgtcctccgtaatatatattatctttgtttttacatgagtaaataattattattatttttgttgtatttatataaggtactcagtatcgtggaaaacggtcgtaccgatcgattaattggccgtatatacgttaacggtagtataacagttcgttaacgtgatacggtgtacatttatcgttcatgaatgttaaaactttgtttttaacgattagttggtccttttccatttaatcatccaaataatcgtttgtatattgtatttgatgataatttagcgtagtttttttacttaatttagattttttttgttttgtaacatatatttttatgttttacttatttaatgcaaccaattctaccaccatgtgatatataaatcttgtgttaaaagagttaatattttacttatctatttaattaaaaaaacaacatgaacatatttgatttatatagttgtacacatctaaatcgtatataatgttataaaatttgtacatatattcatgaatgttaaatttccgtataattccaattaattgtccgtattccgattaatcggtgaacgctaccttttccgtccgacaaccatattccgtcttacacaacactgaagttacttgactaggtttaagaactaaaaaagatattttttgctaaacataatctagaatgctatagattaataatattgaacaatat

SEQ ID NO: 19291 - DNA, 245 bp, Oryza sativa
tggtgtgaccaaccaaccgtgtaggcggaaacaccagtcggcagcggacgaggcagcctgcgatgaagacgtagacgcccaacaacggcagcataataggccagccgtgcaggcggaaacaccagtcggcggcgcgaagccagccggtcggtgaagacgtggacgcccatgagcggtggtgtgaccaaccaaccgtataggcgagtacaccagtcggcggtgacggaggcaagtcggcggtgaag

SEQ ID NO: 19292 - DNA, 488 bp, Oryza sativa
tctctctctccctcaagtatgctttacctccctcgcccgtttccccctctctctcccggaaaggtgggaccaaaggaaccacctgtcatcttcttccccaacaacctgtcatccccaacctccggccagctccaaccgttggccacgccgcccactccctccgccgatcccacgcctcccctcgtcccaaccggcgtggacccgagtccccttccacctcgcgaccacatcccgccccactccccctctctccccgggggaatagacgccacgccgagccgccacacccgccctttgctcagtatgttggatttgaaggaaatcaaacgggcgaggagaaaatagctgctgatggtaacgacgttgcggatgatcttggtcagatgttgcaggacgctagggaggcctgcgaaagtgaaaaggaggcccataaataggacaagatgttggaggaccacagaacttcgttgtacccaggttgcgagcag

SEQ ID NO: 19293 - DNA, 439 bp, Oryza sativa
tagtcataatatcttcaaatttttttcctaaatagtgaagataatcttgtgtaatgaaaagtctgctatgcaaattaacaaatcacgataatgcacatagacaacaggtagagaatctaattcagggaaaatatacacaacggctaattagagaacaaaaatatgatcaatcaatggtcgacatgtaaaagaattacagcagataacgctatgacaatgtgaaactctgttcttctcgtcatcctaattgcgtaccttccctgtgtgacttacaacaacccagtctcagctctgaatcaagttccttccctggagcatctcatgctctcatcaatcaacttgaatgtcttctttacaagtttctggtctagggccgttgttctgtagattttgaacacgtggtctacacagtcaggcctgctgctccggatgtacagct

SEQ ID NO: 19294 - DNA, 1153 bp, Oryza sativa
agatcacaacatatgctacaacttctgtaaatacaagattctcggattccatcattaagatcctctaaaatccctctgaacctcgactacagataaatgcatcgacattcagacagccaacttcagaaattgatacctcctaaaccacttgatataaaatcattccatttggtcagaagatagatatacacgttatctacaacttttgtatagagactttttgcaggaaatcccattatgttggccgaaaaggcatccaaaacagaactgcgcagggggcatatcagcaaaaacctggctgaggaataaatcggtggatcccaaacttactcgcttccaacacttgatctaaaccctaatagaaaaccaaaacaggggaaaaagatcatgtattggtacctaggcctccatgggcagcggtaatcaaacccctcatttccatcttcacattgattccctccgcttccttctttccctttgttctccttcccttcttcttcttccaaggtctgcaatagggaaggcatggggaaggtcgaccagagggggaggtgggcgcccccagggtaccaaatgatggctagggggaggtgggggggggacctcctagggttttggggatgtggagggggcagctgggccttgggctggccgaaagctcgcccagctagcatataactattgtttttcttctaatttcaaacaccaaaaccttagggacttccaatatatcctctacgatattctattttttctagggcattacaaatggacagctatacacactatgcaagcgatggttgaaccaatggagtagttggattgtgccgaggcctcatgcatggttgacacggttcctaagttagtggaactgttgttcctctgaggcggtgatatcagttatgaagtggtcaacccaagtcaaagcctcctgtggcgacatcctgaagctttgtcaatccaaagttgtcgaaatatccctcatcggaaaatccgtctcttgaagccatctctcaacgaatcctctgaataccggtgctcccctacctagcatgccattgttgatgggttataccctaatcccaagatccgtgcctatatggtatgttttgagggtgtagggatcagctgatatgaagatgcaaaaaaactt

SEQ ID NO: 19295 - DNA, 10164 bp, Oryza sativa
ttcacaatagcctagctctcacgtagcctagctcctatatgtagtggtcaatgtatgcataacactccgtttgtacttttatccttgttcgtgtaaaatgttcaacacagggttccatgtttggagtgtcgaaggtttataagctaaccactatcaacctaaactaaagcatcaacaacaatcatatctgggtcacataggtctcaactacatagggccgccccttgggaggcgcgaccagagcgcttgcacagggccccctaggcccaaaactccaacactagatataaagtttaacaagtaaattggtaacccaattagtcctgaaaatctgctatttttttgttcacatcgttttgcgttcgatcgcatgttcgtgccgctttggcctttgggctatggcctcgccaatcaccaagaggagtaaacgatgcctcgtctctctccccttgctctcgtgcggtcgtgccgcttgacgctgtcgctgcctatgacttgactcctgagtcccagatgcctgtcggtaccacgcccctaacgtgatgccacgaccgcttgaatgcctgagcggctgactggctgagctcctgcttcctgtctgctaggtgcttgcctggtgtctggtgaacaagtgccaccctaattcctacttcctgggaatttctaatgtggtaatccctaattttggtgtatcgattattaagtatttagattcatctactatatacacaaaatcaatttttgttcttacatcctgtattttaattttgaagcatgtcttcaataaatcggaataggaaatatgtcgcttttcaagtgaatattatgcaaaattttagaccattttacattgctatgaaatatattacagagaataaattattgtcatataatatcattaattaagtttttatcattcattacgactttgcacaggccccccaaatttgacgggacagccctgcaactacacacatactataggctgctaatgggataaggaaacacgtttgaggtaacacgaaggaaatcatcactgaaactaggaaaaataatcggcaaccgatggcaggccaagcttgatgctctagaatagagggaacacattctgtgcacaaaagcttcgcatgcacacaattaacacacttatgtgtaagtcttaatctcaaattcattatattttggctctaacagaaaattctgatagttttaagagtgttaatctatcataattttatcttttatgcagccattagtgagtaagtatagattctttgtttgttgaacttatctttgtctgctttctttttcttataatatttctattcatttcagctatgatatttgagaagaaaatacaaaaggtaaaggctgccctttatacccatacagagtttaaaaggattgttaagaaatttgaagagctgtacatccggagcagcaggcctgactgtgtagaccacgtgttcaaaatctacagaacaacggccctagaccagaaacttgtaaagaagacattcaagttgattgatgagagcatgagatgctccagggaaggaacttgattcagagctgagactgggttgttgtaagtcacacagggaaggtacgcaattaggatgacgagaagaacagagtttcacattgtcatagcgttatctgctgtaattcttttacatgtcgaccattgattgatcatatttttgttctctaattagccgttgtgtatattttccctgaattagattctctacctgttgtctatgtgcattatcgtgatttgttaatttgcatagcagacttttcattacacaagattatcttcactatttaggaaaaaaatttgaagatattatgactagaaggtggatgcacggtggtgtgaattgtgatggcacatatatagctatgaatcccattgtttcacatacaaatacatatgttattatagtttgcagagtacaccattagctgtagctacctggtccaccatagtaaacatgcataccattgggattatgtccataatattcataggtatatttccttcgattagtagatcctggatcggctttaactgggtttggaataacacgcatgttgtcgtcgttcacgacctgaatatctctaacaaaagctgctttgccatacccttcagaagcaaaatgtccactgcccatttgtggagagtcttctgaggctgttggaccctgaacatatccaccccacaatgctttactggccatttccttcatgtaactaaattgagaacttggccaatatcctattgctgttttctcctcaccatacaccaaccaccaattttcagtctttgggtcctaaaattcatcaagattaaattgtcaagtaaatgcttcttcaaaatcatctaaaaaatgattgttcaaaagactgcaagggcaatatgctattgaatgcacaaggcatggtacttatttccttattgtattctaggggtcttaataaacgtttgttgctataagtctataacatcatttcgtacagtgaggcattcaaagtgaaatgctattgttggaagtccatggaatgcctattatgatttaagatattgttgtaatggtgtgtgctaacaggtaatttaaatctaagcaatgcactgacacatcatatgtgaacatagtatatagatatgacataataagcgaaataaattaatgttttattaattttatatatcttaggtaactcaattaacatcatagtgaaccacttaaattttttattctcataaagtaaataatcaaggcatattaaactgcatgtaggacagagaataccttaaatataagaaacttaattgcgtattgcggtccgttatatacagaaactggctgtattctgcctccaagaacaacagaactgctaacttggacgaaaccaggacacttatgattgttgcaagacttgttttgtacttcatcacgctgttaccaatttttttttctaaagtcagtacctaagcagtggaaatgtagctctatactatctcagcagtatagagactagaaaaaaaatatagtgtagaatccaatgtatttctagaaaaaatgtatacgtattacccatgaaatatgaaacctagcaaagctatcaccactgaagcttggtgagacccaagagccagcaccaattacatctgggccattttcaatttgtatccatgatccactaagatcccaatgatgcttcaccattggttcataaatgtttattgtggcctgtgttccatatatgtcgtcaaaatattttatccctgctacctacaaggaaaaaaatgaaaagacttttgtgaataataataacttacatacatatgcaaagttttacatcatattaatacatagaggactgttgccagtcaggataaagctaatataaattcattagtgttctgtagtataactttgaaatacttaggggatataatatatttaaagtcggtatttttgttgaaaaacattcacaaaggagttggttttttaaagaggatgtgaaactgcaacaatataatcttactaacaaatatttcaaagtaaggcgccatcatttcctactattggcaatttgattgggactttatatatttgaaattgtttgaatgtgatggcagaaattatatgtttttatctaccatgtaatatactcctatttcaataacatacatatttttaatacctatatatttatttataaattagaaggagtaaaatcagtgcaaagtaggagggagtatttagctattgtgtaactgttttagtcatttagtaacacatatttcatctaatggtgttgattgccttcatttattagcacttaaagatggagattcacctaactcttttgtatagttgttacatcaaccaatggtaatatagtggttttgtgagtctattgtgagagctggacataagaacaactccatacaaaaacaatatgttatcacaatcaactcatgagaattgaaacatctaaaaatattttaaaaattcttacctcttgttgttgactggtgacaattgcgtcagtattcttagttgaaatattttcttgtctattgttgcatagtattgggatggttcctgtggggcattcagcagtgggtagttgtgcttctgagatgggatacataaatggattttcgacatcaatccccaccggaaatgagtttggtttcaactaaatgacaagcaaaacatggtcattttataaacaatgagtttatatctcactataaagaaattctctaaacatgattaggtttctacaacattcttttatgatggagcaaatatacacataaaaatagtgccaggtcaaagtgttataaacaaataaattaacgatattatcaaaaagaagccatattagtgaatattatagaccactcaccccctccctcccccccccccaaaagaaacaagaggaaagaatattacattccaaaaaaaaaactaagtggcaacacatttagacatgatgttaaatcttaggaggaaaaatgttggcttacctgaattttgtggtcttttaacaatggatggttaaaggctggttgcctatttatatcaatgcaatcatagacatcaccatcttcagcctaatttgacgtttcttttgcttgttaggtaaaaaaaagatgctaagtatacttaaaaggatccattttttcacatacctggatgattttattaacctcttgatttgtaagatcttgattagtacttctccttgggtttatatgttgaatttcttcccccctaatgattagaacaatacaaaatagaagaagagtgacgataatcacttgactttctttcattttgaaaatcttggaagattggtattgatacttggaaaagatatattatctgtagaactccaatggttactaaatagctgttagtctactaaaagaattaatatattcaatgcaatagatttgataatcttcttttaatgctttaagggaataaataaacaatatgagaagatcatacataaatgtagcattgaatgcataagatttgatatattggatatcatcaatacggcattaaattcattgttttaatgtttgaatgaattttcaagatatttgaagtggtcattgttaattccataagataccatcaattgaaattacatagagtacacgaataacaataggaaaaaaatacacttagatttgaatatatatgtgttgagggtagagaatgactctgatcttgatggggctaatcaatagtgcgtttgtaataccaaagcccgctaacaacttgtagtagtgttgtaggtgagagttgtgactgttggtatttcttaacgacattactagaaatataattcccagcaatggcgcagaaatacacttggtatattatggttacagagtttatccgcaagcgcatgaatatactattgtagcatttcactcgagagtattccaagggtatcatatttgtttaatcccgtgggaaaattataggagagagaaccgtactaatagtttatatgttacttgtaataatcatagactaagcaggggttaatataatccaaagggtacaatgacacacaaacataagtctactcattctcatattaaactatctaagctgagtggaaagaaaatagaaaagaatctattcctatacttctagtatacatactatacatacatcctcgttataagattaactagctaatacctctttccgatgccctcctggtactttgagaagccacccttgactgccgagttccttaccatagcccgtcatgaccatacaaccggggctaaatacggaggaataccctccccaggaaattaacttaggactatatacacgcgcggaggaatacccgaactgagttgtcaccatcagcggcccacctctcttccgcagcatataaccccaaataatgatacccaataatctagacaccacgcctaaactaccagatattactctaatatcatcgccatgacatagagtaattgcataagcaaacattatacccgtatctatgcatctcccagataagctagcagtataatcaatataactcgaatataaagtaaagttggcattcatatacgcggaaagtatttcaatacaagaattatataaagaagaatattctaaataaagtataagtcttacaaaagaagaaaggaatgctgctagagccatacccgaactcttccgaagacttccggactctgatttctattctattcctactccactagcttgagaatactaaactaagcttgagagaatatgagagagcttgcttgaagtgtgtggagaaagaggagatgaaggctttatatagcctcccaatgacgattgtgacggctggaatggtcagaaatatcctccaaccgtcattgggagctaatccacaccttccagtcacaaccctgcatccaacagtgccaggataggtttggccgaacccctggttcggccgacccatgggctgggccaaaccggcccaacttcggctggcggcctcctctattgctcctctctgcagacttgttcttggcccattcatgcataagtctgattctcaacatcgtccaattgattgatcgtttgatttgatgtcgatattcatccattttgtgttcattatctgtaagtggttagtaatcctaatactagtggaatattattattctaacacaaatatgcattgcaagtataactagttctcctttattttggtaatatggacggtcgaaactgatcgcaaacgatcgtcaacagtgacccatgtggatgtgattttaattggttctcacctcagaagtttaggtaggtgagtgttagcttatatcctattccactccaaccttaatacgttcgagttaattcattatattaagaaaggatagaaccacgagtgtgtatcagcccatggagggcatatgccacacgctaatattttttgaaattaaaaattaaaattcaatatattttagaaacatcaaaagtttaaaggaaaatctctaacaatagaactcgttcaagaaaagtttagatgtggcttggagtatttctagtagatctaaaaatacttgatcgtgttttaattgaattttcaaagaacgtaatttataaccacagtttatataaattgtggcttggagtatttctagatgctcatcggtggtttgttcttccgctctttcttacgtcctgctggcctactcatctggctgagcccatccagtgcatgctacctccggccagtgccctctctttgcttgtccaaaaccctacttgctgctaccaccatctcaaaaagacaaaaccgtaataatctcctctccttgttgttagagtttatgttggattattctcctttgttgctattagtccatgttagaaaaactgaaggaggtattgcccttaattaatattctgatcaaatcattctaatcgatctgtatcttgttactgctctgatcaactttgttgccactaagtttagttctgctctcatcatttttaaatatatgatgctgccgacttttggacatagatgtttttctagtatcttgcaagatgctaccgctatttacagttgcgagacacattcactactttgaagtatatatttataattatgtgatgcatttgctacttcctaccaacacatttacctagggatacttagcgctttcaaatgaaattgatacatcagcaatttcattagagttctgtactataaaaatagatgccatttagattctcttttggcatgagattttgtcatgcatatgaaaaatatatgcttctagcatgccttgtcttgggttcctttcaaacacatgtagatggatcccctacctttttcgccgatagaaaaactaatttcttccattaagtactctcaaagctgtgtaatcactgcatctcatgtaatggtggagattgttggaaaaccgctggcccaagaaggcttggcccaggtgaccaactaatggcccactcactaaatatgaaaagcatatattgctatgcctataaataaagaggagaaggagctattgtacactagcgaatgagaagagaatgaatgaaataatgcctcaccttcacatcttgtgtctctacttttgtaaacattatgcaatcatcactcttagactattctatagcaggagggggttgcataatagagatctaatcccattcctccaagagacattgtgatattaacacatcacatccatcagttcatgtctattaaccggtgtgtacgtagtacttttgcaaatgaaggagcaccacaattggcaagagatgataaaacagtgtgtgtgtatatattctcaataaaaaattggacaagatagctcaaaacatgtatttggaacaaaaacaggcgaacaggcatacaccgtgcccacatgaatatgtatctacaacccgtttttgtaactgcgtgcatgtgatgatgtcgtataatttattttcggataaatttatacatgaaagtttatatatacaccgaaagttttatacatcaaaaatgtatatccaaaactaatgcccagaagtttgtatatattaaatatagacggaagtttatacattgaaattcctcgtgaggcacatctgggatttgttcgtattgatgaggacatcctagctcggatatgaccatggctaccttatgtattcatcaaccaaagtgcatgttttctatgtaagatttatgtgttatatatttgaacaaacaatattgtaatatcagtgtattcttgtttgcagaggttcttgcttgggtaaagggaaagcgatcgagcgaaaggaatacagggataatcaaaaaagttgattggggaccaaaccaatatcctccctcaagtcaactcctatatcatcacgtcacttttggtccatagaagacgagagatgaacttctgcacattttggattcggattaggattcgggcctcttggaagaatcaacttcaaacagatctagccactgatttagaaggaatctcaggggctatgagtgcttcttgaaaattcctctttagttgtcaggaatctgcaaaacaagtcatgtacttcaatatgtccgagtctgatttaggcattggtcattgtatactttttctaggctaggtccaatgggtggatgctctagggctaaccctaggacgtccctaatcatatttattcaatagccgtcatagtttagagtcagattttatttagattatttttgttattacagtttcatcgttaattcagtttgtggaacccccaaccttgggatcttagaaattcgtctgtaaattgtgttgcaatctaccttattcttgtttgtgttctttgattgtatgcaacaattagccttctcgccgaggtcaaccgggtagagcatgattgataaccagagaagacgtggtgtggcaattatagggttcagatcatgttgatcggaagccgggtcatgtatgtcaagtttccaccaaattgagagttctcaatacctatcggaagatcgggcatcacgttgccatcacgtatgtgttgggtcccaatgctgagctgaccacggtcacaactgggcgcggatgcaggcttaggacatctagggcttgagcctaagcctacctccaaaatcttgtttaaattttgttaaattatcatgtactcaaattttataggaaaccaacacttcattatttgagatttaggccctgtctgtttcagcttaagattattataatctgattattgagccagattactgtaagctgaattataataagccgatatagaataagttgtgacctgtttgttttcttagattataagctgtttgttagctgttagccacccaataatcttaaaaagcacctttagagtggattactagattatagtaatctggcttatagattataataatctatcataataagctatatatatatatatatatatatatatgtttgtttcagcttatttctaataatccagattataataatcctaagctaaatcaaacatggccttacattagtcttgttttttgacggaagaaggtagagcgtgctctgttagatttaattgggtaattgat

SEQ ID NO: 19296 - DNA, 4403 bp, Oryza sativa
attactagattatagtaatcgggcttatagattataataatctatcataataggctatatatatatatatatatatatatatgtgtgttcaagcttatttctaataatccggattataataatgctaaggtaaatcaaacatggccttacattagtcttgttttttgacggaagagggtagagggtgctctgttagatttaatggggtaattgatccatttaaatcaattaaatcaaataaattccaaggctcattatactaggaattcatgggtatttattcttttatgggatatcaataggatgaagagttttgagaattaatccatttgattagggaattggtaacttatatcaattagtcctaattgatggatggttgatggttgtatagtggaggatggttcatggctagttgatgacaattagttgctctattcttctttctattccattggtaacttacatcaattactcctaattgattgttggttgatggttgtgtagtggaggatggttgatggctaattgatgagaattagttactctattcctcttcctattccatgactcttactcttcatattccattcctcttataaaatgagaatgaatttgatctccagcgagagaagtgagacacactttcatccattttccaacgttgttgctgctacggtaatcccatcccgacgagtgtgtgcacacgcgttgggagagtaggcctccgaaaccacgcgctgctgtgacatttgcacggacgggcgggcgatcaggtttttggggagcgcaaggcgcgactactcactgttcgtcaacatctacttcaccttcaccaatatgtcgaacaccggagacaacggcaacactggatacaaggagaaggaggctcccgtcaacaccaacggaggcaatactgcctcaaactccagcggaggaccattcttggggtataaccttcttacattatttcaattagaatttttactgttaatgttcatcgcaatgtcaacattgtgttattatgtgattgttgatgcttattctacattaagcatgctcatgttgattacattcaccactatcactggatcaaatcccattgtaaatatcatgtttattatcttgttattttggattaaaatatgccgaattatgaccaaatttccaacatgctccaccttatagtcatttcattaatagaaatgaggtttccagcttacaagttagaggttatagttaacctagaacagaaagaagaaagaagaaaaggaagaagagaagaaacaaaaataaaaagaaaagagaaggggtggtggatttacaaagatataaacaatggttcttatactaagagagcctggtacaccaggattgaattttctgccagtttgattcattggttctcatgctccaaagatcaagggtgtctgagacttgctgtgtgatgtgctgtaggttgtcaagctgaccttcaaacactctgttgttgcgggatttccatagcgtgtaggcgcaagcagcgaaccaaattggttctattccttttgaagaccgattgctgtctatgattgcttgaaggaaagccgagcttgattctgagttgttggccagctgcagtaagtttagtttttcccatagattattggcatttttgcatcttaggagtatgtgatcagctgattctagagccgggcaaagggagcagtggggatcttcattccattttttgctgaccatattggctttggtgtttagcctgtctctgaatgctagccaaaggaaaatcttacagtttgttgggatggtgtgaatccaaataaagtctgccggtttccataaggatccatggtatgtcagcatctgataggcattttttgttgagacctgcggtgcaggataaagaaattctcttgtgtctgcttcctctgggattgggttgacatgctgtaagatctgtaacagagtgtgcagttctgtttctgcttggtaggatagatttgggtggagctgtatttgccaggagctttgtctgaactgcgactgaactgtgcactctttatgtatagcaaaggagaataaaactgggtaagcaaactctagacgttgatggaaccaattatctttccaaaacaaagttgttttgccatttccgagcttgactcgtgttatcgagcagagagtctgaaaatgtgaaaggataagtttccaggtcggtgtatcgttgcttctgggatgcagctgtataatgtattgcagatatctctctcgaaaccatttagccattggatcccctgtgcctgagagcaccttgttttctagctttaaaattaatgctgtattgtgtgctcttaggtctttgaaacctagtcctccttgctgtttttgtaggactgtcttccaggctaccaggcagtgtcctcctctgacggttttttcccctttccaaaagaaagcacgccttattttgtcaattgcctcgatagatttttctggccagatgcagcaggacatgtagtaagttggaattgctgaggttactgcatttatcatagttagtcttcctccttttgaaagtggcatccaacctgcaaggtatttgtcaatctttgatatgacaggtaacagcatattgtgtgaaattttggtggttgacaggggcagtccaagatggtctggcattgtaggatttgtgtcactgcatctttgttttcttcattcaggtgtatggggacaagagtgctcttatgaaaatttatttgcagacctgaaaatcttgtaaaggagtccagaatttctttaagagctgtagcttggtctgcttcaccctttagtaggatcagggtgtcatctgcatattgcaaggtaggtggagcaccttcgatgtctagcgggtgttgtagggttcctgtgttaaaggcctgctgaatcatattttgaagcacgtcagtaaccaaaatgaagagatagggcaagagggggtccccttgtcggacccccccttttatactgtatttgatcacccttttgcccgttgatgactatctgagctttacctgtacagacgattgattttgtccaactaatccatttgtctgggaatcctcctactttaaggatccgaaacagggcttcccagcttacaatatcgaaagctttgtggaagtcaagtttgaggactaacatcggcttcctattcttgagggctgcttgtaccatttctgaggcaaggatgaagttttcaatgattgatctgtatctgatgaatcctgattgcattgggtcaatcgacctcattatttctcgctgcaatctttttttttaacgactcacacgagatggtgcgaagttctattgatagagtaggaacaaattacaagattacaaccctagagggtcataacacggaaaaaggaaaaaatatacaacccccacacaccgacagcgccaacacacacgaccaggaggaggctagcaccggaccggccgctgctgagcgtgaccggtcgccgctagatcaacaaaggaacaaagacgagatcgcactacgctaggggatgccaaaacgacgtctccaagaagaggagcaacggaaaaccgccgccgccgtccgttggggctcaaaggagccaagactgggctttcgcccggcaaccacccttgaggggtgagacagcatgacaacgccctcaggagggggaattaaccatcgttgtcggcccggccaaggctgggctgggttttcaccagccgttcaccacctgcgaatccacggctgacgcaccgatgctccaccaccactcatcctctgccgacatgtgggacccccgcaccggcgcctcccgtcgaccagcctttgtatgccgaagaccgtgccacacccaccagcagctcctccatgcaccagggtcgcctcctccaccgccggccgcgcctctcacgccaaatcggcctcctccaccggacgcacctctcgcgccaattcggcctccctccatcggccgtgcctctcgcgccaagccggcctccatatccgccgcccgcgcctctcgcgccgagccagccttcgctgccatcggctgcgcctctctgcaccaagccggtctccgtcccctccaccgtactctcccgcgccggcgaaatgcagccgtctgccatgccctcggctagcccaccgaggccaccatgccacctcccaccaccaccgcagccactgctgccaacgaccacctcgccgccggccagccgcagccccaatgacgaacctagttcgtccaaccattccttagggagggataatgattactggggtgaaaatgtaatttacttgtaaaatgaattgtatcgggttgtaaaccttgtattcttcgattattttttcgaagctaataaagaacgggctg

SEQ ID NO: 19297 - DNA, 1459 bp, Oryza sativa
  unsure (1)..(1459): unsure at all n locations
gaggccaccatgccacctcccaccaccaccgcagccactgctgccaacgaccacctcgccgccggccagccgcagccccatcgtcgtcgtccagccgctaccgcaaaataactgtcgccacgagctccgcgccactgcctctgccgcgagaaccccaaagccaccgcagccgacagccgccaatgctgtcgaccagccatcgtgctgccgccgccgaccaagttgctgctgccaccgtcgctatgaactccacgccgttgccaccgtcaccgttgccccgtgctcccgcgccattgccgccgccgatgtcgccgcgagctccgcagtgccgccaccaccgcgagcttgccccacaccggatccgccctcgggggggccagatccgcctctgcccgccatcgtcatcctcagcggtgcccgggaagcggcctcccatccatcgcctcgcttcaaccgccgcctaccgacgcgctcgaccacgccgcccgcgcccggcctcacctgcggccagctgcgccgcccgcgcaaccgtcgccgcgaccgcctcttccccgccaccagcacgcccgcttctccgccgcacgccgtcgcccggcgtcagccccgccagttccggccaaaacggcgcggatctgagcgggtttccaccgccgccagccctgtccgccgccaccacacaccgccaccactccggcccgccgccaactgcctccccgccgttggcatagtatccgggcgggcgcggatccggatggttgccaccgtcgccgcccggctagtaacccgggccacccaagtgctgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaataagataaacggcgcagacgactccactccacaggcagcttgaccagggctacacctaatcctccacagccgccaatgctgtcgaccagccatcgtgctgccgccgccgaccaagttgctgctgccaccgtcgctatgaactccacgccggtgccaccgtcaccgtttgcccgtgctcccgcgccattgccgccggcgatgtcgccgcgagctccgcagtgcccgcaccaccgcgagcttgccccacaccggattccgccttcggggggccagatcccgctttgccngccatcggcatnctcagcggtgcccnggaaagcggnctcccatccaatcgctcgtttaaaccgccgctaccgacgcgcttgaccacgccgnccgcgcccggncttacctgcggncagttgcgcccgccgcgcaaccgtngncgngacccgcttttncccgccaccagcacgcccgctt

SEQ ID NO: 19298 - DNA, 5877 bp, Oryza sativa
tgtcattacagaggtagatagttcctctcaatcaataaagatctaagcagcggaaaaataagataaacggcgcagacgactccactccacaggcagcttgaccagggctatacctaatcctccacaccatcagcatcactgtagaactcctcctctgatgaatgattgcaaggtgagtatatgacatactcagcaagccacgcagcaaatatgcaagtgcacagggtaacaaaggatggcatagtagggtttcatttgcataaacaacatttaataaacatttcagaatttaataaaatagttaagtagtaatttaagcaatattaatccaacgctatacaacataccctgttgcataggcccaaccattctgtacaaccaatcctggctgcacagttctatctccaaaccaggaatataccattccaaaccaggagctaatcaaattattaccagttatagcatcttttattatggtgagaagtgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagtgcaccattcctagatcataatcacccccttataaacaaggcatggactccccagcgacccccgtgggattatctccaccacttctcagtctggtgctccgcaatgaaccatgctatacaaaaggtaaagccgttgcccacgctggcttgtggttggcacggttaatgtttcacaactgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaagaacaaaaggggtataacaaacaataggttaattccacccaatgacattcgaaaataaatgcaatagttgaatagaaacaatagctttaaacgggatcaacatgctcaaagggttgtttgggatctgtgtgactttccttgctgcccttggaactcttcaaattcttctcctgcgaaaacgaactcttcggaaatgtcggaatctaaacagaaaagagcaaaaacaccaaaacagcacataaacaagcatgaacaatacatgtggatatttttaacatgtagatctcaattttagaaaaatttagagacttgaaccaactaaatccgagctaagatgaattagttatgaatttttaaagattaaatcagattaaaacacttatatgggttttaattgaattatggcgcaataatgaattatttttgaaaaggaaaaaggggtttattgcgtcagcggctagggtttgcggtggaccgggtgcacggcggcggctcacggaaacgaacggccgagatcgatcctaaccaaaacgaacggccgagatcgaccggtccacggccggaccacgacggacggcaacgatgacgtcagcggtgacgtcaccaccggcggcggctcgggcgcacaagctcgccggcgaacgacggcgcgacgacgcgaacggagggcaccagcacgtagagaacgacgcggcgaactcaccggtgaccaaaacggcggcggaagatcaacagacggcgacggcgtcgaggaagaagcggcggcaaacttcggcttgacgacgacggcggtgctccggcggtatacagcaatgatggaggggcggacgaggacgacaacgcgacggcgaccacgacggcggccttcccgagcaacggcgacgactggagcgatggcggcgcacggctggagcagcggcaacgacggcggcgcgaggctacacggtgctagggttctaccggcgacgagagacgaaggcgagggtggcggcaggtagcggcgggcttgggggtccttttataggggcaaggaggcggcggcgaaggcccacggcgaccggcgacggcgaaggaaggtctagggttcggggagagagacgaatccgattcgagatcgaatccacggatttccaaacgattttagccgacgattccaaaagagaaaaggtagaagagatcccgaagatcatttcccctctattgatttcaccggaaaaggaaaggggcagccgaatttggaaagagacaacggcggcgcggcgctagggttcgggcggcggccggccggaggtagacgacaggcctgacaggtgggccccacttgtcagcggcagcgagcgcgcgcggcggctcggcttgactgggccggcttgggccaaggaggagagagagagagttttgggctgactttcggcccaaagccaaaagaagactttaaaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaactagatcttcttttctaggcttttaaaataaattctaataattccaattaaataacaatttatatatatttaggatttttagggtgtgacaaacctaccccccttaaacagaatctcgtcgtcgagattcgaaagaactggcgaacagatgcggatgagctgacttcaattcatcttctcgttccgaagttgattcttcttccgagtgattactccactaaactttgcaaaaacggataactcgatttctggttcttctctcatctatttccaagatacggattggtttctcaacataggtcagatcctcttggacttctatctattcaagattagcttcttcggtaggtacccttaaacactttttcaattgcgacacatggaacacattatggactcctgccaaagattgaggtaactccaactgataagcaacctctcctcttctactgacaatcttataaggtcccacaaaacgcggtgccaatttttctttggtgtgaaaacgatgaactcctcgaagaggcgtgacacgaaggtacacataatctccttcgtcaaaacttagatctctacgacgattgtcggcataactcttatgacgagactgggccacacgcaatctttcttgaatgattttcaccttttcttctgcttccctcaggatatccgtcccgaaaacctgacgttttcccgtttgatcccacaaaagcggagtgcggcacttccgaccatacagtgcttcgtaaggagccatctgaagactagcttgataactgttgttgtacgagaattccgcataaggtagattcttatccaacttccaccgaagtctaaagcacaagctctcaacatgtcttccaaaatctgatttaccctttcggtttgtccgtctgtctgcggatgataagcagtactaaagttcagcttagaacccatccgcgcggatccggatggttgccaccgtcgccgcccggctagctccccgggccacccaagtgcgcactgggcgaagccccactgccgccgtccccgcgggcgcgcggctttgccggcggccgctcaggcggcggtgaggcagaaaaggaggggaggaggaggaagaagacggcggcggcatcgcttctcgtgtcgcccgtggggagggtgacgcgagagctttttttctctctgcaatctgattgttagggctttgctcaggagttttggtacactgtacaatagcgagatgggtctgaaatctttgatatgaactggcgttgctgtttttggcagcagggtgatgtaggattggttaactccagacagatcaatattatattctcatcgaaaaggttactttagtcttgtaattagaagtttctcacttcgccattggtcattggtcacgaccttccaatatcactttgcactatgttttaactttgtgctttgttcgatcttaacgctaatatatttaatcgctccgtccgggatatttcggctaatatatataatccctccgtcagttgtgaacttgtgtttgtatagtactggatttaattaaaccccggcatagtatgtatcattaaaaaaaaatttctcaacaattaaatagacggcatctattcaggaagattagatcgccaaatgagtgtggccactgacacttaaatgcgcacgagtcgatctgattagtgggtccccgtccagtccagctcttgtcgtttcggtcagcattacaggaatgggcaagtacgtttattttgattactagaaaaaaaatacccgtacattgccacgagtaaatacgtttttcctagtaatattgggagccaagaaatcacttgaaatattatggttgctatacactataattgaaaaggttaatcaaaatattttcttggttttgagccgaaagcccattatttttttttatttttagcccctgcacaatccgttgtctcctaggtcctacctttctcctctcgaccttcctctcttcggcttagctagcacagtcggttgccccacacgtttcagtaggttcttcaacctccggaagataatcccgtgtgcccgtacgatatcgaagctgatgctccccatcaaatttagcgaatctttctcgatcacctaaaattggttaaggacttttgatccactcgatgtcctctttccgtttctctcgaaattggagcgaatccgtaaaactcaggataaaaaggaacgggaagctcgccgtctggtcatcatttctaccattcaatagagattaaatccgatgaattaaaaccgaattgaaaaggaaaatcatgggaaaatgacgacggaggagtgagaaatcgatttttgtaatcaattagaggaggaaacgcacggggaggcagatcaatatggcggcggataaagattaaatccgaagaattaaagtcaaattaaaagggaaaatcatggggaaaataatgagggagaagtgtggaatcgatttttgcaatcaattagaaaagaaaacgcacaaagagacaaatagatatggcggtggcggcagacacttaaggctcgtgtgaccggacgtcgtacggatgatgtaaaaaatatacggaatccttccgtatttttttatcaggctagaaaaatgcccgtgcgttgtaagggtaaaaataaattacaataaacatcagatttgcagtgttcaagttttgtcatgatttaaacacatatcctttttacgtggagttaccaattaacctatttagaatagtataaatcggcaccaaattagcatgacttctgcttggtattttcactaagctaatacataatgcacgctttaactgtgagatatataaattttttaaataagacgtacggtcaaaagttgtacacgaaaatccgcaactgcacttaaaatgagacggatggagtatattggaagctttgatgtcacgtgttaaaatgtgtaattctaacagcaagcaaacatcatgaacttcagcaaagcatggttgcaacagctagcaaaacttctatcgtttattgttcatcttaactattatggttcaaccaattggttgagtcaagccatatgtaaacagtaccatcgagttcaacattcacatacttggttccatcg

SEQ ID NO: 19299 - DNA, 2493 bp, Oryza sativa
  unsure (1)..(2493): unsure at all n locations
atatgatgatggaacgacgagacgttcctaagcaagatgtgctcccgaattatgcgtgctcgatggtcttatcagttctcgaagaaaatgcttgtactggctggaacgcctgcccaaacctgactgagaccataaagaccgtaggcatggaaccgatgattctgatctagatacgtatggaaactggggagcaccacgtgttcccggacatggcgattccatttttggtactgttggaagaagaggatgtgtggtttctaccgatgactgacgaagacgcccaagggggcatacagctataccggaggagagcagcggcaactctgcggcgcgaagtcgccactggtggagaaaccatctttcgtcggtcggccgatttccacaatagtcccggatgcaataaaaaccggggctaaagatgatctttagtcccggttcaaaagggaaacgggcatatttgatctttagtcccggtttgtgtcccaaaccgggtttaaagatcatgcttagtccgccttcgaatgctgtcagcacctgtcaggccccgccgggatctttagtcccggttggtagcaccaaccgggactaaagatcttaactttagtcccggttggtaataccaaccgggactaatgatcccggcgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgtctaaaaggtttgcaatttcatcctccaatgttttttttgtcatactacatttgcacctatgttttgcacacctttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgacacatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggagaaaatagctgctgatggtaacgacgttgcggatgatcttggtcagatgttgcaggacgctagggaggactgcgaaagtaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcattaagaacattcttnncgngggaaacaaaattgccgagacaacgtacgangctaagaagatagtctgccccgtaggacttggaagtcgtaagattcacgcatgtcccgacgattgtatcctatatcgcggtgaggagtatgagaacctagaagcatgccctgtttgcaaagcactacgatacaagattagacggaccgatccaggagaagttgacgggcagctaacaaaaaagagaattcctgctaaggtgatgtggtattttcctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaaca

SEQ ID NO: 19300 - DNA, 1622 bp, Oryza sativa
aaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgcaaggaacatcggtaagtccgatgcatggattacacggcatcacattgatactttccccgcgtggctacgacaacatctcatgggtaacgagtcgatcaaccaagaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtcctttccaatgatgtaacgcaagtctttttcgtgaaggacatgtctagcaaaggaaagaagggcagagggtgtcgcgtcccaaaacgactctaaaattcatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaaatttagtggaattttcagagcacaaataataattattaagaaataaacaaagttaaaaaggttttataaaaagaaaaaccctaaaaagtcctttttccccttcccctcttgggccggctcggcccacctccctccctctctctctcttccccgtggcccaatgcgctcctccccgcgcgcgtgccgcagacgggcgggcccgcccgccaccctcgctgacgggtggggcccacccgtcatcccctacctcg

SEQ ID NO: 19301 - DNA, 3193 bp, Oryza sativa
gggcgcgggcgcgtcgcctcccgtcggctgtgccggtgaggcgcttcgggcgcgccccgcggctgccatgtggggcccgggcgtcagtcgcctgcgccctcgggtgcggctgacgcgtgggacccacggcgccggccggcgtaagccgcgtgcacccggtccaccgtggaccgagaggctgccgcgtgggccccactcccgtggacccggtccgcgcgctcctctctcccggctgacgcaataaatatgtttttaaattaaaaatttaaatgaagaaattcgtaaatatccatttaaagagcatataaagttcaaatggccatatcttggccatttgaactcggaattggaccgttcaagtctctaatttttccttaagaagccaagaacccatttttgtgctttgtttctgcttgttatatggagtttagtagagtaaaagccgtttcttttccattggtcgtgtagacgctgcagcttcggaagatccgctcttcgtggaggttgaagccggcatttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattattgttgttattgttactatttccttgttcaccctagaataaacaaaaccctaactagtggacactctactcatggtatcactagtatgattttaggtagatgcttcgctgtttaattaggtaacattaggtggttttacaactctagactttgggaatattcatatcacctggacactatggaatggtttggttattgtggaattggcttcacaccgctccttctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacctagggtcgggttgccagttcggtctgaatcatcgtaggacttgggttaaggcaggttcgtatgggttcacggccttgataaataatattgtatagtactagaatcgtgtttgcaaaatagccctgagcaactaatgtctttaaatgctgtttactgcaaccctaaccctttatagtataactcatttgtactcccttgcatttattctgcacttgtgggtgtgtcttgttgagtacggtgggtgtactcagtcttgctcatttttcccaaacccagaagaggagttcctggaggatgaaggctttggtgtctagctcgtgcctgccgtcaagtgcctgtggtcgtcgccctagtcttccgctatttctcgtttgtctttgtgtgtgctgggccttcgttgcccatgtaataaattatctatttacgcttccgcttgttaaactctgaattgtatcaacttttggtgtaccttgcctcctgggacaaggattaatgcacgcacgtaaggaacgcccgttgggttatttccggtcgtgacagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtatgtgccgtaattattgtgtacatgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttaaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagccaaaaataatttttcgaagtaattgtcattaatctttgtactataaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgaaactaaagat

SEQ ID NO: 19302 - DNA, 916 bp, Oryza sativa
tgtatatatatatatatatatatatatatgttacttcgcatttatcctaatacatattttttatcttgtagaaaagacgtgctgtaggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttcttatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatactgaggggaaccagcaagggcacgtggaaagggatgtggaggg

SEQ ID NO: 19303 - DNA, 3216 bp, Oryza sativa
cgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtatagaagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatgcacgccatgcaatcacaggacgaatcgacctgtcccgttgatgacatcactcagcggacaccatgtgagctgcatattccttttcaagaacttatcaataaaggtaagatttagccattccgctagttgctgcttatatatgttgattactaataaataatctctcacaacatgaaggtggcgtcgggcatggccatcccaacggacccttcaggaacttaccactgcaggccaattccagcaagatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggttcggccatctcctcttcaggatcatgcacagtctcctcctcatgctccgcaagcacggtctccacctcaggctccagcatcgactcctcctcaggatcgtgcaccgactcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagacccaagtgtcaggaacttctttaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagatttaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccacttggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattaaatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatatctatatacatatgcatttgcataacatatatatgtataaatacatatatattatgcatgtatatacatataatataatataatatatatatatatatacatatatatatgtatgcatatatatgcattgaaacatatatatgcatgggttatatatatatatatatatatatatatatatataaaccatgccgcaacaggggcatgcaaaaaaaaaaaaaggtcagctcgatctttagtcccg

SEQ ID NO: 19304 - DNA, 5226 bp, Oryza sativa
gttattcacccgggactaaagatagcgatctttagtcccggattggtaccccggtttggaaaccgggactaaaggggggttacgaaccgggactacaaagggtttctccaccagtgcgcgcgaggcgagcgcaggcgggcagcgggtgtgtgcaaggcgaacacgcgtgtcagatgcaatcggacgcaattgagcccatgtgcgagccaggcggatgagacggaatcagcgaaaccataaaaaaacgcctagatttttaccggacaagaagacggacggatttttttacccgaagccttacttattttttaattaccagaacaaatgcccgtgcgttgcaacgggtaaaaacatttttggatcgctatatattttattttttggttttggaccaaaaactcatttcattccttccttgtcaagtggagctataggtcagctcgcatagcccactgtcgtttccaacctccgaaagacaatgtcatgtccgtacatgccaaaaccgatcctccccatcaaatcctccacatcaaatttagtcaaatctttctcgatcttccaaaattggttgagggtttttaatacactcgttcttctctttccgtttttattaaaatcggagcgacaaaacttgggataaaaatggtgatttttaaatggagattaaattcagtgaattaaagcggagttaaaatggaaaatcacgaggaaaatggtgagggagtagcggggaattgatttttagcaatcaattggatgagggaacgcatggggaggtagattgacatggcagtggcgctagtgtttggtcgcgcgacaaaaaaaatatggcacaaatccttaccgcgtgcggaaaaatgcaactaaaaaaacagcaatgaagaaaaaacatatgaaaaaaacccggaataaaggcaaaaaaaaagtaaaaagcagatcggttttttccccggtttttttctgtccgagtggtttttttagcacgccgtttttccctggtttttttccgtccgattttttattagtgggtcgtgattagtggttttttttgggtccggttttttcattgaatccacagagtcctatacggttacacaaagaaataaaaaaaaacagatggagaaaaaaaaggaaaaaataacgaaaaagaaaaaaaatgacggacgaattttttttttacggaaacattgcttactttttaattaggtatagatatactagaaaaaaaatacccgtgtgttgcaacgggtaaatactatgctagaatagggtaggatcgggtttatttctctttcttgccacgggaatgacacacgcgataacatgcacatgaatttttgagcaactatagacagaaaattttttgacgcacgtggcaaatattctaacgcaagcaaagccggacaaaaaaaaacaacaggaaaccttacgtattagatatataaattcgatcttatctttttgtgattaagaatttagattgtttatttatttttttaggaaaaaaaaggagaattgaaggtgccaagagggggccggggcttgcgctcgcgcttctgggaggggatttctcgcgggtaatgtcgaaacatgaattcggcaataataaaaggggtagcgcacgagacctaaaagtggatggatatggagacaaaggatttagacaggttcaggccctctcaatgagaggtaataccctactcctgtttggagatttgaatccgccgagtgtagtatagatctaacgatcatatgtgctcatgccccctagagggcctcctgcccaccttatataggatgagggcaggattacaagacagaaatcttaaccaatacggcaatattatcaaaccaggacttaaggccgttccgtaatatacagaaaacgtaatacccaagtcatgatctgttacatattccatagatataagttatcccctataactagtcggataaccatgccgtgtgggtatggggtacccataatctccacagtagcccctgagaccttcacagtcaaaaagataatcttctctcgaactagattactccaaagccgagtgcttcaatcatctttgccatggtctcccgagtacttttaccaaatctgaagactgtggagggctgaaaaataaagtcaggtgcatctagtctatgcacctaataggtgtagccctcgactatgtggttaattgaacaaaccaagcatatagtgaaggaataaataatccaaccaaccgagtggtttcgataattgtagtcaaccaagcgacttgatattaatatgtagcatatgcggtgtgaatccctaaataatataaaccaagtgatataccgactgctttaacatgatgcgtacaacctaaagttgactacatcattgaaaatttacatagcaaaaatagctataaagaaccttgtatgctgtgaataaagaatttccaaagtattgggcatatgccatgcgcacactgctttaacagatgtgcttaagtccctaaaagacacatggtttcaccacacccagaaatatatggcatatgtggtgtaaaatccgagtaaataaactcatgaggatttaccaaccgtctggaaaatgaccaaaatatataatcagcctaagccataatattggtcaataaaaatgcacatttacgtggcaaaaagcaatgatattgtatccaatcaattgcttgataaacccaaacagcgccatgactatataaaaaagtcagcggggcagctatataaagctttattgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgataggccacacctgaaaatataggctgcagacatattaggcctaggccaaaaaatatgccttcgacacactttaaaggatgacgcatgtaacatgctcccaagtaataaatctttcgggtgatatagaccaagtatagctcatatgaatagcttctgatctgagtgattatcccttatgggatactccaaaatagatataacaattgaatcccgattggcgcaagtattcagttgataacccttacggggaataataaatagtctagtcattgagcatagaaaatagacccatggtcatgagttgatgttgcatgtatccagaacaagtccaaattgaaggtatgatacttgtgtttgagctagtaagcccctgagcatatagcttgtccttctgtcgtaatcacaattgtccattgatggtagctgacgcagttggcatagagacaagacgaccaatatagagataatattgcctaccagaggtggcaaaaatattggtggtagtgaagataatgataccaatcaaaagtgatgaatttgcacacccgtggaagcgaagaaaccagtcggtagcagtcaggtcagccagcaatgaatatgaaggcgcccagcgataaagttgtgtagccatggcagcgaaataatcagtcgatgacagacgaggcagctggtgaagaagatgaagatgcccattagtggcgacataataagccatccgtgaagacgaggataccaatcggtggtgacgaaagcaagccaacggtgaagatgtagacacgcatcaaaggcaatgacgaaatccaccaatcatgaagatgaagaaaatagtcggcgacgacaaacgcaaccaacatgatgaagatgacgatgtcagtgatccagtcaatagcagtgtagcaaccaatgataatgacgaagacgctcatcagcgtttgcatagtaggtcatccgtgaaggcgaaataacaagccggcaatgacggaagcaaccggaggcgaagacgtagtcatccattagcaacggcagagatgtcagggccgatgaagtagaggtgctggtgatgaagtcagtgacaataatccatcaaactgttgagaagatatcaaagcttaagtaattttcttgatgtgtgcataaggaagattgatgcaacaccaccttgtaaagatggtaatagaacttggagttgtagctattgcagatgcttcaattgaaggaaagtaaatgctgttgtccaactcatcaaaactgagctgattggttgataactctaaactctcggatatgtagatagaatctcaaacttgatacttgaaaattttggagtagattgtggcggcatgaagaagccaaaattgccggtgtaataattggagtcgctgaaattaaatgccggctctgaagcaaagataaatataataactccccgagttgactcgtttattgattgattgcttcatcttgacataaagcttgtcgaattttgagtcttgtatttgtgtagcccccgactctttggttagttgagaactgtagcttcttgtcatcgagtagccatcacttgagtgaatatatgcattgagtatgtctgagtagaaatattgaagattggaacaccatttgttgtagtaaaataacacggcattaaatctagtggtgcatgccgagatgtcgaggctcttgtatacatcgtggttggtgaagtagaaaaacttgcgaagtagcaacaattcggtttgctagtgcagaagacaatgaagatgaagttgctccaccatggtgacaaagttgcatagccgtgatgaagtgaatacgagtcggaggcaacagaagcaaaccggtggcgaagacgcatagtcgtgaagatagaaacaccagtcggcgatggcaaaaaccagacggtgaaaacaaaggcatccatcagcgatatcataataggccagccatcaagacggagacaccaatcatcggcggcgaaggcaagctggtgataatgatgatgcccatcaatagtaacgaagacgcgtagccgtggaggcgacaaaccagtcggcgtcagatagggcggccaacaatgaagacgatggcgtccatcagtagttgtagcggtataaaccagctgtagaggcaagggcactagtcagcagcagacgagacgaccggtggtggagacgataaggccaatcaacactggaagaatcatgcagccatggaacgtgaagaaaccagtcggcagcagacgtagacagcttattagcggtggcggcgacgtggccagccgtgaagccgatagcatcagttggcgtcatacgaggcagccggtca

SEQ ID NO: 19305 - DNA, 6691 bp, Oryza sativa
gcataataggccagccgtgcaggcggagacaccagtcggcgacggacaaggcggccggtcggtgaagacgtagacgtccaacaacggcagcataatagaccaaccaaccatataggcgaaaacaccagtcggaggcggacgaggcggccggtcggtgaagacgtagacgcccaacaacggcggcataataggccagccgtgcaggcggagacacgagtcggcggcggacgaggaagccggtcggtgaagacaacgacgcccaacaatggtggtgtgaccacccaaccgtataggcgaggacaccagtcggcggcgacgacggcaagccggtgatgatgttctgactgatccattcctggagcgtaggagataagcttaaagccatgaatccctcttatgcatatctagatctggatcctgcagaacaaacatataggatgagtagtatctgatgtaaatacaatactcgaggaaaattcaagcattttaaaatgtttataaatatgtatttctcctcatcgattttgatttcctcgagcagatgactccttacgtttatacactctgccgactagtcattgcccccatgcatcgggagtcggccaaggcacttccctgacatgcaaatgggtgacatgagttcgtcattaatggaacaaagtttcacggatcagagtttactactcgggtacttttgcaattgttaagagaagaaaataaatttatcttatctctatgcttttgatttattctgaataatacttagcaccttgcgttactcggtccatccaacgagtccccgggtgctaggaatcggcccaaaggcaactatccatcgacaaaccaaacggaaagcataggaagatagaactccataactcgataggcacttttgtactcagattatatcgcaagcaatcaagataaatattataaaaaatgtttaaaaaatatgatataacatctgtagccccccgactcactagtcaacggcgaactagttgacatagtgaggcagaggaaaaggaaaatatcatataaacaatgaaataaatgatgacttagcttttagtattcccgttggtgacagcagaggtagccgatgtaggaacaaagtcatccatcaatggcaataaaagcaccaaccgtgtaagcagctgaggcgaccggcggtgtaggtaaataaatgcccatcaacggtggtgtggccaaccaaccatgcaagcgaagacaccaatcggcggcgacggaggcaggccggtggtgaggtcgtagacacccaacaacggcagcataataggccagccgtggaggcggggacaccagtcggcggctgcaaaggcaagtcggtcggtgaagtcatagacgcccaacaacggcggcataataggccagccgtgtaggcggagacaccagtcggcggcgacggaggcagaccagcggtgaagtcgtaaacgcccaacaatggcggcataataggccagccgtgtaggcagagacaccaatcggcggtggcaaaagcaagctggtcggtgaagacgtggacgcccatgagcggtggtgtgaccaaccaaccgtataggcgagtataccagtcgccggcgatggaggcaggccgacggtgaagttatagatgcccaacaatggcagcataataggccagccatgtaggcaaagacactagtcggcgccggcgaaggcaagccggtcggtgaagacgtagacgcccaacaacggtggtgtgaccaaccaaccgtgtaggcggaaacaccagtcggcggcggacgaggcggccggcgatgaagacgtagacacccaacaacggcagcataataggccagccgtgcaggcggaaacaccagtcggcggcggcgaaggccagccggtcggtgaagacgtggacgcccatgaacggtggtgtgaccaaccaaccgtataggcgagtacaccagtcggcggtgactgaggcaagtcggcggtgaagacgttgttgccattagcaacggcggtggtgaaggcaagccggtggagtagactcatggcctactaatcgcatagcgagacgcctcgagtccatgaccaacgcccatcgcctcaatagtgccatgtaattatatgcaaacaataacaaaaatagcaagagattaatctgaaattagaaatcaaactaataatatagaataataagttggaagagataaaactcgatgaattgacggcgccagttgtggccatgacgatatttgtcatgtgatcaccatccggtaaattgtaggcagctgcatcccatgtgtggccggtgatgaagacaacgccacccagcaatagtagcaggattgctttaccggcttgttggatcagaacgatatctcagggccatagccatctatccatggaagtacatgtaaatacgagtcaaatcagattagtaaacaaaagaagatgcatgcatacagctgcatacactcctatagattaattgactcatatgtgtcgatagctgcttattgaataattggattcaagcctttgaatgttggtagcagcctagctataaacgcagggctcctgattggttggcctattggctggcatgtatacttgcatatatggcggtgatcagtagatgcatgcgatcaccacggctgttccggagcccctgattacgtcgccacgaggggaagcgtgctagactggagtactttggcaatcaaagcagtcggccgggccaaaacatctgcagccaaccggcaaccgcacaccatgcctgttccgatgacaggggttccagcatgccgtgtatactcccaggtagctccatatgcgcctatcgacgatctcgtcgatagtagtactacaataataatagtacaccaggaaatcaatctatcatagacattgttaaaaaacactagatagattgaaacgacaaacccggttattctttgtagattaatttgatcagaagatgattccagcgattggagttgattccatcgcgctcgtcgacgaggtactcggcgcttcccctacttggcgcgccaactgtcgaaacatgaattcgccaataataaaaggggtagcgcacgagacctaaaagtggatggatgcggagacaaaggatttagacaggttcaggccctctcaatgagaggtaataccctactcctgtttggggatttgaatccgccgggtgtagtatagatctgacgatcatatgtgctcataccccctagagggcctcttgcccatcttatataggatgggggacaggattacaagatagaaaccttaaccaatacggtatcggtttcctaaatctactttacaatattatcaaaccaggacttcaggtcgttccgtaatatataaggaaacgtaatacccaagtcatgatctgttacatatttcatagatataagttatccactatgactagttggataaccatgccgtgtgggttacccataatctccacaggtaattaggagacgagggattaggaaattgacaccgagaaaaaaaggaaaaaaaaaagacctcaacgtaaaaaggaaaaaaaaaggaaaacaacgacagtaaaacaaagggacagaccaaaataatacccggaagccttaattacttgaatttaattttaattaaattcttcatgattaaccacactctctatattttatattaattttgcaaagatgaattgttaattttaataatacaaagataattttaataattaattttaaatacaaacaaactaaaaccctcttctaaaactgggccaaatctggcccattcttccctcctcctccctgagccgtgcttccactcctccatcttgggccaccatccctctctctgttcgggcccagcagccaccccacttcctctcctctctcttgggccaccatccaagtgtccgctcgggcccagcaaccgtcccagcccctgaaaagaatgcggaaaggaataaaaccgagaaaaagggccaaaaaaaagagaaaaggggcgaaaaaaaacggggacggacgaaaataaaatcagaagccttgcgtatttttttaattaggtatatatagatatagatatattaggtactccctccatactcataaaggaagtcgtttagaacaatgtttaagctaaaccttgagaatataaatcatgaataactctcaagttctttagtttgaaaatataaaaagtatatgaatagatttgtcttaaaaaatattttcataaaagtatacatatatcacttttcaatacatatttttatagaaaaaagaagtcaaagttgtgttttggagaccgtgtcgatgtcctaaacgacttcctttacgagatatagatatatagatatagatatagatatagatatagatatagatatatatatagatatagatatagattagaaaaaatgcccgtgcgttgcaacgggtgaagtatattttaatcttattattgttatagaaaaattgctcatgcattgtaacaggtaaaattatttttgtatcgttatatattttactctttggttttggaccaaaatctcatttcattcctcgtcaagtggagctgtaggtccggctcgcatagcctgtcctcttcaacttccgaaagacaatgtcgtgtctgtacatgctaaaaccgatccttccatcaaatccgatcgaatctttcttaatctttcaaaattggttgagggtttttgtcacgcctagaaattcccgaatagaattccaagcagaatgtgcattaaaacccccgtctaggaccggccggggtacacaaacgacaaagttgacatacagatccacgtcttacaaacatcataaaagtcttacataaatgcagcggaaaattaaaagataactggagctaagccttgacttggaccgtagcgggaacaccactccacaggcatcctcgacggcacagacgaagcccactcttcagaaaagccaccatctgacgcatactcaaactctggggttttggggaaaatagagcaagactgagtacaaccaccgtactcagcaagtcataccggaataggagtatgatgcaggatataatcaaaggatagctagagcggttcatttgcataaaacgagcatttataaacagtagttgaaagcagtaaaactgttataataattaatcaatattaaccatccactgtccaacgctacaccacgttgcaataggcccaaccacccacctgaactaatcaattccattagactagactagggtgagactaatcaaggtgaatctagttgaccgcccataaccgcgggcacggctattcgaatagttttactctgataagaggtgtacaactgtacccacaagacacagccccacgacacgttaccgtgcgccgacatgccaccacgacataccggaaagggaccgtgacaggacccttcgcataaccccctctagccaagcacaccacacctcagggcgatgggcagtcccctctcgtgcctaggtgaatccggaagcgacaaaggctgtcgcaaggcctgccccgctccatgacgcccacccttacctagatgcatcaactagaggaaagctacactacaagcccagccgttgcccacgctggcttatggtaagtacgataagttcttccaaggcatcccgtgaaccggtccttaagtgccatgggcgcgaccatcaaaaccatgcacccacagcccaccatatggtatattttaattgactaacaccaggacgatggccctaatccaacatcaacactagaacctgaagtctatgcattaatgtgattcacccattgtgtactagttgaactaagcatggctaagcaatccctagtccaatatctagtcatgttatatcccaagctaacaaaggagcatggtacaaaaatagcatggctgtaacagtaggtaaacatcccatagtaacattataaaataatcagtatttaagggaaacaataggacatttgcaatataggatcaacatgttcaagtgacaagcatgacttgccttgctctgctgctggaggaacctcagcgactgtttcaaagtacaccggagcgtcgggagagccggaatctaagcgacatacaaagcaaacaatacaaacatgccataagactactgaaacagggaacaaaaccatttttaatggattctttgcatttttcttgatttactgagacttgaatgggcttaaacggagctcgatgaattggatatgaattttagaagattcactgcgtttttcctataaacagaaaaaaatccttaattgatttattgtgaaataattaaaaccctggagagagagggggcggcgctgacatgcgggccctacacgacagtgactcgaggtggcggtccgtggtggaccgggtccacggaccgggaagaaggcggcgcaccacgtggcgccgacacggcagccacgcgggaggccaaacggacgaccccgggtagatcggacggcggtgggagcgcgcgaccgggcgcgcacgggcacggatcaagccgacccggcggccatggcgcgcggcggatctaccgcggggcggcgacggcaaacggtggcgaccgacggcgagtggcggtgcacggcgaccgacggcggcgcgaccccgagcggcaaggggcggcggcgctaggagggaaggggaaggatgat

SEQ ID NO: 19306 - DNA, 13813 bp, Oryza sativa
  unsure (1)..(13813): unsure at all n locations
attggttaaaattatttctagagctctgaaaattccactaaaaatcttgttagcatattttgacatgtagaactcaagaaaaatccccacatatgccatttcggattattattgccattaattcctttagggtttctctcttgcttttacaccgatattttctcaatgttatttataaattaaatttaggcttgggagaagaacttcagggtgtgacattttttgatacactcgatctcctctttccgtttttatgaaaaccggagcgataaaactcgggataaaaacggtgatttttaaatagagattaaattcagtgaattaaagcggagttaaaagggaaaaacagaaaatcaattggaggaggaacgcatgggaaggcagatcgacctagcgacgacgctagtgttcagtcgggcgataaaaaaacatggcacataaaaaaacaaatccttacctcgtgcgagaaaatacaactaaaaaacaacaacaaacatttgaaaaaacccagtaaaaaggcatagaaaaaaaagcgaaaaaagacagacggaaaaaactgggaaaaacgaaaaaataaaaagagtgaaaaggacggaaagaaagaaaaaaaatatacagataaaaaaagaaaaaagaatcggacagaaagaaggaaaagaaatggacggagaaaaaaaggaaaaccggaaaaaaaaaagaggaaaaaacggcgaaaaataaaaaaagacggacgaaatttttttttacggaaaccttgctttatttttaattaggtcggtacagagatgtataaaaaggactaatcaggcgccaagattgagaaaattaaggaagagagcaaaaagaaaaaaagtaactctggcaggtctcctagctagttaacttggaaattcatgagagaataccctcatttagaaatgtacaaattttatggaaattgatggagattaaacaagtcgctatagaatttataggagccatacttaattgtgaaattgagaatacttattctatttgtgggtgcctaaatttttcttacatactaccagctagctagatgaatttacaccatataaacttttacaaaaaaaaagaatataaatatagattttagtacgttttttatattttgatacgatcgcatattaatttacacatatatgtgtgtgtattattttctataatgacttaaagagacacaattcatttgatatttaacatagttcgttacattacaagaataaaaaggtaccatatgagttgctggatattgttcctatggactatggttaaaacaaattagatagatacatttatactaatataaaaaaatatttttatagttatgtagtaataactacacggttaatacacataaacaaccatttctactatttgattacaagagcatctccagcaggggccctaatcacaaagctcaaactgatcttagggctaaaaggaaaaaaaaaacaagctccaacggggccccaactatagggaacgcccccagattctcctccataggcctcgttcctaggggttctatccacagcccccatccaaattttttggcgtatccaaaattttttttgttcgtgcattcggcctctcctcccttccatggtcacgctacaacactacggactctattcctgtcggttgcgctcctgccgccggtctccctgaatcttgtgtgggtgggtcacaatcctcctcgatgtctcctgcaggttgtcttcctatggccctccgagctcatctgataactgactactcccaacagctacctatcagggttatcgatacggcatacctcttattcttggggttatgaaatatatgaacagggtatacccttaagtacacaggaaggttactttagttacaaggaattggaccaatgcataaggaaaccaactccccaaatagaaaggtgttagaatcctatttcagaggaggtgttagaaaccatctcgtatatgcaaagttctctccgagttctacttggaagccaagccggtttgaggtataagtatttggccccagagggtacgggatcatcgaatcataatattgctacctgccataacagaagcaacccggaggactcgaaaccaactcgtcgattgatctcgtcctcaacaaaggtgtaatcggtaactcgtcggttctgttgttatctattgtaatcttggttattctcttcataatcccatataaactggattatggctattaccttacgagggatctgaaccagtataaatcttgtcttctgtgcgtttgatgtcgtttcgtgtagatccttgcttcaacatacccccaataccgtcaggatatggtccgcaggtatcacccgccgacactaccctcgtatagaggctccagggctgcgcttctcctctaccggatcgtcctcactactcccacagtgtcagggttacggataaggtataccttctacccttggatgtatgttgtatactgatacggtatacctgcgcgtatacggatgtttcctgtacacgttaaggaaatccatcacgtaacagaaacagagtccacggatggaaggagtcctactcggacagaactgggtcgttactgtatcgtgtggggtccgatatctccgagttctacttggagatcaactgacccgcggtataaaagggaccctccgggaggacctaaggcatcgaatgtcaccaccaacacacccaccgcatcctacgaagtcggagccaacaggagctaagtcgccgggtgatctagtcgaaccaactcgactacggtctcatcggtatcatcgagttttgctattccctttgtaatctgtggttttgctcatataatccataccaactggattaggattattacctatcaaggggcctgaaccagtataatccttgtctttttgtttgcttgatgtcatattacgtagatcctcgtaccagcgtaccccaataccctatatatccgatctacgggtatcccccgtcggcagtggcgcgccaggtagggggacttggtgctcaaggttctgctactatgccatcaagcctcgtcgacaacaacgtcaaccccggcatcaaccaaggagtttcaacttcaataatgctggtgtggactcaagtcggcgaaatcgtcttcccgatctacaccacggtgccgatctcgactggtccatcaatgaccggaagcgagaacgccgtgcttacgatcccagacgcctttatgtcgaaggatcctcctgcggaagtggagagcagaacatcgacgacgtctgagcccgagaaggacccaagtgcggccatatctcgtcctcccgacgagaatgacgagccgacaaggacaacttccaaggtaacaaggtcctagtgtcctatccacaaaaccggaaaacacaccttgcaagcttgctgggtttttctcgacgtacaagctgagatccgtgcctgcaaagagcatggaattcagcgtacttctccaactcgtgatgtctattgtcctattcacaagacaaagaatcacgacctctcaagctgcaaggttcttctcatcgctatgaggacgtcatctcctaaggtccagcagtcacaaatatctcttagagaagcggacaaggaacgaggagcgacagttatctcagatcgattcgttggggtaatcgacatcgatccccatgagccattggttctacacttgctcgaagaccaggcctcatcatcaacgagtacaccacgtgatgtattcgcgatcgaggggaccagcacttctgcgcgcgctaacacagaagcggaggatcaattggctacaccggcccagcacattaggaccatcaacacgatacttagggaaaccccttatgctcccgttctgaacgatgacctcgcacagtggacagaacgactacgagaatcagtggccaacctcagcaacacgttcgaggaggccgctgccagggtcctattcaatggcgaattgcctgagcagcgagtatcacctcgtcaagccacccttccgcctcgaggcaccagtgaccaccgtgaccatctaaatggccaccgagaagcacgccgcacgcgagacaacgaaaatcattcctaacatcatgtctcttcgcaacatcgcgagaacgaagaacaacgaggacatccgagcgagaaccgagaccttgataatcgccacaaccgccgtgaacacgatatcgcgacaagcgaatgccagcgaatactggtccaggtagccgccgtaacaacgccgacgacaaagatcaacatcgggacaataacggcggacgacgacaggattctcgagaacccgtccgccatccctgtaatcgtacaccggaaccgagtgactcatcgtcatcatcatcatcatcatcgtcttcgtcatcagatagacacccacggaggacacatgatcgccgacaacccactgcccaggcgacggatgtagagctttcattcgtgccctgcgagatgtccaatggccggagaggtttcgaccgggagcgatagagaaatacgacggaagcaccgacctggaagagtttcttcaggtctattccacagtactctacgctgccggagcagacgacaacgcactggcaaattatttgccagcggcgttgaaagggtctgcacgttcatggctggttcacctcccgccctactcgatatcttcatgggcagatttgtgacagcagttcatcgccaattttcaaggaacatacaagcgccacgcgatcgaggacgacctacacgcgttgacacagaatccgggcaaatcattgagggactacgttcggcgctttaatgagtgccgaaatacgatccccaagatcaccgatgcttctgttatccgcgctttcaagtctagtgttcgagatcgctataccacccaggagttggcgacaagatgaatcacaactgctcgtaggttattcgagtttgttgatcgatgcgctcacgtagatgacaccttgagacacaagaacgacaagccaaagacagagggagacaagaaaccagccaaggacacaccagagtcaagcaagaagaagagtcgcaagaatgggaaaaggaaagctcaaacagaggtcctcgtggcagaatacgcggacccacccaagcacccagacccacaaggcgatgacacgaagaaaatatggtgcaccatacacaagtcggacagacactttctggaggcttgcttcgttttcaaaaaggcactcgcaaagcaactagcgttggagaagggaaagcgggtacgtgtagtcgagaaggccgccgaagcagctactcagtactcagactcgacatacccagactccgacctccatgttttgcacatcttcggaggttccatggcgtactcctcgaaacgagagtacaagaaagtggagcgcgaagtttattcgacatggcagggggctgcgcccaagatgaagtggtctgaggagaaaatcaaattctcagaggcagaccaccccaagactgccatcaccccagggtgatatccgatcgtggtcgagcccactattcggaatatcaaggtcgcacgggttctcatcgatggtggcagcttcatcaacctactctttgtcagcaccttggacgcaatggggattccacgaagcgagttgacgcccactgatcaacccttccatcgaattacctccccagtcatcgtccaagccattgaccaagattacgttgcctttgactttcggccaagcaaacaattttgaacagagcagatcacttttgatgtcgctgaatttgatacagcatacaatgccatcatgggagaactgcactcgtgaagttcatggccgtatctcactacgcataccaagtgctcaagatgcctggcccgaagggaacaatcactattcaagggaacacaaagctggtggtgcagtgtgacaagcggagcctcgacaggtcgagcacacgcccaaccctcccaccacagctgagccacccaagaaagtgagcaaaacaaacaagatgccgaagccagacggcgcaatcaagatcgttccactctccagtgccaaccccgacaagaccgtcaagatcggggcgtcactggacgagaaataggaactcgcgctcatcgccttcctccgtgacaatgcagacgtgttcgcttggcagccgtccgacatgcccgggtccctagggaggtgattgagcataaacttatggtgcgacccgatgccaagccagtaaaacaaaaactgcagagatttgcaccagaccggaaacaagccatacgagaagagctcgacaagcttctcaaagctggcttcatcagagagattctccatccagagtggctagccaatccagtcatggtgcacaaggccaacgggaagtggaggatgtgtgtcgacttgaccgacctcaacaaggcgtgtcccaaggatcacttccctctccctcgaatagaccaattggtggactcaacagctggttgtgagttgttaagctttcttgatgcctactccggctaccaccaaatcagcatggcgaaaaaggacgaggagaagacagccttcatcatgccgtttgatgtattcatgccgtttgatgtattctgttacgttaagatgccgttcgaactgataaccgcaggaaatactttcctacgcacggtccaaggagcacttaacaatcaaattgggaacaacgtcgaggcctacgtcgatgacattgttgtcaagaccaagacaagcgactcattcattgacgatctccgggaaacgttcgacaacctccgacgatatcgcctcatgctcaatccagataagtgcacgttcggagtaccatcgggaaagctgctcgggttcctcgtctctggaagagggatcgaggcaaacccaagaagatcaaggcaatcgagaacatgaagtcgcccacaagactcaaggaagtccagaagctaactggatgcatggcggcattgagcagattcgtcgcttggatgggagaacgaggacaacctttcttcgctctgctgaagaaacaagacaaatttgtatggacacaggaagtcgaggaggtgttcatcgcactcaagcgctacttgtcaaatccccctgtacttgttgctccccaacctaatgaagaattattcctctatatcgccgccacaccatattatgtgagtaccgtcattgtcgtcgagagagagaaggtgcaaagaccagtttactatgtcagtgaagctctccacgacgcaaacacaagatagccatagatccaaatgctgctttatgcagtaatcatgacatgaagaaagcaacgccactacttccaagcccatagggtcacagttgtttcctccttcccccttggtgaagtcatgagaaacaaagacgttgtcggccgcattgcgaaatggatagtcgagctaagccaatttgatgttcattttgtgccatgaacagccatcaagtcccaggtcctcgcagatttcgtagctgactggactatgcctgacaacagggcagacagtcagaccgacaacgagacatggacaatggcatttgacggtgcactcaatagccaaggagcaaggacagggttcatcttgatgtcaccttcgggagatcagttcaagcatgcaattcacctcaacttcagtgcaaccaataacacagccgagtacgaaggactactcgctgggataagagcagcagccacactaggagtcaagcgactaatcgtgaaagggtattccgaactagtcgcaaaccaggtgcataaagactacaaatgctctagccccgagttatccaagtacctcgcagaagtcagaaagcttggaaaaaggtccgacccgtatatcgcaaggacactatcgaccctgccgacctagcacagcatgcatctagacgagagccactcgaacccggcaccttcctggacatcctgacaaagccataggtaaaagaggcaaccggcgaagatagcacagtggtccccaacacaagctggggggctacagaggcagaacatgtcgttgccaccatcgagaccacagacgactggcgaaccccacccatcaagtccttaagtagttattagttgcccgaggacactgcagaagccgagaaaataacctgttaagccaaaatctactgtatgaccggcaacgatctataacgatctatacaagatggcgccaaatggggtacttctcaaatgcatctcatccgacgacggcaagcatctcctccttgacatacacgaagggaactgtgggtcacatgccaccggtcgcacgttggtcggaaaagcttttcgacaagggtttttttggccgaccgccctcaaagacgcttgcgacatggttcagcggtgtgaagcctgtcaattctatggtaaacacacaatgctaccggcgcaagcgctccagactatccctcttacttcgttgttctcatgctgggggctcgacatactcggaccattcccacgaggacagggcggatataggttcctattcatggcgatcgacaagttcaccaagtggatcgaagcgacgcccacgggggaaatcaaggccgacaatgccattaagttcattaaagggatattctgcagatatggattgcttcaccgcatcataacagacaacggctcccagttcatctgtgccgacttccaggattactgtattggattgggagtcaagatctacttcgcctcggtttctcaccctcaaagcaatggacaggtcgaaagggcaaactgcatagtattacaagggatcaagacccgtgtctacgacagactcatgtcacacaacaagaagtgggtcgaagaactcccctctgtcctatgggctgtgcgcaccacatcgacaacgtccaacaaggagacaccattctttctcgcgtatggcttagaagccatgcttcccacggagctacgacatcagagcacacgagtacagaagtacaccgacgaggatcaagaggagcagcgaaatgacgatgtaaatctactcgaagagcatcgagaaagagttgccgtcagagcagccagctaccaataggcccttcgccgataccacgagaagcgcatcagagcacgcacgctttcgatcggcgattacgtcctccgacgggttcaaagccaagcagggcgtaacaagctctcacccaagtaggaaggaccattcacgatcacgccagtcttgcggccaggtgcattcaaaattgtagacggcgatggtcgcgagttagcaaattcttggaacattgatcaattacgtaaattttatgtgtaaatcaatagtatccatatttgtaagacatcttacgacttcaataaagttgatttcaggtaaagactacgatcaacgtgttccttcccgacgatcccttaccacgacgacacctagcgttgaaacctatcctcatgtccctttacgccgtcttgacaaggcctctgaggaacctaagggaacttcggctagggacgctcagagcggataaggccttgtcggatcatgtagagacaaacgaccatgtaagatctggtcatgtaagagttctcgccattcgtattaaccaagccgtgtaatcggaaactgagttttccaacttcacggctgggggctaggatcaatgatttttcaaccaaggcaagtcaagggtccaagagccttatcctccgagaacgtttctccgacgacaaagctgggggctagggagagtgcacgactcaagtgactgatcgaagtcgcgaatgagagaacactcacacatagcacatccagagtaagaaaacttagttagatagattcattttctatttcacaagtacttcttacaattcataattgctccaaaatatattacatatctccttgaagataatttttataggatacaaagagtaccaggacggccaacgccaatccatagactgaaaaaccttctcggcgagcggcgccatcgacttcgccagattgtctatctctgcgggagtcctccgaaaccgagaaaacccttcgtggaggaactcgaggtgcagctacgggcggtggtctcggatacaggccagcacgtgccctccggcatatcggctcgaccgacgacactcctgctttagggcctcgtcgatgcgcttgccgatgccttcaagctgagcgcaggccccattcaaccatgagatatatccggtcgccgactccatggggttcccgcgaggtactcaaagttccctgcagactccagccatggctgtaccacagctcctgaggtacgagttgaaccacacctcgcgacctcggagtgcttccacggcttggtcttttttcacttccaccacagtcctctcgagttcggccacctcgaacttcatcctccaatattggattcgacgatctcggtcggccaacgcaccctcgaggtctgctcaacacggaaatgactaagtcaagtcgttctcctctttcgagaacacggcaaattaagtcgatccgaacaaaagagtaaatgagatgaagaccaaagcaccaacctaaggaagtcgtcgccatgcccgcctccatgaacaggctttgatcgacatcgtcccgtggcacgtacggctcaagcgcaagtgcctgaacgactaccggcgactcaggctgcccgcgctactggacatcctcgatatcgacatctctacaacaacaacaaagtactcggaatcaacatgctaaagaaaatgaaggaaacaactgcatacacaaaggcagtttgaacctacgaaagttttacaagcataattgattaaggagtaccagggaaataaaatcctactcttcaaaaagatggagaatagactctcccaagtcatcgacttctcccatcatgtccttgcgcgcgtcattggcggccccctgatccagaatcctctggaggtcaaggtcagggtacgccaacctcacgcacgcgaggacgtggcacgccccggtatagatcccattagacgtatcctcgccgatcctggctgcatgcttggaggggatctcatccatcgccacaaccagctccacgagtgaggacgtcagcgagaactcgtcgagagttgcgggatggtggtcgtgacccacacttcccgccgaagttggtgtagggtggtgtaagacacccgcagcgagccgcggatctcggcgaggttgttctcgaactccgacatcnggtgctcgagcccctgccgctacctttcgttgtcggccaccacttctctcatcttgaggaggtcctcgtgggtctccgaaaaatcgcgcgccagctgctcagcgtgttgggttactgacaacgctgccgccctggcttcctcgatctcgcggccgacgccgcaagcaccaacctggaggatgcgctccatctcagcttggagctccctccaggtgagggcatcaacaggtgggccccgagcgggcacaagatcgccagcgggtccactcggcgtcgcctcccggtccctagttgtgaccacgacatccgtcgaagctgccataggtgacacgctggatgtcgcgccggacccgtcttgcgccgccttcgcccgcgccgccctatgaaggatttccacaatttcatgaagacaggcaagcaagagtttgcgaataggatgacttctaaaacatctacttacttctcgccaagcgtcaccagcctttgccttcactggggcgggggagatgcatccgaggcctaaacaagatagcacgatatgaggtcaaaatattccgactacatgattaagaaacaagagaggcttaccgacggagtaggcgctttccgacggtttccgctttccgacggtttccgagtacagaggagaacttcctccctttcttcggaacgttgctgccactcgttgtagcagcagcagcagcaatgtcagatgcctccttggcaacgccctcctttaacgacgtcgccgtctggtgatccgcgagcggcccgataacgtccgtcagagggagagcctgcgtacatgaagttacaatgcgatcccaggaaagcttaagtaaggtagccatcgagtacacccacgttgattgcagcctcgcgctcggccgtccccttctcgcaaagggggacgggggcattgctcgccgttgtagggccgctgatcattacttgactgacgcaacactccactgtttcgctgttcaaacctgtaggatcgagaaccagaactcgataagtcaggaggaacatgcacataaagaatgaaatctgaaatacaagaaaaataccccgatgagaaacccaggtcgtgtcctccggcccagaataatcaaaggccgggtgggctcgggcctggagtggttggatccgcctactgatgaagtcggtagcgacttcataccccgacaaccctcgtattcggaggtcatcgataatgtcgatgaaagactgaaaggagggagttagggcgggtttggcggtccactctgaaatcttgtctggttgctcctcagggacaacaaagactggatccgagttttctatctgaagatagaaccacctcgcccgccatttgctacgagaagaggggcactggaaggggatgaatcgcgacttcaggccatcctgaagtcggaaaccgacacatccagataccttttttggttccatccagcgcaactcatagtaaaagcgaaagagatcaacaaatggctctaccccaatgtaggcctcacaaagacaagagaagatactgaggaaggcgatggaattggggttcagatggagcaaggaaaggccgtagaaattcaagacaagaagaagaaactcggaaggcggaggaagaaaactgcaaagaatataatcctcaaccgcaaccatgcggctcaagacaggttctggttcagtacctcctgtttctctctccatggtcccgcgaccagggagggcaccgtcgtcctgcagcttcttcagggacgcattggtggaggtggacttgtcgagatccatcaccgccggagatcgttggagaatagaccgagatgagcaaactagggtttttctgcggaagtggagaagacaaggggcgcttgaaggctggaaagttttgcagcaaacggtcttcaaaatggatccccaaaactcccttaaataagcgcactactgacggtgtgaattccaaggaaaggagagagatggccgctggaaatttctgggtccgttacgcgcagcagttttcaaacttcaatttaaattcactcatgaccgttgaacttcgtgcaatgttatcgataactctatgtctctacggttatcataccgagatcgaccagttgagagcgataacgattccgacatcagaagtcgcgattggtcacatgagtttatttaagcagaagtcgggtgctactgtatcgtgtggggtccgatatctccgagttctacttggagatcaactgacctgcggtataaaagggaccccctgggaggacctaaggcatcgaatctcaccaccaacacacccaccacagcctacgaagtcggagcctacaggatctaagtcgccgggtgatctagtcgaaccaactcgactacggtctcctcggtatcatcgagttttgctattccctttgtaatctgtggtttttctcatataatccataccaactggattagggctattacctatcaaggggcctgaaccagtataatccttgtctttttgtttgcttgatgtcgtattacgtagatcgtcgtaccagcgtaccccaataccctctatatccagtctaccggtatcccccgtcgacacac

SEQ ID NO: 19307 - DNA, 16161 bp, Oryza sativa
taaaataagagttattgctagatactccctccgtcccaaattataaggtctttatctttttacacggttttcaatgatatattttgatcattaatttattctatgttttgttcccaacaaatatgaaattagcattacatgaaagtactttaaattatgaatctagtgatataacatgcataatacttaacatattatggttagtataattattagtcagaaataccgagtttgattttccttataaagagggcggcctataatttaggatggatggagtatgctataaggtcgaggccctgaatcccctgtaagtattaatttctacattaacttttgagtaaaatatgtcgatagtaccacaactcgtgatgtgggtgtaatttagtgacttatcttttaaaatgctcaaccaagttacttatttatttatttatttatttttttgcaaatcacataaggcatgtgctttgtggggatatcgaggggtgaaaatttttggcgtgtcacattgtatatacggacacacatttaaaatattaaacatagactaataacaaataaattacagattccgcctgtaaactgcaagacgaattttttaagcctaattaatatgtcgttagcaaatatttactgtagcacaacattgtcagatcatggagcaattagtcttaaaagattcgtctcgcaatttacacgtaatccgtgtaattagtttttttcgtctatatttaatacttcttgcatatgtctaaacattcaatgtaacagggtgaaaatttttaccagggatctaaacaggccataagttggatggagtattggtttcttttgccaacatggccagacacgatcacgaataagtcaactctaatgcgagtgaaaatttaagatgaattttattattgctctctaactttattgaaaacacacaagtagcaaccagcatagatgaactagcatcgaccaattggggtatcaatagccaataaatgccgtacatattgaggtgggctgagtagtactactatgagttaactagtaaaaattaagagtaatagcgagtacaagagcaggctataagttagctgtaaacacatatagagagaagagaagagagaaaaaaagtgggctttagatttgtagtcagctgcagcacgaactctaatacgttgtgtgtgtacgagagatgggaccatatattaatggtgtagtatatgtttataggtaactattgtatgaataagctattagattggctatagataatttgaagatattagttggctatattattaaacttgctctaaatgtatcagcggtatcctctcttactaatagttatatcccactaattcctaatacttaacatgcaaagatgccacatcatcatccactatcactaattcctaaaacttaacatgcaaaaatatcacatcatcacccactaacaattacggacaaggcatacctcatatcctacgacttatgaaatatacggatacaacataccttcgtgtgtacggtatgtttccgtatacaataaagaaattagcaagagattgtggaaattatccttacgagtaagtgaatagtagagtcctactcggagaggattgggtctactatagtttacaacctggagcacatgaagcctacacgccggaagatctcgtcgaaaccatctcgacaaggatctcgccggtaatctcgggatcatcagttcactattgtaatatgtggtatttccatatcaatctcatataaactggattagggctattaccttacgaggggcgtgaaccagtataatccttgtctttttgtttgcttgatgtcgtatcgtgtagatcctcgtaccaacatacccccaatatcctattcatctgttttacgggtatcccctgttgatacctatatacctatatagttcatcctcacttagttcatgttatttttcttctctcattaagccaggtcatctttgttagcccttagatgaatggtctaaattatcttcctactttctttctcccataaagccacatcatcttacttttatatttgaattattattatatatacaatgcaaatttaaatcacatcaacttatctctactactttaaaatttcgtagtggtgacggtaactccaaccctgacatgcacgcgtaaagacaaccatcggatcgccagatcgaacggcctacatttcctcgctcatcccctcaattgcggatcaactcgcccctccctactgctccgcctccctcctcacaaccgcatgtcgccgattccctgccgcatctgctcgtcgcccctcacgcccagccggccactccgcccagcgccgtctgccgccgaagcccgtcgccatcgcgtccggccaccggcggttgccaacccccacccctggcgactactccgccgtccacgatttgtcgcagccgcccatcgtccgcggccacatagccgcgcgatccctcatcactatatccccgtcgcgccgcctaaccatctccagatcaccacgacgattcctccagattagagcgaagagctgctccccatcctcggctcctccgttgggaccgagaagctatgtggcgaacctccaaccaagcatcgccagagaggacagagctggggccgaggtggggagaagaggagcacacgccggtcggcccgtccgtcactgccactgggctcccacctcccgctttcgtgccgactgccgctactcttccggattggcagagcccaagcagtaggaggcaccgacgaaggtgatgaagacttgagatgaggcagtatgcaggcttgcaggtttggacctcttccctctgatgttatttcagtttgctgcggaaatccatgtttaattgaagatcctttccattaagagatgcaaattaggtgctaatttcttcagggcacccttcttgcagcaggaattgctcaaatcaggtttgtctcgattgctattattacctactcttgtagtcttgttcatatcttgtgactgaattcagaatgtaatattagatgatcgattacttcagtaaattttatgttacataactgattgaatgaaggttgtatgtatatggtggaacatgggttgttccaagatgaacaactggcttacttgctcagaagattatcaactgagattctcaccaaaccactgtacttaacatggagaagcaaaatattttaatgctggcctgaattaacaagctaaacacaagcatgcagtattgttctttgtacagtaagctgttatgaattataaccctgcaagctaggtgggcaaaactgatatttggataggttcaagaaaatgcagtaaaatatctgaaacatacgctatggcaatctgaacagatatgcatatagcctgattcacaagcaaataattaatctgaatagaaaaacaagtggtggcaataaaaattcagagatggccattccctcttatacatgtctgagaaaaaaactgctaattaattcaatgaatacaactacggatctgtaggttgaactttgctcaatttatttgtctagctatagctatccttaggcttcctttatttcctatatacaatcctgtagatttctaacttacatatactgaaaattagtagtcatgtacttctattgtatcttgcagcactcaaagctcgtgagtcatgaatacacactccgctgagtgaacattaggagtcatgtatcttgcagcgggtgcaggagcacatgccaagttctgacaagtacatgtaaagttcttcttttattgaacaacacttgattagtgcttactaatcagccatgtagagttatgtaatcaatccttttgttttccttttactaggtttttgagacttagcctgagagatgttccaattatgaataagttcatgatttaaaaccgacctgatgtatgggaactactatagaagacggttccaattgtgaataagctcatgatttaaaactgatctgatgtatggaactactatagaagtgtggattaattaaaattattggcaactcaggccttcattttacatttttaatgtacgctcgatgacaacagaaaattgctggtgtgcgcttactcgcaggcttacattggtttggtttagaaaaaaagaactcatgtgtgatggatgatgtcgagcgctgcaagggaatgacagtgtaagggttgaaaattgtttctaagttggatcaaccttcaaaaaaataagtgaggggtaatatttttgccaagcttaaagattgaatttgatccatgtgacactgtcttcaaggtaaacatgatttctatttttaagattgcattttggtttgcagtagacgtacacattataactattgttttacttttagttcatccatgcttattaaagctccatttatgcatacagaatctgtatttttcgacacctccccccccccccctctctgaaaatcaggtatcttttgtatgcaaatatagtgagttagaaagtttcgcaaccatataatcatattagagttcagaaccatatgaatcaaccataaatgatggatggccttagtagaatagtatgtgtgccgctgccatccaattaatttttgtaccatgccaaattttaggtatgcacaatgattttaagaaagtcaagattcacaaaaattgcactccgtacgattgtaaaacacaagggggaagtgtgtgcttgttcaggtaaagtaatttcataatccttgtgtggattctggctatttgtgctgaaaccatgatcagatggaaaagtaaaagatcgaaagaagtgaactataaactgaaattttgaacttcaactcctttgtaagatgataaacccagagcccggaaggtatcacctaactctggtgaaaatgccatactcttctatctccatctgtatcccctgcaaatctgcactgcctggcccttctattcattttcataaatatgtatcagagtttagaaatagctaaagggtgaattcatatgttgaacttctctcttgggataacaaattagtttatgccatctggtgggaaatcttttcccctcctaaaactcgtttatgccaccatcaaattaaagaagtgtttgtccatgatgagtcctaaaatttctaaaagagttatatttttcccgttgcaacgcacgggcacctaactagtgtaacttatgtttatatcagactatattgttcaagctatcttacacattatttttacttattgttattaaagtaaactgccgcaacaacgcgcggggtttcacctagttgttaagaaactaactacagggtgatctcatccatataagatgggatcagcaaccgacggcaaccgtgccttctccccactcggtgctccttggaaacgggcgcgatggttcctaaccattgcgtctacggttgccacccctttcccatctatatgattgtcccgcattgatcaataaagtaatatctttgtctcgctcaatctctctcaaactttctataatgcgctatcagcacttccgctctctcgcgaaggagaaagagaaggagaaacaaaagggaatcaacagagaagatgtctaaggatattgttccgattggagaggaattatgtcttgtggataatggtaccacaaactctatatttagggagctcaaatactttcaaactctcaaaaaagagagaaggcaaagttttgaccatcgctggatgccttattgtgatagttggctctggacgagcaactattacattcccaatggatacagaaattacaatgccttactgtgtcctgattcaacccctactgagttatagagatatccatcaaaatgggttccacatttttttttgactggaaatactgccaggactttgcctcgcagtgtaattttataaaatgaaaaggttatttacaaattacagaaagaaaacaaaaaaaaagatcaaggtatcacactgtctgtaaccaatcagaaacaatctgttttagtggatccttcattctgcacaaatgcagaagaacctcagctctgaataaagccctccaagaactgaacgagggaagctcattgcgaaaaattttcccattcctttgcttccaaatatgccaagcagcaatgaagaaaacttccaagaaacctttctaattaaactgaatgcgagccaaaaccaccatttgaaaaaattctaggtcaggattccacgtaattcccaaatgctgccagcaaagtttactaaaagggcaaaagaaaaaaagatgctctcttgtctctctgatattattctggcataattcacaagtgaggtcatcattttcctttgcacaatgtcgcctatccagcatgtctcttgtgttaagtctgtctctgaataaaagccaagcaaaaactttaatcttcattacacattttgttttccagatccagacaaaaggcctaggcacaaaatgggttccacattgaaacccaatatgtataatcgagaagaatttcttctataaactaaacaaaactgatatggaaaacacatttgcgagaaaattccgtctctcacatcgggattgtactatacatacattaagcctgttgcacatggtgcatataaagtaatttttcaaaatgttgatgcattctacacttggcatgatcgacttgggcaccccggtatcgagatgatgagaaaaattattagcaattctattggtcatcatttgataactgaaaaatttcccaaatcctctgattttgtatgcactataggtgctactgggaaactgattttgacaccttcttctctcaaaatagagctgagccacttaaattccttgaacacattcaagagaatatttgtggtcctattctgccaagatctggactgttcatgtactttttagttttgattgacattgttggcggatggcatgaggcccttcaaccaaacctgccgaaacccatggcgaaggctatggagcaagaacggcgcaaggcgaagagtagcgccaggccagaggcgtctcaggcgaagggtgcaaggcgaagactgtctgccgaaggaggatgacttcgccttgacaagttcgcccccgcgagggccgaggaagcctttccggcccatcaggccggcgatcgccagacggcccatcaggggcccatgagcccctataacattatgtacccctgtaaatgtctcttctgtaagggtaatcatgtaaattcccctgtacaacctaaaccctagtagtaagaacctgtaatggggctataaatagtcccctagggccatgtaatggggggatcccaagtgaaattcaaaatttagtacacttcatttttccaaccactgttgagtaaccacgtcttttgacgtatgcagttgtcgtttcgacaacagctggcgccgtccgtggggactccgagcgaaaccactgagagcgaatgccactgaagagggtcgtgaaggagaaggttgtcaggcggaaggagagcgatgccggaccggacatggccgccgaggaaggagcagagccttcggcgttcgtggccgaagatggagaagcacaagcgccatcacagccgccttcggcccccgcgccaccacaaccgtcttcggcccccgcaacctcagtgcaagtgccgaacacggccgacgtggcgaaggcggctgcggcgggaaggacactccagaccaaggtggagatcctttcgactaaccaactggtggtgcctcaagccgccccgtcgcagccggcggcgccaattgcgctcaccgttgtacaggcccaaatcagcctggaccccgaagcgcaagccgaagccgacatggaagccatgcggcagaacatgacatggctccaagacatgcttcgccaaatgcaagaacaacaacaagcatacgaggcgacaaggcggaccaaggccacgtcggctccaatccttcagtattcggtaggctatgccctacctcaagtccggccgcaagtggtgacccatccctctccgccactagccgcatagccgccggtgtacttcgccgggtagcatcaaccacctggccaagcgccacaaccagtggcggaaggggcttcggctctgcaggcgcaactccaagctttccttcagcaactcaaccaaccccactacatttcaagcacaaccccatcggcttacccggtggggaatacaagtcaaggtgtgcccaattggttgccaccaattcagccaggctcgggaccttcgccgtggagtcaaggaccgcagttcgacttcgtcaacactgctcaggtgccaaccgttcggcagcaagttccaaccccaggcttcggaacaaacaacgcaccaatccaagctgccatgatgtggtcgcagccaatctttgaccaatccatggcggcccagcaagtaccaccagttggagccgggcagtcgaatgccacggcccaactccacacacaagctgtgatttcgcccttcgccacaccgtaccagtaacaaggtgcggtaaacagggcgggaggcgaaaaggggctgccgctgagtgggggagtcaagactcgtccaatcccgccccagttcaagttcccacctgtcccgcgttattcgggcgaaactgacccgaaggagttcctctccatctacaagtcagcgatcaaagcggctcatggtgacgaaattaccaaggcgaaggtaatacatctcgctctagacggcatcgcccgctcttggtatttcaatttaccagccaatagcatttactcatgggagcaattgcgtgatgtttttgtccttaactttcgaggcacctatgaggagccgaagacgcagcaacaccttcttggcattcgccaaaggccgggggagtcgataagggagtacatgcgtcgcttctcgcaagcccagtgccaagttcaagacataaccgaggcgtcggttataaacgccgcttcggccagtctgcttgagggcgaactaataagaaaaatcgccaacaaggagccgcagacgctcgagcacctacttcgcatcattgacgggttcgtaaggggtgaggaggattctaagcgacgacaagctatacaagctgagtacgataaagcctccgtcgccgctgctcaagctcaagcgcaagttcaaattgccgaaccacctcccctctctgttcgcagtcttagccggcgatccagggacagccgccaaggcaaggccaagcccccatgacttggagaaagttcagaacagatcgggcgggcaaggctgtgatggctgtcgaagaagtgcaagccctccgcaaggagttcgacgcccaacaagcaagcaaccatcagcagccagcccgcaagaaggtccgaaaagacctctactgcacctttcacggacgctcttcgcacaccacggagcaatgccgaaatattaggcaacgtggcaacgcgcaagacccaaggccgcagcagggaacaactgtcgaagcaccccgtgaagcagttcaggagcaaacaccctcagccgaacaacgccaagatacacaacgaagggtaatccaagtgattacaagagctgacccgccaagccagttgtcaaaacggcagaggaagatgcagatccgcatggtccacagcatcacttcggcgggtgagggggcgccacagtacgtgaaccagctgatctctttcgggccagaagatgccgaaggagtcctgttcccgcatcaagatccactggtaatctcagctgagatagccggttttgaagtccgacgaatcctagtcgatggagggagttcggccgatgtgatcttcgccgaagcatatgctaagatgggcttgccaacccaagctcttacaccggcaccaacgtcgctccgggggttcatcgtagaggcagtgcaagttcttggccaagcatttttgctgatagctttcggctcgggagaaaacaggcgcgtagagcaaatactgttcgacgtcgtcaacatcccatacaactacaacgccatcttcggccgtgcaaccctgaacaagttcgaagccatttcccaccacaattatctcaagctcaagatgccaggcccaacaggggtgatagtagtcaaggggcttcagccttcggccgcttcaaaacgcgatctagccataatcaacagagcagtgcacaatgttgagaccgaaccgcatgagcggccgaagcacacaccgaagcccacccctcacggcaaggtaacaaaagtgcagattgatgatgccgaccccacaaagctcgtatcactggggggcgacatgggcgaagaagaagttgagagcatactaaaggtgctcaaaaagaacatcgatatcttcgcctggagccctgacgaggtgagggcgtcctggcggatctcatcatgcattacttagcagtcaagccgaatattaagccaagaaaacaaaagttgcgcaagatgtctgccgatcgccaagaagcggcgaagaccgaagtacaaaaattactccgggcgggggttattcaagagattgaccatccggagaggttggcgaatccagtgctggtacgaaagcactgggagtccagcgcctgctaattcgaactgactccaagttggtagcaggtcatgttgacaaatccttcgaggtaaaaaaagagggaatgaagaggtatctggaggctgtccggtccatggaaaaatgcttcaccggcataacggtcgaacacttgcctagagaccagaacggggaggcagacgccttggcgaaatccgctgcttgtggtggcccacattcgccgggcatctttttcgaagtcctgcatgctccaagtgtgcccatggactgctccgaagtcatggcaatcgaccgggagaaacggggcgaagacccacatgactggcgaaccccatttgtgaaacaccttgaaacaggctggcttccggtagacgaaacagaagcgaagcgtttgcagctcagagccacgaaatataagatggtttcgggttagctttaccgcactggggtacttcaacccttacttcgttgtatctcatttgccgaaggcgaagaaatggcaaaggagatacaccaggggctatgcggcgcgcaccaggctacaagaacagtggcctccaaagtatttagacaaggagtttattggcccactgtgttgaaagtctgtgttgagcaaatcaagaagtgcgaaagttgccagcgtcatggccgaagccaagccatgccccagtatgatctgcagcccattgcgccaatatgacccttcgccagatggggactggacatcattgggccgttcccagtggcgcgaaacgggtataaattcgcaattgtagctgtggaatatttctatcgatggattgaagccgaaccccttggggcaatcacttcggcagcagtacagaaatttgtatggaaaaacattgtttgccacttcggcagcagtacaaaaatttgtatggaaaaacattgtttgccgtttcggagtgccaaaggagttcattactgacaacagcaagcagtttgactctgataagttcagagaaatgtgcgaagggcttagcctggaaatcaagtttgtgtcggtcatacacccgcagtcaaatggggcggccgaacgtacaaatggcaagatcctagaagcactgaagaaaagacttgagggggcggcgaaaggcaaatggccagaggaattgctatcggttctctgggctcttcggacgacccccacaagaccaaccaagtttagcccgtttatgcttctgtatggcgatgaggcaatgaccccagcagagctaggggctaactcaccaagggtgatgttttccgggggcgaagaaggacgcgaagtatcgctcgaactcttggaaggagtaagagtcaaagcgctcgagcacatgcacaagtacgccacaagcacttcggcaacttacaacaaaaaagttcgacccacggagctcatacctggtcatctcgtcctaaggaagaaggcgaacccagtagcagttggcaagcttgaatcaaagtgggaaggaccatacctcatcaagcgcaagtctaggacgggatcttttcgcctagcgacactcgaaggcgaggagttcgaccattcctggaacgccgcctccctcaagcgcttctatgtctaaattgggtggcacccaaatcgccaacttgtaaaaatgtacatactgtcatgtaagcctttcggcactatgtaagactttcggcaagaaaaaaaaaggagaaaaagaagaaagagagaaaaagaaaaaaactggatgtagggctattatccaccatggaggcccgaaccagtataaaatctctgtgtcctccgccttcttcttacttttcgtgtgattgataatttatggaaaaaccccaaggcaaacgcctgatcagcgaaaaaggccaagggggcgaaacgaatcggccgaagcattgctcgccgaacgttgaaaccgcaatagcttgtctcggaaataaatagccgaacgacgttacgaccgatcggcataaaagcaaaagcgtttctctcgacacagaacgctacagatcgaaaacaaacgacgaaaagctgaaaagtcagtacacctatttcgctaatatatgcaaaggggccggcatgttctggcctaacaaaagcacaaaatgtgacgatgcgaaaaatagcgaaaaggaaataaagcacgttctttattagcttcgaaaaaataatcgaagaatacaaggtttacaacccgatacaattcattttacaagtaaattacattttcaccccagtaatcattatccctccctaaggaatggttggacgaactaggttcgtcatcactactaatatcatacacaaccttaagaggagtagggggcgaaacacagactaaactgtaacgacgctgagagatcgattcctggcgtttagtcttctgatggtttcgccaaaagcgagccatatcttccaaacgtcttgagtgaacaagatcgtaatcttctaaggttcgcccggggtgcgcacgtagccagctggcaaccttgataaccttatagctgcgaccgtttatctccatttcgcgataaacaggccgaaatggatatcgcgtcttcggcagccccttcaatgccacaaatttctcgttttgactttgccagctcccaaaagggggccgaatgcatgattttcggcggaccccctagtagacagtgcagaaaaggcaaaacacatcttgcatggtaagagtaggcgaaagaaggggaaggtatggcataatgtgaaacgagtaaaataaaaatatgccaaaaaagcataccaaaaagccttttttaaggttcgccacatctagcgaacaccaaaagaaaactatgaaaatctaagagaagggcggagggccttacacctcttggtggttctgggcatcgcctccaccccctccggccgtcgcgccttcctctaaacaaaggtccgccgcctctgctttcgccagctgctccaaaaggcgcgccttagcggcggagctgccgtccttctgccaaaattgttttcgccacgcacgaagtgcaggcgaaatgtcttgcgcactgatttcccaatcccccttcgtgtacttagggaactcggcgatgtgctcgcagccgaactgctgcaggaggcccatggtaaaggccgctgacacgcgcgcacagcagtcgccgtacgcggtggcgcagtccgaaaccgatccaccggcctgctgggtctactccgagaagtcgaaggctgaggcatcctcggtagggaccccgcgcaccttcgcgcccatgtcggtaagggcgaggcggagtgtttggcaagccgttctcgcagattcggtggtcttcgccatctcccgcgaaaaccgccgcgactcctccgcggcgctcgcttcggccctgctagccttctggcgaagagactgcatcttcggctcagtaaggttgctcgacgaccgaaacatcgccgatcatcctgcgggcttcggcttcggcctggtcaaagggtcaacactgtaaaagaagagtgtgaagctatgtcaaaagtcaaataaggcgaaataacaaagcacagcagtatatagcaaaagaacagtcttactgttcgcccccttaggaagtatcaggttcggcaaaccgttgacctcttcgccttgttcaaccgcgacttgccatgactgggagatgggaaaaatgcgaagcatacaaaattcctccaccaagtcacggtagctaaggcgggagcaaaccttccgcagtagaacgaaccgcgcctccatggtgccgtccacagcaatcttgggtctccggttcggcgcaatcgccctgcgccggcaccggagggctttcgccaattcagaaccagcctagaaggggatggtgtggtagaaccacctcgccatccaatggcgatcccacttcgacatggcagcgttcatcggccagagatcggaccgctcggggcgaacgttgaagttcacgctcccgaacactgtttttttcgttccagccggggtaatcaccgtcttcgagttcacggtggcgaaaaatatggcgccaaagagctcggcgttaggctcaaacccggaagtccggcacgcccagtcgaagatagcaatccgaacaagcgccgacgggctcagctgcggaagttctacctagaagaggcgaaggatttccggcaacaacacgttgcagggaaaccgtagccctgcctcaaaaaatacggcgaacaccactgtctgattgtcgacaggtttcggcaccacggttttccctggggcgaaagcctgccccttaaccaacgctccggagctgaccagcttcgccagctcgacgtcgtctacaagagagacccccagaaaggcggtgctgttgtcatcgactcggccgggatctggccctttcgccgaagtaggatttggcttacgtggggccatggtgaacggtccgtttgcggtggcgaaaaaagagattcgacgaaacgcctgaggggtcgaaagatgctgtgaaaggaagagacgaaggaagagagcgcgcacggtaaaatggcaagtggggcggtgaaaaggaaagagcagcaggaatatatagcccacccaggcggccgttcgcctacccaccagtaataaagcaccacgtgtcgcaagggtaggcgaaacggtaaattcctatcgaccgagcggcacagtgaaaagcccacgatataaaggcccaatactgttccattcgacccaggaaaaaataatatatataaccatcaatcgcaggaggcgcagcgcggcaaattaataccagccgcacaaataacaaacttcatttgtaggaataatgtaggtttcggcaggagcatcggtcgaaaggggccgccgcataccataccacatggtttgcacggtctcggccgaagctccaatttcacccttgcccgtgaggggcttgttggcggatggcatgaggcccttcaaccaaacctgccgaaacccatggcgaaggctatggagcaagaacggcgcaaggtgaagagtagcgccaggccagaggcgtctcaggcgaaaggtgcaaggcgaagactgtctgccgaaggaggatgacttcgccttaacaagttcgcccctgcgagggccgaggaagcctttccggcccatcaggccggcgatcgccagacggcccatcaggggcccatgagcccctataacattatgtacccctgtaaatgtcccttttgtaagggtaatcatgtaaattcccctgtacaacctaaaccctggtagtaagaacctgtaatggggctataaatagtcccctagggccatgtaatggggggatcccaagtgaaattcaaattttagtacactttatttttccaaccactgttgagtaaccacgtcttttgacatatgcagttatcgtttcgacaacagacatatctactagatggtctaatgcgtgtcttctatcgacatgaaaccatgcctttgctaacgaaatatctcaaattgttgattgctatcaagttgatccagaacctaactctgactagtgtggcagcattatttggtcacgctggtttggctagagtggtagcgctatttggccacatcaccctcgccgacgtggcaggat

SEQ ID NO: 19308 - DNA, 10919 bp, Oryza sativa
ttttagtacactttatttttccaaccactgttgagtaaccacgtcttttgacatatgcagttatcgtttcgacaacagacatatctactagatggtctaatgcgtgtgttctatcgacatgaaaccatgcctttgctaacgaaatatctcaaattgttgattgctatcaagttgatccagaacctaactctgactagtgtggcagcattatttggtcacgctggtttggctagagtggtagcgctatttggccacatcaccctcgccgacgtggcaggataaaactgttacacccgttatgtgtggagtgtcaatgttgttttgtcacgcaagacggactggtgtggctaaaaggttcagattttataaataagttttggaatggtttatttttaaaattaaaaaaaataaaaggttcaaaaaaataaaaaaaaaatctagcatgtcctatgccttcttttttttttgaggtgaacctcaaaagaggacagggagttcttgtttttatttaagaagaagagaggtggcccagtttttagggaaaaccgggcccgaaaacctcacaagtgcgcggttaattgagggaaaccggccaaagacccacacgaggaacagaacaggacacatgcagcagcactactaaagttcgaaacaaaagtcatcgttgccaagctcagaggagcagctccgacttcttaagaacaaactacgaactaggcgaccacaaagacaacgtagggcagggtcttctagacgaagcctccaaggagaagcgtcggagacgcaaacaacgtccgtccgagaatcggaacaaagttttcacctgaagaaaaggagagcaagcgacaacgccttcaggaagggaatggtgcccataggcgtcgacgttatcagccgtagtccaagaccaagtagggctttcacccgtgctctcgctccctgacaaccacgaaaccaaggccgccacaatgcttcacaacccttagacgcttccaaggacgagataagggggttatcattgccgagcttgccaccgcaagcagctccgactccaccctagctcaaccacatggttgcgccacaagagcttcgagcaccacacacctcactgctgcaaggactttgaaggcactgacagagtggacggtctcccgatcttcaccaagcagaaccttccaacctaacctgtgtctctctccttaacatggggcgccccacgactggagtaggccagtctaagaagggaaggggctccaatggacaggaggagggaacaacagccagttgggaggaaccctcgccgttgaccaggacaatgaccacactgctgatcatcgtgtcccacggctttccaacaagcagaactgcagcaaacgatcggcctctccaagcggcgactccacctaacggcacctgctgcgcctatccggccatcttctttttcagcctctccgccggccacctctactagcaccttctgcctgcctcccccaacttcactggccttccccaactccttatggccggcctcctccctccgggcatggaggcgaccagattcggcataggccggattgaccgcctcctccacctgccggctgccagcttctcccaacagccggccaactccaccaccacgcctcctccaactccactcccgctggccttccccttctggatccaaggtggaggcggccagatccgaaaccggttgaccgccccctccatatctggccacacccacaccgccacacgccgattacaactcgccactgccaactcttctcaccgcctcctccccgccgctgtcgctggagcagctcgccgccgggacgccgcagccgccgctaggacgtcgtccctcatcccccgcgcagaagaggactcgtcgcttcacggctgcctaccccgtcgccgccgtccttgctcgccgagccgtggctcggccccgcttgctctagcggtggcgaggtggaggatggaggggggaaagtggcggcggctagggttttttccgcccgcccggtcgcccgcgatgggagcgacgcgagcggggaaagacgaattgtcctatgccttctctttctctgtttgatgtcgttctattttttttgttaatacatatatataccttgatttacgtgcaaatcgactagtaagaaagaaaaagccagtcactcgataattaaggctttctttggcaaaactctaaatctcatatcacgatagatttaaagtttatacgttaaattatagtggttgaaaatttaaaattttattaaaatggtaacaaaataatttatctaaatgctatcaacgttatcacgaatctaaaatctatagaattgcggtgttagaaatatccaggtttaaaaattttggatgtaaagtttgccaaagatgacctaaatagcttctttatatttatcgaggagtgtacgttccgcacatgccaaacctctttgcaaatatttaacctgataatctcgctgcatgcacgctgcaacttgcatgcgacgatggtgtttgagatatattaagataaaaataaagttagcacatgtaaaacaagaaagccactagcgcatgatgatcaaatgaggtataattattttaaactctaaaattgaatttatctaatatttttaaaaagttttaagtagaaaatttttatatgaaaatatcgtttatcagtttagaaaatatgcttaaaaaaaccgaggtaagatgtcatgaatccctggattgcgaagtacatataatatgatatatcacgctgcatttgtctaatcgttcgatggctcgctcaaagccatatcgatggcgacgcacagcgcacgcatgttttctcaatcatatatacggtttggtttgtttgtatctcccacgtgtggatggcaggatcgatcgtgccaagaattgtcagtcagaggtatttgtatgggtcaaactgaattttgccgaaagcctctttttagacgcccgaattgaaaaggcagctagtccaacgcttcacacttgcaggtttcaacgtgttaaaagtacgacggaatcgtccgtatcgctaaacaaaagtatgtccttttctcgtaagtttaaacttttagatgaatcgattgatgcgagtgaatcaatacgatgacttttggtcgagataagagcatatatatagacagtcattaatttagagttgttattaatggagaaaaggatagctaaaagaaaataaattattagttatattcactaagattgtaggagtagatatatttaagtcatatttaaaaaaaatagtcaaatcatctttaccctataacttacattatattttttggtatttacattgtattttattatctccttgtaagaggagatataagagatcgaaacatacttatatcatatataggaatagcaatcaaatatttaaaaattaaaattaaataaactttttttggcaaatccaaatattaatttgattcatcaatgaccaggttaattatcttctgaaattatttgcctgcaacgtacaccctccgttccattttaggtgcagtattttgtttttttttcaacgtttgatcgtctgttttatttaactttttatgactagtattttttttattgtcattagatgataaaacataaataatactttacgcgtgacttattttttaacttttttataaactagagaggaagcccgcgcagatgcgcggacaacttatttattctttattaaaataatgttacaagatatttatcatatattgtttaacgacggtagattatgttattatcataaaaaagcatctctaccttgaaattaaattgatcatagactttgatacaataaattaaattaaattacaaaaatgtctctcatattaaaaatgatcactatgtcctggttatataaaaactccctatcacaattattctctcgaattagctaagtgcctttttaagagatagaattgcttattaaaaaataaacttaatataatcatctccatttcatactgaagtggccatgtctcacttgtgcctgaatgtataaacattttaaaataccgcttctatcaattattgagagaaaatcattaaaattagatataaacacttgtctaacgtgtgaagttggccatagccactaaggatttattctctaataccttgaaacatgggtcctgcatcgacgtagccatgcccctcaagattaacgtcgatcacaattttaactcctagctcactatctacaccgttataaagaattgtatcaataagtaggctagttgagctctactgctgaaaggagtcatataggactcaatggactgattatatgtaggaatgtacaaacataacaacattttagttttaaatttgaggattaggagggaaagattaatagttattttcaatcgtatgtgggtatgtatgtttctcctttttttgatgaataatacttatatctggtacgtaaatgagagattatcaggagagactacattaatacatctaatttaatatttaaaaataatgggtctgattaattcaatgctagatgttttgctttttttctcatttttttttatattttctagacatcaggtgctgccttaggatcatttgtagaaattaagagggagtgattagtttaacagatctaatgtaatagttaaaaatattgaatccaccagttttagtataaatcaatcgctagatgttttacttttttagaatttcttagattttctctaatttattagagcacaatgtggtagcttaagattgtttgtagcagggccacgtggcggcgtaggagtgtttgtatgatgttcaatggacttttagaatataacaatgttcttatctcaatgattagtggatagctatacgcacgtagaagtgatacataggtttgagtgtgcacatagaattgacacataaatttaaccattcatgagtcaagtacattggatcttacatactatgtactccaacatgtactccaacctagattaacttaagtttaaagtcgagagactgaagagaaaataatcaacatatatgcctcctattgtctaattgagacatatcgatccggttcatttaatcatttattttttataatcatttaaatactagagatataattatatcaaaataattatctggacgtatctatattaatattattgtgaaatttatattttaaagtggaggtaatattttttatgctaatcacaattagagtattattgcttgcgacattgtggattgctttaaatattaaaggtattattatatcaaaatatttttcatgaaagatttaagtaacattattttattttgtgagaaataataatattttagcacatcaatattttagaacagtggtattatttttgggagtgctaatatcaactaattagagtattttattttgtgatattatatagctaatctaattatgcatgattgtgaagtgatatatgatgatatgatctaatttatctattttattcacaatctttttttttgttgtgatgagatgaaaaatgtcaggatatgatttgaaataatagaggaaatatttttgtttttgtttttgtcaaatctatcataaatttattaatgtatgttttgcaaagtgatctatgatcatataatatacattgttatttttttttctaattttatttaacagcttaatgtgcatgctaaggataggatatgataaaaattaaatatttcttatgagttaaagaatttagtaccgttctaaatggttaattaagcacgatgaatccgataataattaaagaatggtaaaaaggttgtgtaatctaaaggttaagattatttctctatacataaattattcaaaaatattatttttaattgtaagaacttaaaaggagaaaagagaggagaagatatggaaggggggaggggggtaagcaacgtacatacgtacgtacgtgggggtggggaggaggatggactggtggggggagagaggtggactgtgggggtctgttttttctaaaaataaatttaatagattaaaaagtgggcctattagtttattagagagccacatggcagcttatgagtatttgtaggatgctacgtggcagtgtgagagtgtttgtaggaagtttaatggacttttattatataatagatttttaaaataagatgaatggttgaaaaaaaacaaaacactgcattttaaatttaaaatgagacgaaagaagtagtgcatagtgcacggcaatgcagacgtagcttacacaactaaaaaacgatttttctgtataagtacctctttagattgcagacagcccgtaactggtcgcgttaacaaaaatcgtcattcactttcgcgtgcggaaccttaagagggccgcacgcgaaaatcagcaggcaagcctctttaaggctccgcacgcaaaaataaaccaatttttacgagcggaccacttaaggggccgtacacaaaaatctattttcgcatgcagacctcttaaggatcctgcataaagtttacgttccctcctcacacttcaaaattttttatccttatcctctcatcacctctctcactctctcacctcttcttctcacaatatcgctcactctctcactttgcgcagctctcctctctcactctcctcgcgtggccggtggtgggctgcgcggccaacaacgggcggcaggcgcggatggcagcaagcgatgggcgcggacggcggcagacggaggactcggccggcagcagcgggcggctcggtggcggggggatctgccttcgccagcctcgcgacgggaggcgggtggcgcggtcaacggcaggtgactatggtcacgggcgacgacgaaggcggcagctccctcagccctccccgcgcggatccggtggtgggctcgagcgggaggccacggcggctctcccccgcgcggatctagtggcgggcggcacattggcggcaggtgtcacgcccagaaatttagcccaaatttccagactattttgtgtattaaatccctgtccaggaccagccagggtacacaaaacgacaaaacgacaagtaatatacagttccaaacgtaaataaagcgtaaaatacttacaaaagaggcacttagttctcgcaccgaaacgaaagcagcagcagcggaaaagggcgatcctagcgaggcttcagctccactccacaggcaaaactcaactggggtctgagccttggttctctaactccatcttcagctcagaagcactacacttctgaaaagggggaatagtagcaagactgagtacaaccaccatactcagcaagccacaccaacgatgcagatgtgcaaggggatacaaggacggtttgtggttatttgcataaaggcggttgtaaaacattttattgagcaaaacagtaaaaatgttgagtaattaaagtaacattaaatctccactgatcaacgctacaccacgttgaacaggcccaaccaacccacctgaactacagtgcattgagtcgatttattaagatggaactaatcacggtgaatctggtcgaccgcccataaccgcgggcacggctattcgaatagttttactctgatcagaggtgtacaactgtacccacaagacaaagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggacgtcgcagggcccatccaaactccatcacgcccacccttgcctagatgcgtcggctagaggaaagctacgctacaagcccagccgttgcccacgctggcttgtggtaagtacgataagttcttccagggcatcccgcgaaccggtccttaattgccatgggtgcgactagcaaaaccatgcacccacagcccaccattcagtcgcattttagttggataattacgaccatgaagcatggccaaatgtctcgagcacgcagctcaacaagatactagaaaggtctaatactgcaattaccccatcaactgagctagtggtaattaagcatggctaagcatatagttctagctaggtcatcaaagtaacacaagctagacgatttattacccatggttgacaaaggacagatatcaagtaaacatggcacaagcgagcagataggtaaaaccctgaccccatgtaattagcaaaacatgcatatttatttgtaaacagtaaaacatttgtaaattaggatcaacatactcaaggggaatgtgtgacttgccttgcttcttcactttgatcttctgaactcttatccttgcgaacgcggacttccgaaacgacggaaactacacgctggcacgccaaacgagaaaaaaactctaataaaaaccaagaaaacagtacataaaaagtaaacaaacatgtagagctcaattttagatgaattttgcaagttgaatggctcaattcagagttcgaatgaattagatatgaattttagaagttttgagccatttaaatgaatttctagaattaaactcgatttattgcgcaattattatttattttcccaaaggaaaagacggttgctgacgttagcaaaggggagaggcagcgccggcaagcgggccccaccggtcagcgacacaagggcgccggtccaccgtggaccgggaccaccgagcggtccaccgccggtccacgggaaccgacggcccggatcggcgcggctggggcacggcacggctcaggccggcccagccgagcgatggcgcgcggcagcgcggccatcggcgacgacggccggcgacggcgcggggaggagaggagggatgctcaccaagggcggcgacggcgagactacaacggggaagccggcggcgggctcctcgggaggcaacggtggtccggcggcgtaccacgggcgcaggcggcggacggtgaccgggacgaccggggcgtggagagggcgatttcagtggttcccggagacgacgaagcggtggccggggtgcggctcggagttgccgatccgagggaggaaacggcgcagtccggcatcaaccggggaggcggggcgacacagatggagacggcaaacacggcggcgatctcgggttggtggtgaagttggtgctcgggcagcgagaggcaacaaccgagcgtgcggccgagcttgactttgaggcggcgaaggtactggcagtggtggcgcactggggccacggctaggccggcggcggcgcgcggttggagtcggtgaaaggggcggcgtcctcgggtgtgcggtgggagtggtgctcgaggggtggagagggggaaataagaggcggccggacttccccttgcagtggcgaagctggcggtggcggcggctcggcgtggcgacggctgtggcggcgggaaacggcgaccggaattcgccggagtgtgacagcgcgtgggtgcggcgtggggagagcgagggagagtatgccgggctcgggaaaaatggggaaatgtacgaggggagcacggggatgctttttataggctagggaaggcgggatcgagcccgggagaggcggcaaccggcgacggagtggggcggcatcgtggcgggtgtggcggctcggcgtggcgtcgattcccgcggggagagagggggagtgggcggatatgtgtcgcgaggtgaaagggaactcgggtccaccccggttgggacgagggaaggcgtgggatcgccgaagggagtggcggccgtggccaacggttggagctgaccgaaggttggggatgacaggttgttgggaaagaagatgacaggtgggtccttgggtcccacctgtcggggagagagaggggaaaacgggcgagggaggtaaagcagacttgagggagagagagagccgagcgggccgagggagaaggccggcccgagagggagagaaaaggggcgcgcgggccgcgggagagaaggaagacttgggccgaaaatggcccaaagagaggaagggggattttaattgttttctttttattttaattgatgcaatgatctttgtgctattaaaactatttctcgagctccgaaaattcacggaaaattccggagagtacattagggcacaaagaatattacaaaatattcccgaccaatgatttttaaaggaaattttaatttcctctataatttcacttgattaaattgattaactttttatttaatttctaggaaatgcattattaaatgatttttaatcccgaacgaaaatcggggcgttacagcaggcgcgggctccggtggcggtgcagatccagcatccacgcgcgcggatccaccggcgacaacggcgacggcggccagctagggttagggctaggttttgtgttttggacttttttatcgattttctattttcatgtgcggatggcttaagcgtccgcacgcaaaaatcctatttttgcagaccctttagtgccgggtagccatgctgcacgcgaaaaccccttaggccatctgcaatcggtaccctcaacccatgcccttgcaaatggcgtcttctttccgtcgttgggtcgtcccctaggagagaggcgcgacccctggcagaggaacgcgcgtctcagctgcttttctggagccaccgctcgaggctactcgttggaggagggcgtggctcgtggacacggctcccgctccacaaatttccccttccaccctcggtctcatcgctggcagtggggaggagtcggaggtgacggcggcagtgacgaacccgcggccagcgcgacgagcgacggccgccaccatctcctcccagat

SEQ ID NO: 19309 - DNA, 5223 bp, Oryza sativa
atgttatgaaaataacgccagcaacctatctccaagcccgggccggcccggcccgagccttgctccgcgcaagggtaacgtgccgcacgattcccgttttccccgtctcccacacttctcctctctgaccacagcacacacgcaacaccgggacgggcgatccggaaggttctggaaccttctagaggctcgtaggagcctccggcggaacccctctcgcctcgcctcgcctccgatgggctcgaagccgccgccgccgccgcagcccagcgtctccttcaagctcgtcctcctcggcgacggtacggctatctccctctcccttccgatcccgcgaaccctcctcccccccttctcaacccccttttctgccgaattcccgatccttcagtttggggttggcgtgcgcaagaaaatagccacggaatctgggtgaattttggctgctcttgtggtgcgtgctgagccctagctagggttaggggaaagccgcagaatcatttgatctggtaccctgtgtaggtagctaaatctatagcttagacgagggagttgagcggttttgagctaagcttaccttttacttgattgccttcgaggcttagcggagtccaggagatgattagaccgagagggctactcatagaaacaatctaacaagtagaagcatattcgttcttatatagaagatttgtctagtgctagctgcagcggggactgctgcaaattcatgtggacacaaagtggcagctgaagggtggccatggagctggtggcagggaattcgtcttatgcaataggggtggataatatttcattttgatccgtgctctctgtccgcttttaagcttggattgtaatgtccagctgatctagttctatattaattggtggttttacttttcttgtcattaccttaaccaacccttgaaggcagggtcctagaaaaaaaaaattcagtatgactcagctttttggtcatctgtgtatgatgccatgggtcttacccatgttcctctagagaaagtgatgtgtgcctttttggaaaaatgatacagtatgtagtttgggaggagggggttttgatgggaaagtactacagtctttatttgggcatgcttcttagcaagtgcatgtaagtcatacatgggaatgtcaagagaatttttcttgaaaccaggcacgggtgggcattgatctaacatggtacacttgcttttcctagcattgttgaacattgactcattttgatttaggatcagcttacttatagcttagaagcaagcttggaaatcagtttgtgcattgccaaagcggaatcacgtttcatttgaagttggctaatttcaattttggaaaagaaaaaagttggagtagttttgaactgaggcaatgagcacaatgaaagaattttttaccacagtagacagtacttgataagtgatagcgccagcataatcaattgctgaaactctttaaccatgccttagtacttggctttacattttttgaatgaagatatatatgtgtttccatgcataaaagcattgttgatagtcttgtgggcatgtatcttataggttgggtcattagggtttgcttattgttataactttctgtcattgatttcagatttttaatggaagaggtgtttaggctgtcttgtaaccagtcctctgttggcccagcctatcaatgtgaaaactgataaacctaagtttaacttaggatgaattgatcataattatatgctccattttttcaatttcattgaaaagacatgtgattgaatacatttcatatttattaacacaaacaataacttttacttttctcttggcacagggagagtaggcaaaacatctcttgtgctgcggtatgtgaatgatgtcttctcagacaaacaggaagcaactgttcaagcttcatatttgacaaagcgccttgttgttgaaggtgtgcctattacgctctctatctgggtgcgttgtcatctctttgatttgcgataatttgttcaacattttttacctctttcattttctcttatgtcagttgcacacacttgtttgaagtaattgtttactaattttgctgttgggatgatattcaattatggtttcaaatcccacttatatgtgcccttgtatcagaaatcctagtaggagtcagaaaaggtgaaaccaacccaattttgttggattataatacgagattgggaatatttagagatatgtggacttagttcttcattaaaaaaggagtaaatttcatagaactacggatattttgacaaaactatcacagaactacagatttaaggtcaaatttatcccaaaactacagatttaaataaaactgttacatggtttgcttccattatagctaaagtccgagactctgtgtacttgaactcatgaagccaaacattagattgcttggacatgttcagctggcatacaacttgtctacaggtttcacggaaatgggaatgattaggtttattactctcctgttgattgatttgactctcattttgttgattgcctttttaatttaagtaagattttatcagtatggttgtgttcagttttttactgatgtgacggtatccttcatggaaatcttaaatctttaccagaatactgaaactagactttggtcctccttttggttagtttgtaggctttgcttgttctatcaacaaaagtatatttgctaccagtgactgccttctataactgagtaataacttatttccacgcgctggtcacttggttgtctcctttactttaagttcttcctgcaagatttttttagtatttaatttttcttggtttgcaggatacagctggacaagagaagttccatgcactaggccctatatactatcgtgatgcagacggtaatattcgtcttcttgttttgaattaaatatatcgaggtggatcactaaattcttttttatatcttttgatgactgcagctgctcttttagtatatgacatcacagacaatgatacttttcttcgtgtcacaaagtgggtgaaagagcttaagcaaatggcaaataaagatattgttatggccattgcagcaaataaaagtgacctggttagatcaaaacacatagacactaatgaagcagcaaggtattcttctttgttatcagttacaaatactacacagccaaaatatgtaatattgccctggtacttgagttagcaacttagcatcgttagtctttgagtagaacaaaagaaatatatgtgatatatactttatctgttgattaaactatttagatatatcagcatagtttcaacatataatctgcaatccttttatgattgtacagtttcttgaaaatgcgttcttttagttccatatttcctcttctctatctatttcatctaagtaatattgttactacatgtacatctccagctatgcagaaagtattggggcaactctctttgttacttctgccaaagctggtactgggattgatgatatcttcagtgacatagccaagagtaagtcttattgtgttagctattgctttcaattcatctccacatttttgccactttaacaaatactgctttgccaaaacttataagttgtaacattcagctattccattagaatgcggggtcatcaacgatagcatatagtttagttaacaatttcatgtttcactctattgagcagatttcgtttatcaaactcaattgttattcctcagattaatccattgtataacactcaatatttgcgaattccctcttcatctcaataacaaggtgggtatggacccacatgtcattggtatagaatgctgtattcgaagtggctatgttgtatgtagtttgtctagagctattcttgcaatgacataacttgcaataaatggatatgtatgcattcttaatcctactgattttctggacttgtcaccagggaattcaaacactgctaacatggaactatttatttccttttaagctgttgaaaatcgtatgtccctaactgattggtggttttcttaattgctatgccctcactaccgtttgttgtaggattattagagagaagaaaaaacagctccgatggcttgtcactggctcatccaaagaaaggcattttaatcgtcgacgatgaacctgagaaagaacctccaccaaagtgctgctcatagcgagattccaatgcaaatcacgtgggcataatgtcatagaaacctgcaattgatatgtgaaggatcaaatccttgcattaactttgctcatgctcttttggagctcaggagcaatgcaagtgtatactggttgattatttttagcttgtgtaaatactaaactcagttcatgaaattgttgtcaaatatagttgttcgatgatgacgattcgatatgccgaagaagttcatggccctttgtatatctgtaactcacaggttgcttatttactagctgttgttttgagggggttattttgatcatgtgcgtcgaaataattgtgtcgtgttgactgctgagtgtacatgtatcgtggttattccatctgaacctgcaatgtaaagcttccgtcccaattcccaacttcccaatgttttaggaaagtttcgtctctgtcgttttctttaatccctacgaacaaggatgttgaaatatggagaaaaacgaaaagtccactcttgactaaaacattcctaaagttccagcttgtgcgttaggccatgttcaatgcgtagcccagggcgtaccctcactcacaccgcctgtccgtgagctgtgcctctggaaggaggcgcgacccccacgaggggaacgccgggaccgagcgaggagtcgcgctgggtcggccatggctaggggaggagcctgtggacactgctctttcccccgttttcccctctaccctcccctcctctgctgctctcccctcctcctcggtatcatcgcctcctccgccggtggtagctcgacgaagatggatccataacggacgaccggggatggagaagggagagaaatgggcgctcgcgggagcggcgggagctcgcgctgcccaccagatccagcggcggcagtgtagtgggagcgtgtgctgcccatcagatccggtaaccgtaggcggagggagagagaggcggcgatgatttggggaagaggctgaccggatctcgctctgccgcgtcctcatcctgctcgtgctcca

SEQ ID NO: 19310 - DNA, 4681 bp, Oryza sativa
aatgtgcttcatgtagtatagagccactcataccacaaatacatgagacaaacaccccaatgcatggtgtagttcgggtcatgcatagtaatatgcactagttagcatgttgggaaaaaaacatgtttactaatagcggtatgatattttgggcattatatgttcccgacatgataaaaatatacacaatgtcatatgtaggctgctgtgtaggatggtctttgaaatgtgtgtggcaggatgcccaatgctaaggccctgtttgattcagcttaggattattataatctggattattaggagtaagctgaaacaaacagatagcttattatgatagattattataatctataagccagattactataatctggtaagccactctaaaagtgcttattttagattattgggtgactagcaactaacaaacatataataatccagagaaacaaacagctaccagcttattctatgttggcttattataatccagcttatagtaatctagttctataatctagattacaataatcttaaactgaatcaaacaaggcctaaatctcgcagctaagtgtcgagaatatttttagaaacggtttttattgaaggtctatttgtaaaaatatatttttaaaaacaatcaagattaaaaaaaagaagagcttatcactctccctattttcagttttgaccctctcatggtctcacattgtttctgttttgttcctcaccaatataacaattccttctatccttctctatccctggacactagtgcctctcccctcttctcgactatccatagaaaccactgttggaccaacacctcatcttaggccgtgtttagtttcccccctattccctactttacatcacatcatatcacatcaaaaactttcctatacacataaacttctaacttttttttcaaactcctaactttcttcaaacttccaacttttttcaagaactaaacacacccttagtcgtctagatatgcccgacattacacgctagccctgtgttcggatttcagggatgggaactcatccctcccacatgaaaaacggaaagatctattagcacataattaattaagtattagctaattttttttttcaaaaatagattaatttgaatttttaaaacaacttttgtatagaaactttttgtaaaaaaccgcaccatttgttagtttgaaaagcgtgcgtgtgaaaaacgaggaaggaggggtgggaaagttgggggccgaacacacttgaattaataagcgcataggtagacataacatgcacccatgagcccatgagcttgtcgaaagctagatttaaccatgagctatctatcttctttgagcataacctcacattctcactatgtgaagctaccatcgtttcaatagtcattgctcgcggcctatgtcaatctgttgctcgatcgactagtgttggccaagcaaaccacttgcgggcgacatgagtttaccccttttgacctctttattttagatcgcacttttctcctcaagctattctctctacagaaggcacacttaaccccaattaaaaaacaccatctcgccttatctctcctctacatggtgttagggttcacaattccagtggaacccggtttggattcgatgaaacccgagctttccggaccgtatcgaaaacacaaaccactcatttttcggtcaagttaaaaaaaacaagctaaactttaaatttttgacaaaatttattatctggattctattagtctttgtcggtttaacaacgaattccacgaaatccaattgtaccactcatgagcgggttttgatccgatatcggaattgtgaacccaccgtcttgtcccacgtagctcttcgaggccaaatgcctatttgaaacggtggaacgaaaacatggttttatcaaatttcatgatttatagttttaaataaatatagtagtacgttcatgtattacaacggatatatatatgccattggaaatggcctagatgtggatctagtatcgggacgactcaaatcaagcgttcaattttttttacgttgtttttactgctactagaggaatgtttcaccactatactaaaaatgtttcaacctattaaaatgctaaaacaaattcgaatcaattttgttcacattgatgaaacatcgaaattcaattgctgaaacatcaacatatctgtatgcattaaggaccaagttatgaaacactatctataatcctactgcaacatgtcaaatccaacgcaaagaaacaaaaaataaaccagctaaaacataaaaaaaaaatctcaacacacccattctcgtactcatctcctgcacactcccgacggtgaggcgccagcgtctacacagacctccttgagtgcaagatgaaaagggtcgccaccatctggtccatcagcttgacacgaaggtcgcctcatgctgctgcctcacacaacgtcttcctcaatgctggccaccacgctgccattgcatgttgtcttagtgccggacctcactctccttggagcttgcagcatatgcttggggaagagagagagagagagagagagagtgtgttgagtggaacaagtggatgagaatgatagatgatggatgagggagatgaggctggctggagtgcatgaagagataaggcctctcacagtgcggtgagctggaccggtgctacacggtgccagctcggattgaagcatacgtggcataaggaatcgcaccctagcagagctcctcgcccccaagcagagccgcgcgaaaccttgccaaaacgagggcgcgataaggagaggaagacgcgaggcgcgcacgctgtggggtgcggttcttggccgcgccgtgccctcgcgccgcatcgagtggagaaaaccctgattcgcccacgattcttcccgccaccgaaacaccccaagcaagaacgcagaaaaaagaacttgatctatcccaagaacacaagaggaatcaccaagaagcaaaagaaacaaagaaatctcgatccgtcccaagaacacaagagaaatccagggcccagatctcatattaaccaatgaacaacacatcccacatgcacaaaaaaaacaatcaataatctcgccgccgcgcgcccgtttcctcctcgccggggcttcccgtcggcgtcgcgccgtccgctcccgcccccctccccgcggccaccacatccgctgccacgacccccaaatccagcggcgaatccgcggccccgcgccgatgaccgccagcacaactcggatccggacgagccaagaaccggcggccgcccgggcaccggcgagccgccgccaagatcaagggagaggaggtgctgatgagcctccgaaagaccactgaagttgccgctgacgaccgccgcaactccgaaagatcacgccgccgactgctgcttgggagaagatgagaagaaggtggcgcggcggcgtgggaggcaaggaggcgcggcggcgtgggagaggagaaggaggcgcggcggcgtgagagaggaataaggcagaatagtttgaatggtatgaaaggagtgtctgaaaatttggttatttaaaagaagtgtatgaaaatttggtttgaaagatatcaaagtggcaactaaaggaataaggcagaatagtttgaatggtataacaatatatttttggtaggtgtggtactagcgccacaaatcaggaaccagtctacctcttattaacctaaccttcaggttaattggattatgctattataatttttgtgatttggaaatataccaataatattcaactatttagacttatgccattacaatttaatagttatttgatttataccattacatacccattgtattttttaagatttttagaccaaattgtccttatcttctttctccatccctctttcctgttcattttctccccattagatctgacagagcttatgcatatgtgataagtgataatgtgaatcgaatgcgagcatgctcttgccggtcgttggctaacattcgttggagggatggatggcggcacggcgcgaggtcagcttggtccttctcctcacaacacctgcacactgcgtgggttgagctcccctctcctctacccaacagcaagccatcaccacaggaatggattcattggagccccaaccagcagcagcaactgaaatggaacgattccctgatcccaccaagaaatcaaaccaaaaccattccccaacaaaaaaaattctccaaaatagaacagactcatgctagtgaccaccatcattacaacggctattaggcataatcaagcaagtgagcgaaccaaacaagaggcaaccaaatgcccaccaacactagaagcagcagtgctttggcgacaaccactaccgtgaagaaaaatggtaatttagttcaaaaaaatatttttagtgtagtgaagggatgagtagtggcatgtttcaaatacatgctaaattgtaatggtatgacaccaaatagttgaatagtcgtttcaaaaccatgaaatttgtaatgtcatgtatccaattaaccctgatttttagcatcttcgaccttggttcacctccaaaatgaactggcgcacgattttataaatgggagttcgataaaatattctatttataaataataaattatctcattattatataaagaaacgt

SEQ ID NO: 19311 - DNA, 6587 bp, Oryza sativa
ttatcatcaaatccaatatacaacgattatttggatgattaaatgaaaagggaccacctaatcgttaaaaacaaagttttaacattcatgaacgataaatgtacaccgtatcacgttaacgaactgttatactaccgttaacgtatatacggccaattaatcgatcggtacgaccgttttccacgatactgagtaccttatataaatcagcaaaaataataataattatttactcatgtaaaaacaaagataatatatattacggaggacacacatgagctagctactagtattcatgtgcaagtaatagtgctgattttagcaatattattatcgaaaataatgaaggacgagaaaacaagaagatggaacaaaggaagaatataatgttaaagttttagtttcacaccgtattacgacaaagaacaaatttaataatattagtatattatcgattaatatgagtataacccataccatagatgtggacaacgttttctctcgtgtgtttgagctagtgattaacttttcctttttcttaccttctattgaagttctcctaacatgtttaggtaagaaatgttttagtttcttttttgagaaaatccattatgtgccattgactttgtccccaatatatgtaaaatattagtccaaataatatattaaaaaattgaaaaacaatatgaaagatttaggggaaataccaacatagttatatatatatactaatagatagtcatcatatatcatgtagtgagagaaagagaccataatggaatcctttattattgagcaaaattcatggtattatatttttatcttttttgagttgaatatatctaaccataattaattaacaattaacctgtgttagtagaagtctgtatcgtcatgcgtcaacatatcatgatattattagtaatggctaagtagatcgacccaaccataaaagtgcagagacaatgataaaactgtagtgggcttagcatagcacgagactatcatctaatggacaactcatcttttaattgtgctagaggaaaacaattagattacagtttgttctatgtaatctttaaccattcttttcatttacacaagagctaaatttacatttcaattttcaatttggaccactccattatatccatctccaagtctggtgactccagtcactccaccacagctctatctccaagtccagtggctctacgacaactccacacactaactctctctccttgttgctccgataaaaaagggagcccaaatctagtgtctctgctctctgtcgggttggttcctgcctctcgagtctcagcaagtgtgtcacctctggtcccaacgacaaccattacaataccgtgcatgatgatagcggaggagaaaagacatgttgatgcctaaagggtgcggctacacatgcgaaggcagagaagaggaacgatagtggcttatggagaaagaacggtgatggcagtgcatggagcaataactaatagttgccggtggtctaaaaaatttactatcaacataatatgtaatcgagtttattataaatttttaagtaccgctgacatgtggatcatccatcatcataaagaatgggtaacataggaaatttgagagaagttggactgctaagtgtcctccctccccttcccttctcctaaaagaaaatctcctgtctcagtctcctccgctccttgcgccatttcgcagcttgaacaggggaggggcgcgggcgccgagctccatctggcgagcagggtaggggaggggaagggatcctggtgtgcatctacatcctcattctgattcatctctctcccgacctatttttgtcttgaatctgtgcttgcgttaaccctagcttcctcctctagatctggaagaagctcctctcttaatttcagagtcttaaccttaatgcgagtagcagtttgtttgttcccccccaaaagtttgggggtttaactgaaccccaatgtcccaagttggatccgcccctgacgtacaattgtttgctaatttgaaataggcatgtatgcttataattattccgcataatcaaaacttgtgaattttaggagaaaaaaaaaggggcaaatgaatcctgtatttcactggtcagaaatggttactaatgtttttccttgatataatgtttctggatatgtatccatgcttaacaatgtgggtcagcaatattgaactatgcaaaccattactctgtacaatcttttcttttcaaatgctggccacattgcgctcgagcttactgctcatgtgtgcagctcatggaccctgagatctagacgtcaacgtgcttcctggaaagagagaggctcaggcatgagagcatacctctaaaataatgtccgtgcttacctatgtgcttgataacataggctcatcctgtagcagatctcattctttaagtgaggctgaaacagccgaaaatgcaaaagtaagttggcactcaggcttactgaacaagtaaatgctaactcaattcttgatttgagagttgccacatttgatttcttctaattcagctggtaacagtctgcagacattgacaggtgaattttgcaagagacaaaagcagagcaacacatccacaagctcttacttcttggtattgctaactttcccaaattttagtggtcattttccttgtcacaattatctgcgctacctttagtatctattggttcagaaattaattgtttctgttgttcctatttacctctataaaaaaaacctttctcatgttatttccaaaaaaaaaagaagataaataaatgtatcctagaaatttttagttttaacttgttctcaatttggatccatccttctttctctctctcaattgcttctgttttaaggtgcgggagaatcagggaagtctacgatatttaaacaggtgatgaatgctatattccatggagaatcataatccgtacgccactagttagtctgatgtattcttactgttcacctgcagattaagctccttttccaaactggctttgatgaggcagaacttaggagctacacatcagttatccatgcaaacgtctatcagacaattaaagtatgcaatactggaaagggtgtgtcttttttttcttattgcaaagtggggattatgtaggagattcgactagggatttgtattctgttcataaggaaatgcgttcatacttttcctttttgtcgagtaatgtgttaaatgttaacagatactatatgaaggagcaaaagaactctcacaagtggaatcagattcctcaaagtatgttatatccccagataaccaggtttgtgcttactctttactcaacagttaaagctaaatctgtgcatatgaacatgtcttgttaaatctgggaatacaaacattttgatttgcaacatttctgttgtagtcaagctgctcggctctatgttttaacctgttaagaccttgtagactgtgctcggctctattgtagtcttatgttttacacggtcattctataatgaaaacttgaaaaagatatctattgaaccgtacaatgtactgaacaaagtagaaaagaacaatgagattttgtaacatttattcttccttgtttatttgattgcttcagacaattgttgatatgctaaaaataacttggtatcaaatgtgggtgttataagattcaatttttttctcaaccaggttaaaaaaactatacctttgtgcatttaccttgttccgttgctttggaacttttaaggaaaactgacttttcttagacattgaaagacaaatatcaccagtttcacactgtacaccttaccaaccaattttggttctaagatgtcatttactttgtcatatcatcacgaaattggagaaaaactatcagatattgatggcaggttggattatccactgctgaacaaagaacttgtactcgatgtaaaaagggtatggcaagacccagccattcaggtgaaaacaaatagccattcaaatcttttgaagttatatagttttcctggccaggtgtgctgaagcaatgctctatattgtaggaaacttacttacgtggaagtattctgcaacttcctgattgtgcacaatacttcatggaaaatttggatcgattagctgaagcagattatgtgccaacaaaggtgtgctgtccatgttcatagacaattatttacatattctcagatatatgtgctgacaccatttcatgttgatttttagtctacttagtctgaggttgtcaactggttaactatgtgtactgagtcaggggttgccaaatagttttaaaagatgggcatatgcttatccttatctttttaaataatattaggggctaaaattcaatattagggaggagaaactattattctaccattattacgcagtctacattactaaggtaaaaaatgtccctgtgaaacatatggtttaaaattgctgtgaataaaactctagcatattaatcttatgaccctagcatatatatttttgttcagttccttcaataagttgcaaaacacaaatattatcattgtaccgtcctcttttgcaaccatttcccgtcatttcttaagcatagggaattgcttgtcagttgttcaagtccacactgcatcaaaattccaattaactttgtggtccaaagcttagtctcccggagtttgtgatcatgcaacatttcttcggacgattcactgctcatactgttgttttccttgatatggcagttggaggggcctttatccatagaaccatcgaggaaggaaggggaattttggtgagaatatccgtcaattaaacaactgaaccaccttatgaaaactcaataaccaaaacacccttagctccaccaagagatagccaattcccctcccaagccgataccgccaaaatccttatttgatgaaccatttgagccgatcccaacagacttcatgattttacaaaaaaacacacctcctctcctttatgaacccatcaaatatatactatgtttttcccaagtatgtaaatgctcagttgttgcccattgaatggagtgtacatcaattagtgaagatcgtgcctcaagaccacgactctgatgaattatggagtgcaatacgtggtgatgattgtgtcgagtatggatatgttcacccagagtgccgtagacaatgacctaaagttgatagtgtttactctatggaagttctcaggacaccagatttgacactgtaacatggatttttcgacaacaaatgtgaatgatttatcctcgaagtgtagaaatatccatgctatcagaaataacttcaagtgcaagtaatatttgtgccaatatttatgagagctttaaccattctataccattatgccatggcaacattaaggctccatctccaggttaagctattgcattgttgctaggaattatcagcaaacaaattaagtgatggagggagctccatctccagattggctacaagaggaaatgctccgaggtcaagctattgatccaaaacaagcacttccggcaggtaacccgatgtttttgtttatttccattatcgcatttgaacttactttcatcgtatatttcatcttccaaataaaataaagaggtattttcaatcatgtaatggaatcaaataaaagaagattatgtttggccccggtcggccagataacccgttggtcggtgcccctgtatgttgtaacatttgtcacatatttacagagtcaaatcaagggattaaccagcctggcccatcattgcacagcctagacaaccatgtcatagcttggctgagcttgtcgtgatttggccaatcgtgccgttgctcgatcggacaatgactagattgaccaatcaccaagttggcctgctaaccatatccttgcccgattgaccgtgtcttaggtcagcaaggccgttggacctccccactagttcgaccagccactccaagcccgaccgaccttacccatcagctagccgacttgaccgttggcctactaatgttgcctttgtctggctagctgtgtatagagcatcctatggattgtccaacctcatcaaagctcgatcgtccatgccatggattggctgaccttgttggtgcccagaaagtcatgtcttaacctagcaagccatgccaaggcctagcagcccttatcagagattggcaacccttgctagatacttggcaatatctacctaggtccaatcatcctggtcattgtttgtcaatcatgtctaagcccgagtagatttgtaaggctcaaacaaccctacaaacgtccagctggtcttactgcaactcgattgactgccaagttgcggctagcttagttaaggcctagccgagcttgccaagccttaccagatacatggcttggttggcgtaatatataaaatcattgaaagtacactgaggaccgtagaactcgccgggggcaggggtgaataggaggaaattataccttaccaaacaatccggtgccattgtggacagtccgacaatgcacaatgttagacaatccgatagctagggataatgagccctat

SEQ ID NO: 19312 - DNA, 2242 bp, Oryza sativa
ccctccaatgaatcttgctctaccaagcatccaccagtatgtagcactacttccactatgacttctttccttgcggaggcaaggtatcaaccttcacaaacatctccatggcacatcacactccacttggttggtcttgggtttctccttctccttctcttaattacaacctcaagttctccaacttgaagcacacaaactccacatcactctcaattccacactctagctacacttgaacacacttgagatggtgggagatcttcatgcggcagtcttgatcttcttccttccaagccttgcctcacacgcttcttcgacaacgaagatttatcctcagcaacttgtgacttcttatgacctcgaccggtttgttggtgttgcatagagcactttctccttcaccacttcatcgagtcctccagcgctaagcctccacttgcccttttcctctacatggtctatcgcgtagccaagtcttgccaaccctacattgcattttgcaccttcagtcatttgtagccttgtatgacaatgaacctcacatacgaagtagattaattaagacatcaatctaccaagtgatatggtattgttttctatagaataatattttctcgtagcatgtgcttgtgtcataggtcagtttgatcgataggctattgcatggggacacgagacatgtctcatgcacgtatgtgtgtgtatcggttggtcaataccaatcctaatcggacatgtggaacgaagcatgtgtagattgactttgtcagcaagtcagattttccactcctcgggtgtgtgtcgtgctcgagaccaaaaggtcacaggaggttgcacgaacaggcagaggccagcgttctggcgttccctactaaactaatggtgtaacaccccggaaaaccacataagcctgggatgccactaaacaaccatacaaaagtgccaaaacaagcaaatttcggcaacaactaccttagacaagaaaacatcacgaaagcatcaacatatagattaagtttatgatacatcaactgactgacatatagggatagcctttgaaaagtagttaaccaatggtcaacaactctagtatttaattagctcattatgtctaaacacaagaaatcttatcagcataatacaatactcatgactaagtgagatcatgttgtgtgactgtgtatctaatcccatcccttcatgcaaacatgtcacagcgagtacctgaaaagactataagggggtgagaataaatctcagcaagcaaacggctttaacaagctatttaaaccacatgtttattatatactaattaaataccaagttatgattcacataaagaaagttcaatatccaaggactaaaacatcatagcgtcaccaatcaaatccatatagtcacaaatcccagagaagaaaacacttctcaaagatattttcgatcgataattctcataacatcctgcaatatgtgcatatgcaatgcaatgatatgtactcctgctttcacacccaacagggtgaataagtgcatatgcaatgcattgatatgtactcctgccttcacacccaactaggtgtgaagctacatcgtattacagcaatatacgatgctgtaccggtacggtcgcaaccataggttcacgacatgacttcaaatgcaatgcaagtgatgcaaatgcagtatgaattccagagtataacatcggaaccacattccttcgatggagatcagtataaggttattataaccaagagcataaagtatatccataaacagtgtaaaatcaataagtatgatttagataggtaaatcctcggtgtaacatataataatcttggttgatgatatataatttcaacgtggaggttgttggtatttaatacggttacggataaaatccgcaagcgcacggatatacagatgtagcacttcccctacggattattccaagggtatcgaatccaagggaacgtgtgtggtcagatcttcctccggttcatccaaggacaccaagcaaatgataggccgggatagagaggattcactagtgagaaacagtgtctagggaaagtttaactttaatcctaacgcaatacttcaggcactggcaacccgctgttcctagatgtcgctctactacgtacctggacagggaggacttaagtgatctcgagggctgtcaccacctctacacctacctcaaacgtactatgggatacacaacaattactggata

SEQ ID NO: 19313 - DNA, 697 bp, Oryza sativa
aagtgccctccagcggtcatcaggcatgcatttggtacgtccacgccaaaccccacatgcaacggtgaaagtggtggttcgcccgaccagggggtcgggccgaacctgggctaggccctcctggcctggccttcggttggtggactccctggaccttcctctatccatttctcggagttttggattgatttaccgatgtttcaacgaagttctcaacccctccttgtatggatacataattctcctcactttagtctgattttcctcccaacttcagggtttatcatctgcatacaaatatacaccaacactgatggaatatgtgagattaagcacctatttctatgttggatgttttattatatcgactttatgcagatgctggcggtatagaatcggcatttaacagccgccaacagaggtagaatcaaataacaactcaaagctgtagcaaaccaccgctacgtttacttgccttcaccgatggcgagatgaactctagttgcattccaaagtggcatcacctgaataaacaccgactcagcctcaaactacacacatataatcattcaagaatcacacattcactttctacgctgggaacccaccccaaacaacataaagaaaattaccgataatcttcctataaaagcaacatatattaacaactcgatacctccaattctacatcacataa

SEQ ID NO: 19314 - DNA, 723 bp, Oryza sativa
gcagcccgggtgatgatgtgatatttttgcatgttaagttttaggaattagtgatagtggatgatgatgtggcatctttgcatgttaagtttgcaacacgttcgaggaggccgctgccagggtcctattcaatggcgaattgcctgagcagcgagtatcacctcgtcaagccacccttccgcctcgaggcaccagtgaccaccgtgaccatctaaatggccaccgagaagcacgccgcacgcgagacaacgaaaatcattcctaacatcatgtctcttcgcaacatcgcgagaacgaagaacaacgaggacatccgagcgagaaccgagaccttgataatcgccacaaccgccgtgaacacgataatcgcgaacagcggatgccaggcgatactggtccaggtcgccgccgtaacaacgacgacgacaaagatcaacatcgggacaataacggcggacgacgacaggattctcgagaacccgtccgccatccctgtaatcgtacaccggaaccgagtgactcatcgtcatcatcatcatcatcatcgtcttcgtcatcagatagacacccacggaggacacatgatcgccgacaacccactgcccaggcgacggatgtagagctttcattcgtgccctgcgagatgtccaatggccggagaggtttcgaccgggagcgatagagaaatacgaccgaagcacccaccctggaagagtttcttca

SEQ ID NO: 19315 - DNA, 2154 bp, Oryza sativa
ctaatgacggattaattaggtttaataaattcgtctcacagtttacaggtggaatctgtaatttattttattattagtctacgtttaatacttcaaatgtgtgtccgtatacttcaaaaatattttggccaaagaactaaacacagcctaactccaaagtttgcaattaatttggtgttcaattaaggaaatttctgctcactctttataaccaattctcaagctggtttttatccaaagatgtttttcgacaatgcaaaaattggaaaaccacatatgtttgaaaaagcaaatatgcaaatgaaaatttggaaatcaaatatacaatttggaaaagtaaatataagataactaccgattcacctattggcaaaggactcaccattttaagtccggtgagcagggcttttctccatcatgttcaatttcccatcgcggcatccgactccagagatgatgagatggatgactgttgttctttcaatcgccacaccttcttggtcttcttttgttttaccgatgtggtcgattcaacggacttcagggactgtgacttgggtcgtgcctgttggtatttgttacggtcacagataataaatccacaagcgcacgaataccgatgtagcactttaagtcagagtattctaagggtatcgaatcataaggaacgtgtgtgtataatttaagaacaggattcatccaagcacaacaactaaatggtagggttaggatagagaggattcctatgggttaattaacttatttaagttaaggtaaaactttatcaattgcttcggtcaccggctctcccctggtccgccaagttgagtccgatttgtagctttatgatatacccgaacatggaagaacacgaaggatgtacagggctatcaccatctgccacctacctctactttgcgtggagcacacaataaacaaaggtaacctctaacctagacatcacgtctatattattgattactactctagcctcggccaagaacttccttctttatctagagtcttagtaccagagcactcaatataaatactaaccgacgaacccgcaacaatgagaatctatcttacttaaacaagaaaactaaatacccaaaagaaatcacaaatacttatataaaagaagcatctgtcgaggtataagatcggagagagggccgacaactccggtgctcctctaggactccttaggaaataggccaacatctctggaacatctcaaagagaactccgatatttggggcactaattctggaacttcccctatctctcttcctatattctaactctactatcgagtagcctagatatgaaagtgagttgcactccacttgttgtgttgtgctttgagagtgaagtgagaactcattttaaaggcagcaatgatggttactatggcggttatgaggtcggttcacccacaaccaccacagggaaccaatccccatcctccacgtgaaaggtagggatgagtggctgcaaaggtggttcggccgaccccctggcaccgccatttcccctctccttcggctggatcaccgtccaatgggcctttatgactgtgcacagtggttagcctattttgaggtgatttggtcagcttgtgggccctccaatacgtgtactcgcgtctgattggccggatgtgtgtttcttcgcatggctggtggttttcatataaaatccctgcatacacatatttcaccaatacctgtggaaatgattagtaataaccattaccacaaagtttgatgtattatttcaattgcttgtatgcaggaattaatggtcggatttggtatttaggctgtgtttagatccaaagtttggatccaaacttcagtccttttccatcacatcaacatgtcatatacacacacaacttttcagtcacatcatctccaatttcaaccaaaatccaaactttgcgctgaactaaacacagccttaaggactgtcaacagtaccccctgcctcttgggtgtcttggtgttgcggtattggagagggggttcctggatttttcacattttggtccttttgaaaaacttattttgcaaatagacccctagaaaaacttattccaaaaatggtcctttttggggcgccagagtggctagcgccgttgtccaacaa

SEQ ID NO: 19316 - DNA, 1541 bp, Oryza sativa
tcctcctgtcacgtcggttcgcgtgcgccccggtggcaggaggacggcgccagcctccgtcccgttggatgacggcgccagccactctggcgccccaaaaaggaccatttctgggataagttttttcagggatctatttgcgaaataagtttttcaaaaggaccaaaatgtgaaaaatccaggggggttccctcttcaacacctcttccatgaatacgaaggatggtggaaaggcggtgcgacagaggagacaggcagcgataggctacaggccttgccgggctatcggtgtggggttggtggcgtagagcacgaagcagcacggcagccaccgcgatagcagcgaggacggcggtaccatttctagggcagacaagaggggccatgatggcctgcggtgcagtgccaacggcacagctgctgcccatgtcgtgcgcaggaggggcggcaaaaggcaaggtggccgtggcgttagggcagtcccaacccataacactagacatggtttccataaactccacatcatcaagaaactagtactagacactactcttccaatgcaaacaccactattccatacttcaatttaatgctacttatctcacatgatgtcttggatgttgtgtagaaaccatgtctcatgcaagacatgatttccttctctttcctcatttattaacttgccacatcatttttttgtcctaggtggcaacttatttaatgctatggacaccatcctagtcattgggttgggaatgcccttagaaccacgcgtggcagagaggagacggcactaccgacaaatggggccacgctgtcggcatgcgcgcagcgcaattgggccgtgggccggcgcggcattacatgggaggctgggccgggagaggggaaagagggaaggagagaaaggaataagtttactttaggtcccttaatttgtcgccgagtctgattttcgtcctcagtccacaaaaccggatataacgcattccccaacataccaaaactgtgcagatgaggtccctcggcggtttggaaggcggttttagctgacgtggcacctacgtggctggtttgactaggtctccgtcccacgtggcattgatgtggcgcttacgtggcaattatttctcagaaaaataataaaaaccatggccccacatgtcagctgcacacaaaaaataattttaaaatggtgggccccacgtggccccacaagtcattctctcctctgtcggctctccctcttcctctccgctctccgtcgtcctctcgacagagtggcgacagcgggcagagtggaggggcgggcggaacgacggcggcctcgccaaggacgccgctccgccggcggcggtgcgggcaaagcggaggggcgggtggagcggcggtgacctcgccaacgacgtcgcgtgtacctccgacgcgagaagagcggcagcgcacgccggccggcgggagggagggagggagaggaatggggctctccctcttcttcctctccgctcttcctcgtcctcacggcggagcggcggtgggca

SEQ ID NO: 19317 - DNA, 5136 bp, Oryza sativa
  unsure (1)..(5136): unsure at all n locations
accgcccgccgccgctccacttccacccgcgacccctttgctccgcccaccgcccgccatccttccgcccgcagcccctttgctcgccgcccgccgcccgccggggtagagagaagagagagatggggtagagagaagagggaggctgacatgtgggaccacatgggctccaccttttctttttttagctgagatgtgggtcccacgttttttattattttcccgggatccatttgccacgcaagcgccacgtcaacgccacgcgggacgaggacctagtcaaagggagccacgtaggcgccacgtcatccaaaaccgggcacaatacttccgagggacctcttttgcacggttttgtaagttgggggacccgtcatacccggttttgcgatgaagggacgaaaatcggactgtgcgacaaatagagggacccaaagtgaacttattccggagagaaaaggggaggagttgggccggctgtagagaaaggagggggtgcggcccaaaaggaacaatagcacatgggaattttcgagagagggtttggaaagaaaattattgatttgactttgaattttgaattcaaatttgtgatttgaactcaaggaagaaatgggatatttttgagaggataatttgatggtattttgggaaggagaatattttggagggattttgaattgtaaaattcaaattccagggttcaaatctggatccgaatttttgggatgagatctttaggtctcaagggcagggattttgagatttttggcacttagtccttagtagcacacaaagaaccaaaaattttggaattaggatttgtataaaatagtttctaacggcccaaaaaatcggagctttacaatttcaggggaaatcctgcaaaaaaaaatgtaaccgtgtttacatgctaaaagttgggtctgaaaatttctgtgcactaatcttaatcatgagaaacatcacaagacatggtatacaaattttcttgaactctcactactcaatatcttcccctggatgctctcagctcagtggattaattgagataccgatccaattctcccttatttctgatacttgtgcataaggattgcgacagcatgttttgatatagttagttgcagtgaaacagcaagtgggacttgcaaaagtaaattcatggatatatatatatcctagccaaaaccaaaagatgaaaaccaggacttccaaccatcacattatcaccgacgatgatacacagagttaataacacatgcatatgaaactaagaacctcatgcgtttctgtgcagcatccatcctctgccttgttgctgcactattctgcaggttacaggcttgagctcttagcagttagcacgatgtaagatataccagcgacgagtctcaaaaaggatgatcgcaacttacgcaccttgatcgtttctgaaactgcgtaggtacagatttttaaaaagactagcacactgggcatggacgcacggccacttgtgttcgtcttccctgcgcggcattttctttttttttaccaattcaccagaggggagagattccccacctgaaaactttgtcattatctaaaacatcaggaaaagttcattacatagtactgagagtttgtagaggggtacagaagagttctttccaagtcgaaactacaggtctatcggaactcttcagtctttcagcccataggccggcttcgtccacacacttccttaggcatctgctgagcgatggagtttgatttctgaagcccagaagcataggagatagaacagctgaaaatgttttctgggcagcccttgccccggcttcaataggtgcagcatcttcacatcttatatcgtaggatggagccctatcttgttccagaaggttgttgcaaaaggacattgtatgcacagatgactagccgtttcagccgagctttcacaaatggcgaaaaccgccgagctgacaatgttcttcttgaagatattttgttttgttgataaccgctctctgctaagaaaccacgcgaagatttgaactttcatcggggctttgcttttccaaatgaaggtccagtttggagaggtttcgcccccagttagcaacgcatcataaatctgttttgtcatgaggtttcctgccaggttgttcgcattgtatctttggtctgcagcttgcgtcagggagtggtaatgtagcaggtccagcaggcagcagcattgccctgcgcggcatttcatcaaacaggcaagagctcccagccatggaaacctcccactcctccgctcttccccgtgcgagcagaggaaacaccgcaggactttatatactccgcctgaggactcttagagcctatggagacggcggacgatggccggatcccggagcggcgcgcgcggcgggggcagttgagtttcttggctgttggccggggaaacacgtcctgcgagtctcgcacggagcgtcaatggcgtgattaagcagcaaggaaattttacacgatcgttgatttacctccacgccgccgcctcctctgctcctcgcctcctccccggccggtcgccgcggccatctgcccatctccacgccaccgtcgtcttccccgccacgcggtaacaaaacttttctcgaggcgaaatcaactcacggcgttaatacttaatagtgggccggccaaagtacacgtgattttggaacaggatgccaggtaggaataagtctatttcgtgtcccttatctcttgccgcgggttgaattatctccctcaatcataaaacaaagtataacgcattccctatctctgaaaaccggtgtaaatcgtctcttttgattgttttggaagtgattttgtcctacgtgacgctcattggacccacatgtcagtgaaaaaaatgaaaaattaacagccccacatgtcgatcattctaatctctttttctttctcacctctctcccctctttcgctttcctattctctctcccagaaggaaaaaaaaaaagaaatctcaccacattagcagcaaaagatttcctcgtttgtcttcataatttgttgccctgggctcggttatgccaactacaaagcaaacgctctgacatagttcgatgagtgaaatacaccagcagttgctagctccgttgtctgtgtaaactttagtttacgttcctctctgaaagatttaatcttttttttttgaaaagaatcagcacgagattgtgctatttcattggatatagaggtaaaaaaaatacagcccctagagacaaaagggaaaactgaacacaaatacatagaggctaatgctacgaagggaggaattctccaagtcgccttgcgcctgccatgatccaggttcttgcctcttcctttattttcgccataagattgggagccgttgtttccttgtgctcaaagatccgttgattcctttccttccagatttcccacacaatgagcagggttaaagatctcagtcctttcttaggcacttcctttttgttgtttagcatgtcccaccactcttggatgctttggcatgggtcccaatggttcggatccaattgctgataggcgacccagctggccgttaatctccaaatcctcctggtgtatctacaaaaggcgaccaggtgacatgccgtctcgttcgtctcccgacataaggggcacagaccattattttgccatcctcttgcagctagccagtaagatgtttaacccaaaagggnaaatttgggtttcccccaaactttgttttgtatcacaagccacaaataaaatttgcatttcgcaggggcccaagatttccaaatcaaggaattgtagttggtgccgacatttcctagcaattgtgccttgtaggccgaggaggctgagtattctccatggttcgacagcttccaggtgatgtgatctggttcatcttgatttagtaggatgccctgggttgcactccacaaggacacaagttgtcttattacgtccactgtgaaggtagtgttcccgttgagcttaagatcttcaatccaggtgtcattttcaattccttcgcgcagcgacttgcctcttttcttggagattgcatagactagcggcatgatgccttttggtcgttgcccatccagccaggcggagtcccagaatcgtgccgtgttcccgtcccctactgtaattttggtagctgcggcgaagaggagtttgtcggtttcatcacacggtgtctctagacacacccacggtttggttggatgaaagatttaattttgaaactgatacgagcttactaatcttttttcttttaggatgggatggctatactcagattcactgaaagcgactgaacacaaacaaaaaaggttctggtggagataccagcttacaaggaaacatcaacttcagaatgcaaaacgccaaaatgcatgcgggaagtaaaaataatcagaactgtcaccaacatcaccccggatttctagccatcttcaaatttctttgaatttctcgtccttggatggcttcagagcacagcagcattgctgcaaaaatgaggcaagtttgtagcaaccatatgtgaaagcaacatcattttgaaaataagagtgctgcagtactgtgggaagttcttcatccttgaaatttgcacttgcatagcttaaactacctttaaagcttaaggtcccttaaacctgctgctggccggtgaaaatgtcctgtatcttctgccacctgcttcactggcaggtgaaagtccaccataacctatactgcctcttttactgacaggcgaaggtgaaaatgccgtgtagcttctactgcctacttcactggcaggagaaattccgccataaactgtacttcttacctcactggcaggtgaaattccaccccggctcatattgtgtgcttcgttgacacgtggaagtcccccagtttgcttcactgcattgtaggcatctccccaataagtttcagtgaaatcacttcgcgagtcatcttgaagcagatctttttccagagatgccagaaactcttccatggtgtcacctgcagatgtgctaacctgtgacaactgttcttctgatacacgagaactgtcataaaaataaatttgttaccatcaggcattgtgttgtgctt

SEQ ID NO: 19318 - DNA, 3352 bp, Oryza sativa
agtaaagttgagcagttaagttttcctttagaagataccatattatttaaagaagaaattaccataggccttcacgttttggtccaaagtatttggatggaattgggctttattgagatattttccatgatgcaccagatggcagtccattatttgttgaagaaatctgctggcatgttgcttggatagttggatgtcaatttgttcagtgtgattttcagaaactggtaaatctgttcagggtatcaacagaagcaaggcataaatcaggaagcatttgacatgaagtaatttccacagcaaaccatgaaggagtaatggcggcaattaagttactcaaaagaggcaagccagacttacttgctggtgctggacttggttgcattgagcatgatcccttaaggtaacaattgccattgctggtatgaaatgattcatgttcttgatgaacattcatttcttcagtgtagctagagtaatttgctggtcttggcttgcatttaagagcatggttaatgatcatgtcccaatcttgatcagaaatatttcccaaaatctatacaggttattgtggcatgttacattctataggagtacagaatagaaataaataatgaaattcattgcgtaccttacgcaattctttgggatttttatggaagaagcataaaaaatccccctccgtcttgatacctttatgctgtagtaacttgtgcctatcaccattcatggcaattcgagtcagtttttatacagcatcacagggagaaggatgttcactcttctttgttgctgtacagaaagacgccaggcattagatgtagaagaatgagacctagtagacatatgaatcagttattgatgaaaaggttcggtttaaaaggttgtgttcacacctagcagaccattgccaggatgcacaaaggaagatagtttcatacgtttactgatcaaatttaccttacataacagaacagttcttcaaattgaggattgtggcataataaatgatagagaagcctccacttttctagtttagggcctcattactaaatgatgctggatgctgcgggtttctcttttgagtatggctgtttaagagttaccggccttttaattaaaagtaaagacgctatgaggtgtaaaaataagtatcatgttgaaaaggcgttaggaacttgaatataacaatgttttgcacttgtcctttagctagcttatgcaacagaagaattttgttagagagattgacagaatgcatatatgtaatgagagctatttatatgaagagtaatgtgtatgattgtctaaacttttggtgctaggatgaaacttaatattacttacagaatccccggccatcctttacggcaaaagattcagatattccttcgaggattttttctgatatgctatcatcagctgccatgactcctaacctgaactgcttgcttggaagaaaactcgagttatcctggaatttggcaccatagaggttagccacaccattttccagccttagataaagttcgttggcaaacaaaggtagttttccaggccgcccatatactatgttctgaaggaaggagtctctattccactgcactttattgtccttgttaaactcgccattcatgacaacaatcctaacttgcattgaggataaaggtccatttgtgataatcttattatcatgatcatatatggctactttgataggactgccgtcatcagctgttatgacgtgtctcgagaacttgtcgttgcaacatctgttctcaaatttcagtcggtgcgttctaatttctctctgataagataagccccttaaaagttatgttaaatgatcaagtatactatgtccaaaattttaactaattagaatcacctacataaagtctactgagtggcgagcctgtgtacgagacgggccaaagatttgatacttcaattttctagaacaagagatttcctacctgtgattagtgtgtttcttaacatggtccccaggagtacttgtgtcctgtcacagaaacaaatttacaatcattagtcagaaagagcaataaataaattcagctcagcaaagatgctaaattcttcaaatgatgagattgttttttgacagtgaaacacggaatgacggaaatgcctttcataaggattttttttccttgactcagtttccttgaagttcccattttgttagtataaaaatgtcaaaaaaactatcaagcttagttgctattatatcgggttgtcctttggttcatatcattagttctgataattgtagatattgctgttttccgtagtcttcagttcagtgaccgagtgactttggtaggtttgtagcctttggtgttaccatgcattctcacaaggaagtaaagaactaagagtactaagaatataagggagaggacctagaaaattttcagtcaagaatagtcgaatctatcaaaacttgaaagccaattatgaagcttccaactataaagattaaacaagaaagtaggtgtttaccgaaatcaaggtgttgaactgcccccagatctgttccatcctcctctgttgctcactgatctgctcattgagctgcagctgggaattttggtaaaacagttgcatctctctctgtaagactttgcgctcttcaatgaaaccttttgacatacattgcatttctttcttgagtatttcaatctggctcttgtagaaatcttgtgtctccctatcatgcacataaagaagaagaaaattctcaaataagaaaatggtctcatcttattattccatacaaacttgcaagaaaagcataaggccttgttcgtttcgggcgggattgtggcccaaaccccatggatcagcctggcatgggaaaaatcacggcctgcatagaaatgtgtgttcggttaagcctagtcgggattctaacccagcccatcctagccttttcccctcaccccggcctgggaaaaaaataatcttatccagaggtgtggaaaaggaaaatgtatacgaaggtccctcaacttgtcatcgagttacaaaatcgtcccccaaccgcaaaaccagatatatgacatccctcatcttacaaaaccgttcactttaggtccttcggtggttttgaccccggttttgtccaacgtggcagctgactcagcgtgggactcacgtgggccccacatgtcagtatgccacgtcatctctctctcacttttttcctttgagccagccgaccggcgggtggtgtgggacgaggtcgccggggcgaggcgggaggggaggaggtccggcaacttggcggtgggccacaaggaggcggcggcctccggtttcccccggc

SEQ ID NO: 19319 - DNA, 4985 bp, Oryza sativa
accccacccgccggccggttcggccaaaggagaaaaatgtgtgtgagagagagaggaggaagggagagagagagagaggggtgatgatgtgtcatcctggcatgtggggcacacgctgagttagccgtcacgtcggataaaaccggggtcaaaaccacctaagaacctcaagtgaacggttttgtaagttgaaggatgtcatatatctagttttgtggttaggggacgattttgtaactcgatgacaagttgagggaccttgagtgtactttttcctgtggaaaatatcctcggggagaagacgcgcggcactgaagggacattgcggcggctgcgcgactagttggcgacggaccgacggacgagacaaggaggcgaccgcgacgctgcgctttcccctccggtggctttccccaatgtctgcacagcgaggaggaccgtgttcttggcggcgatgctgaccgcagtctgacacgatcttgtcaactaaaattcgcgatgctactgaatagctgaccatgatgttgtgcgccatctgattgatttgcttagctagccttttttgtttgatcgacagaaactcctgtactagtgccatctgctgctggaatgacattgtatcctgtctgcctagctatcactttaattattcaagatcttgaatatgttaagtgactttaagaaaaagtagggccatccagttcattaaaatgaaattaagttctctgaaccacactgaatgttgcccccaccatgaggtaactgacttactcaaactgatgttgctgaggtagtttctttctcgtgtttagttcagatggtgcttggtctgctctttttagttcacatatatgcatgcatcatcaagtgtctttttttgaggaaaatgtttacaacttggaaacttctgtactcaccaagtttagttcagatggcgcttgctctgctctttttagtttacatatactgctctagttactgaagcagattctacttcatgtcatgtccaacatgtttaagtatgccaaaagttgacgatgatcctagttcatgtcttgtgcataactttgagttgtccacaagttctttttcttctctagataccctaaacacttgtatgtatcctacactgatgcaaatcctagtttttacatgccatgcacaaagattgttccctgcttaaggataagtataattcctcagccatagttaccactgtttacttttcatttgaatttaattactgaagtgtgttcttcataaatgttgaccatggcaatttaattactgaaggtcctgatccctatggtttattaatatcattggagcatacagttctggtgttagctcttttgaccatacttatctatagtaaattagtaagtagtacagtatacatgttgctttccctttttaccttttgcctgtagctgctagataacatagcagtctccatttctctgtactacaatacaaagtcaaaaaacatgtagccgtgcattgacaattattattttattgtatatctatataagtagtatatatgatctctgcatcttctgaaaatgcagacaagtcaagataaacaactccaagattaacatgatttctgcattggccatatatctatctatctgttatacatgatttctgcatcttgtgaaaattcaaacatctcaagattaacatctataattagtttggattaacatctgaatggacttcaagatgttatatattgtccattgtattatgtctgctactttctccgtttcacaatgtaaaactttctagcattgcccatattcatttagatgttaatgaatctagacatatgtatgtgtttagattcattaacatctatatgtatattggcaatgctagaaagtcttacattgtgaaacggagagagtagaagggaaaaaagtggaattggtgggtagtaggttaaaaatatggaggttttgtgcaaattcattaaccaaagttttgtttctttttatctgtttgtgagataggaaagctgatgtttactcttgtgctttgtaggttccttgaaatcgactggtatggaaattccagataatttatttgatggtagcaatttcctgaagttcccgaagatttattacttcagacagcatggtgaaagtcagggcatcattatagcgtctcctgctgctcagctcatgccactcatattagacctttttagtttgtgatgtatctgagttccaatgctcgtttgtttggatttttagtagcacctggacacccagtttgtgttgatgattttattgacaatgacttgtatgtattccgttgttgctcagcagcaaatttctatggattaggagaagcaaactactactatatggcttttatcctgctctttcttttcttttttgttttgctggaatgaccgaaggaggtcattcaatataattaagataggaagaaaaggttacaagaaaagttttacattgacagctggctgtcgaggaaggatgtgcaccagagcacacgccccgaaccatgtgtcaaccgtccaaacacacgctatagaaagggaagccaagcaccgaaccggccatcgctatgcgagaccgatcgccaccaagccaacaacaccactacgacacgaagactctaaaacgacgccctcacgagggttgcgacgccgaaagacgctgtcatcatccgtccaaagctggacaaggttttcacccatagttccttgccaagggaggaggggtacctcaacaataccctcaggagggttaccacgcctgaaggcgtagtcactgttggcccaaagaaattgggctaagctttcgcttggaaccccttaccgccatggtccgtcgcccaatccgaaaccaccatctaaacatcggcggcacatggcttccgccatacccgaccgacgccccaccgtcggtcagtttccagtcctgccaacgacaagactgccaccacaccgcaccgacgccccaccgtcggccgacttcatcgaaccaccatccctgaaagttggcctaggaccccctccgttccaccacccgccggcctccttgccaaatctggccggaggaaaacccgggactaggtggcattgcttcgacatcctgagcttcccccgctgacaacctgccgcctcaatccaacctagaaactccccgcaaagaagggaggagctccaagaagggcgatggtgacaaccggcaatgaggaaggcgacccaccgccgccagctccctttgcactaccatctgggcctgcgccgacgctggaaacgctgccgctcctgctccggcgcacccccccccccacgatccagcctccacgccggcctatgcgcctctgctgctccggcctacgcgtcgccgcgccaccatcccgaggagcgcgggcctccgcgctgacagtcgcgcctccagccgcacgtccacgccggcccctcctacaccgacctcgggccgccggccgtgcccccgctcctcgccgcccgcggcgctgtcccgcgccggccgcctgatctagcggcgccagacccggctgcccgagctcgccggcctcctccttccccgcctccgcctcctcccgagcgcaggcttcgacgtcggcgttgctccggccagcctccaccgtggatgcccgcgcctgctctggtggtggtcgccgcagccatcctcgtgagcctccagctttgctggctactcgttcaagcggcggcgaggcaggggtgagaggtggggtggggcgacggcggcggctagggttccgccgcccatgtcgcccatgcgggaggcgacgcgggggccaaccaacctaagttcacgtctattctgctctttcaatttatcagattttgatagctaaaacgaacatagggtttaagacagggaataagagagagcaagggattccaacccccatagggattgagtgacatgggagggattcactcaatcccttcctggatatattccacttggggattaaatcccaaggaaccgaacaatgcctaagtggcatcaaaactcctggattttccctcgaattaattgtctaaagactttcttaactaatctgaacatcttgtatgcataagttttctttcttttttttttgctggacttgttataaaaccctcgatctatctgcttggtaactctaaatattttatttctgccgtttaaccccctctttcaattcttttataggtttattcagcatggatctttattattccaatattcacaaaagaatataaattgaagcatatgatggtgacagatgaaagaaacaactgatgaacaggggaccgaattcactggcaacaggagcagagccgaggtcgcttgccttcaccaccaacacggccgtcatcgctctcctcctccctgcgccgaccaggccgggagagcgacattgccggagctcgaggaggtagctttgctgggatccaagcaaaacgcggtggatgcacgaggtgtagcacaagcagaggaggaggaagacgtacgatggcgatgacaattacgcgtgcatgaacttgcaagtgatcaagtgatctaaacgcgtgcttgtgaattcgatttataatacagtataggagtgatataacgcggtgaggaatactcgctcgtttttcctcctcgctgcttcctcgctgctggctgtcgttcatggggtctggttaggtttgccgagtcaagagtcatctcttttacccttctctgctgtgcaacttcttgtgccaaagatgattagtgcctggtggtcaattcaaacaaacagttgctgttttggttcaagatgatggatgtggttaggctggtgttttatggatgagcaattttcaaggagtgaaattgattcagaatagcctggatttttcacattttgattcttttagaaaacttattttacaaatagacccctaaaaaaacttagtccttttcgcggcgccaatttctttg

SEQ ID NO: 19320 - DNA, 6170 bp, Oryza sativa
ggcgccaatgacattggtgccgcgaaaaagatcatttctagaataagtttttttagaggcctatttgtaggataagtttttcaaaaagactaaaatgtgaaaaatccagtcagaatagcttccaggcactgtacaagtctaaaaactgtctctgcttgaagaaactctgaaaattaacacggggaatgattccaacttaggcaccttcctcgtttctgaaactggacatatgtagatttccagaagagagagaagagcataccaggaatgcacggcattatataaaaaacgtcatcattgccatggaaataacaggaacaaacaagaacaacaaacagggttgttggtcacagatcagaggtcagagccacaccaacaggttgctttccaatgaaatagtgcatagaattgtactaaatttagacgccttggtttttctcaaagcaaaaatataactatggtatgcataaaatgtactgaaagctatggtctgtaaatatactaataacatccaaatatgcactaaagttgaactgaatacaagcaatccgatgggagtaccttctgaataaacggcggcataaaggcatgcatcacccgtttcatcagtgaagtatatatatatatatatatatttttaagaagagtgaagtatattattcttcatccgtgaaatatttacttgtattgctgatattgtctgaaaacaagacaggcggcagtggggtaaaccataagcagtcgctgctactggcttctccaaagacttgttcaccgtagctgctactgcgtgcttctctgtgtcttctactgccagctcccctggcaggtgaaaatgaatgtctcctgtgtctcctactgcctgcggcccgtgaaggaggaagtcccctgtggctccaactgcctgcttcattgacagccccattgtagttcatgctacctgcttcactgacaggtgaatgaccccagttttgctccgctgcagtgacaggcgaatgaccccagttttgctcagctgcactgcaggaacctcctgagccaggagttcccgtgaaatcatgctccccccgccccacatattcactcagcaaattttctctcctctgtgcatttaccatagattccaactgcacatctgcgtggccatgaatccagtccaacgacgaattccaatcagatggattagcatgtgataatccattccctaatggaaaaatatgacagcatgcaaacatcagactattattccaaaacattaactaacaaaaagtgccacagaaataaagttgctaccatcaatttcagccgtattgatgtgccccaaagaatgttgttgctgtgagctcgacacttctaacatattgttatccatggatgaaaccgacataacctcatttcctaccgatgaaacttgccggtcgacaacttggatacgctcaagttgtcctgcagaaaattcagagcaaatctacctttaaaactgatgacatacaaaatatacacaccacagagaaaaaggccaattaccatgatgcatcaagttttggtctgaagtgtctggttggaacttggacctatttggcacaatcactgataatccaccggatgatagtccattacacgttgaagaaatttgctggcgagttccttgaacatcaagttgttctgtgagtttttgaagaatcaataaacctccattgggatatccacagaaacaaggaactacctccagcagcagaccatgaatggcgaatggaagcaatcaaattactcaagagaggccagtccaaacctaccttgtgatgtatgacttggttgcattgagcatgatccctgaaggtaatagctgccattgcttctaaaaaatgcctcatgttcatgagacacattactctcttgaaggcaactagagtaaattcctggtcttggattacatttcagagcatgactaatgatcaaatcccaatcttgatcagaaatctttcccaaaatctacatagggtgacattaaaaagaaaagaaaaggaggattaaaaagagaacaaaaggaggaactgttggtgatattgtatatgagaacaaattagatagcaaaataacagtgttaataattcattctcatactttacgcagatcatctggactcttgttgtagaaagataagaagtcctccactgtcttgataccattctgctctagtaacttgtgcctgtcaccgttctttgcaattttgctcagtttatatacagcatcacgtggggatggattgggattcttctttgttactgcagagaaagacattcaatgtagttatcctgcctcttatcctttgaaaaatattgatgtgtgaaaatgttttttctgtaaaataaatggatggtggccaagttttaaaggttcttaagtatctaaaaacaggttttacatattgataaaatatgaaatattcacatgggttaccaactagttatcgtgatccctaaattgttcttactactcattctgtttgcaccttccaggttaatggatgttcatgtacatgatagagatatcagcacagaggagcaaaataataagtattaaaaatataatagaatagcgtgaactcacagtatccccgaacatccttcacagcaaaagattcagttattccttcttgaattctttctgagattctttcatcagctgccataacacccaacttgaactttttgcttggaacaaaactagaattgtcttggaacttggcattgagataacccacaccattttgcagcctaaaatacagcttcccagacagcaaatgtcctttttgaggtcgtccaggtactattttactacggaagtactcttcagtccactgtcctttatgatcatcatcaaagtcaccatcgatggctacaatcgatctgaactctcattgaagaaaatggttcacttgttacgatcttgttgttacgatcatatatggctacctgaagggggctctcgtcatctgcttctattttgtgtgttgagtacttatcgttactgcatgaattcacaaattgtaatcgaagtggttcgctgcagttctgatcaggtaacatcctaaaaaatagtgcaagtacatcataaacatacagtgttgaactttaatatatggcagttacttatgtgtactcaaagaaacaaagaaaaataacacagagcaatacaggtatcccatatatgcacgtgactatatgagaatgagatatgatggactagatgttctcttttccctcaactcttaacttgctactttcttgagaaaaaaggtgcccggtttaattttagctagcactttttcgagaacatgtgagagccttggatgtcatttcactgagagccttgctagtagaacacgatgggtaaagttaggccaccaagcaagctgaaccctttgataagttaaccctccccaataggcaaacaagccaattaagactttaaagaaaggacttcataaataaattaagatcatcatggttgctcaatcccacaataatgacagcatgtgtgacaacatcccgatttgtggctagtacattccaaacctccctaactccacctctttgcaacagaaatccaaacgattaaccttcagaagatgacttcactatttatataatcttattttgtttcaacatcggataaaatatctagtcaattgacaactgacatagcaaaaacaaaataaagaaagctggaaagataatgcaatgttttttagtcctttacagcaaagtaaataaaattgcatattcttgcaacagagataaacattatgtttctataaaaagagatagacactatgtcagtttataggtgcaaattcaacatatgtgaaactacaaaatgaaaaactgaacgaaatgtgcttcttcatctgttaactaacatcataacattagttaaaatagcacaaaacttttcttaattcatgtacaattcaaaaacttaaagcaggtatgttgtaactccatgtacaaccgaaaaacttgaagcaaaggaaaatgtattaatgccaatattaccaagtaccaacctaggcgcagggattcgcttatggtaaccaacaacttcacttattgcctgccaatagagtttaaagagcatcactttctagacgtaaaatgcaaaattaatttgcaacaatattggtataaattctgataaacctcaaatttgatatacatcagttaacatatgacatatcttaagtacaaggtagttcattaatctattggctcctatccttttgagatcaaacaatatgtaaattttgctacttaagaactgagcacacataatactatccaaaaactacttttcaagatctcatatattgtatctaacagaaacaatattgtaaaggaagaagttcattttatcatccttaactttcatggaagtcttaaaatcaactttatatttcaaaactggacatttcaaccattctaagttcagcttaaggttgaaaagtgaatgattttgaaagttcaagataattttcttttataaaggaagttcaagattttaaagttggggtttgatgtggaagttcaagtccataaatgaacttcttcatatcggaaagctctggaatcatatcatcccaaccatgaagtctgaagcatacatttttgctctatgggatggaagcacaaattaagctcttaccgctgttaggctggaaactttttctcgcagctcctgattctccctaagcactaatttgatcctctcattttgctgctgcatcattcgattcatccgtagaatctcctggagcatttcagtctgcttgtcactgccatgcaagcgaaagaaaataagctcaatttcttacctctctaggctagcttaatagcccacaggtagtcatcatctgttttttttttcatttcacagcatattgtgcccattttattgggaagtgtttttgcaatactttcttctatgcaaactaaggctgtgtttgaatctgtgggttcgtaacccatttctcccgcagggaaaacaaggtagctcattaactcatgattaattatgtattagcgaaaaaacttgagaaatggattaatatgatttttaaatcaactttcctatagaacatttttgcaaagaacgtactccctctgtcccaaaatataacaacttttagctcttaagatttgccacagaatataacttctccatcaacattctcttcacaaccaatcacagccctccaccattcatttttcccacctacctccactactcatccaatcacaacccttcaccattcacttctacctactttcttaataaccgtgtccaactctaaaacttcttatattataggatggagggagtaccatttagcagttcgggaagcgtgcgcatagaaaacgagagagtagaagttgggaaagaggatgttcgaccgcagcctaaaggtggatctactgcaatatgtaccattttcccttaaattattatatttacataaatcacatatagattataaataaccgattttcttagtagagaagggtttatttatagagggagggaataagatagtgagaaaatatggattgagacacacttgaacacaaggttggcatgagcacctggcaactccctgccgctaggctacgatgctgttctcaggagagggatttactgacttacttctttttcactagacaggcatggtcaattttattaagaatagagaggcgtgaccaacaaacatggttattgtctagaaaacaacttggaactcaccagagttccgaacacaaggggggccttttaaaaaagtggtttttgcatattgaaccaccaacacaagttgctgagtttggatgaagataaactggagaaactaaatcctggtccgctttccctttaccaagcagattaatctgaggaggaggaggggggggggggtggggaatttacatcaacgaacatcatatggcacataaaggagagtgtgttgtgattagatcaaacaaaatactgcaaaagtgaaacataaatgaagcaagattgtagaagtgagctcactcgaaatcacaggagttccgcagtcgcttcgcaggcggtgatctttgtgatccttcgtcgtcattctcctcatgatcctgaggcag

SEQ ID NO: 19321 - DNA, 4059 bp, Oryza sativa
tcgtgtaatcttcctttgatgcacggatttcctagatttttgcaattcacaccattgacagctttcttttcagaaggagagagagagagagagagagaatgatccacgtgaatgttccatgaaacttcagccgttgcacagcagtacctcactactgagtcaatgtggagcagggaagcattaggtgcgtttgattccctgtatttcaacctggcctaaatggaccgtttattggaggagatcaacctccaagccgcctaccgcgtccgcgtggagattggagagaagatcgacacggttttggctttggaaaattgaagcggaaccgtctctagatgcttcttttttttttttttgacaactgatacttttcagatgaagctttcgtttcaatttcccgagaaaacacctaagtatatatcccaatggaatttagcatgaagccccatattcgtaatatttttctattgattttagtgggttcaaacaaaatgggcaaataaaaaacgaaactgttggggatgtgcgagacttaccacatatgtgccgactgttgattgacaactgtagattcgatggagaccgcatctgcatctctacgaacacgatctctcccggtgcggcatttcgccgaacacctctgcgtcgctccctgtcatgggcctgggcctgtcaagtgagctatgttgattgggctggcttgaggctgaggggaggcaaaggatacactataaaaggaaagaagcaacaggcatgaaggggatcgatgaatagaacttgtggctgctgcctcttcttcctcctcctcctccggatttctttcccactcctgctgttcttccaatctcaaactctgcttctctaataccagtcccttgcttccctttctagtcttcactcctatattccttgcaattgtatcccaattacttgagtgatttctactgtggatcgttggttccttcctgtgttgatattgatctgtgaatgagttgacggatcgtgacaatatggtatcaaagcagtcgattcgtggggtttcttgtgtggagatgaagtgggagagcgctggtggtcagaggaacagccaacaacttggtggtggtgtctttggaggagatgcccaccacctgttcgatgaaatgtcgagctgtccaagagctgactcagctgctgtccttcgcgtcactgtgagccagatcatatatccagtgacatctgaggtgttgcatcaagtgtacgatacctatggagcagtggcggtgcaggttcttgcggtgagcacatggcaagtcaaggctcttgtgtcgttcatgtccagccatgacgcggagagggctcggtctgccacccacggtcgcgacatctacgacgggggttgcttactggatgtgcagcacgtccagatgttccctggagatggcgccaccgccacgcacaccacctgttcgacgatggtaccaagtagcgccaccgcaaggccagtggccaagagtactgctgctgcaccagaacgcgtgttccctgctactacagcttcatctgtaccctcaattacatcagcagccatggtgacatcggttcctttcaacgagaccaagaaggctgagactgacatggacaaggtggtggagaacttagacaagaccattcaagacctgtgcaccaagatcgatcggatgctagagaggcatttcgcgacaccaaggtcagtacagaggccggctcaactaaccttgttgacacagccaagcttggcatgggaacaaccatcgagtgttcaatgaagtgtgagaaccagttggctgatgatgatgatggcaaagacatggccaaggaggagtggatggagctcatggaagtggataccatgttcaccgctatgtatttatgcttcagagatccatttttaatcatcaatgcaattcctcccaggaactggagttggtgcttgagccgtgcctactttggagttgtaggcctctctttcgtttcatcgaaattggaagtactctatggttgctttgaccggagcttagaatacacagctagccctccaccggtaccaccttggagagcagcaattccatggaacaaagctgagatgacctcaggttctcggcctttaccatggcctgatccacagctttgtcaaggcagcggaggcgtggtggtaaagctcttacaactctagccgccacctattcaaacaaatgttaaagctgaaattgaaacactgaatttatatggtgagtctcatcaagtctccttgaactacagtgttgcccagttcatgagtagaacaattaattccactgagggcttgctgcaaaatctgatggttggatggtgtatttggcatgagatatgtctctctggtgcctttaggaaggcctatcagcacacacatcattcaacctatggttgggcatatggggatcatgaattgttcttgctgctgatgctgatttcccagttgtcacctgatgcatggtgtgattgcttattcagttgtgataatgctgatggtatttgtacttgcaagtcacccgagagaagtaccaactgccatgctcggtgctgcagtgttccaactccatttcaggttcagagcaaaaacaatggcgtaataggtgatacttcatggactcaattcagatcaaacaatggtgatgctgtgctgttggtgccacaaccatggccacagccgattctcttcccagttcatattatggttgagctagaggtttcgttgaagggaattattgtctcaacaaaaaagttggtcaacttgcaatctttggctcctccttcgctttggagaaatgaggtattcaatttgtgtgcaacaggagggcaagggctaaatttttcctggaaatgtatatatgaagagctacagcagttgcaatgtacctttgagtttactctttggaatcaacatggacagacatataagctattgttacaaaaggagcagctgaaacttggtgcagtctatctcagtttggaagtaaaatcttcagagacatgcttcacttgccggacttacgaggaggacatgttcttacaaatcacaaattttgtaggtcacaactatgaggggagtaacacttgttctacccatcaattcagtcatggttggcctaaatatttggtaagagctaaattcgttcaattccaaagaggcaagattctttaggagcaagtgcaactggcatatagcaggccaaacgggcggcccggcccagcacgacacggcacgccgacggcacggcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgagggaaaaaaaagaaaaaaggcagaaaaaacataatataaaggaaaaaatgataaatataggataaatgtgaggaaaatttaggaaatatatcataaaatatatggtacaaataggataaaatgtggaaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgctagcccacgggctgaggcatcggcccaaacacggcacgggataacgggccgtgccggcacggcccacaggctggcgtgccgtgccgggcctgggccggctacagtacttccgtgctcgggccggcccggcttggcacgacccatttggccaggtataaactggcattgtatacaacatcactggtgcgggtgacttgggatcctggtggctgtgttgtatcggcttggggacaagccgaaattcatggagggaggaatgtcatgggcctgggcctgtcaagtgagctatgttgattgggctggcttgaggctgaggggaggcaaaggataca

SEQ ID NO: 19322 - DNA, 6857 bp, Oryza sativa
  unsure (1)..(6857): unsure at all n locations
ctgcagccctgttcttccaatctcaagctctgcttctctaataccagtcccttgcttccctttctagtcttcactcctatattccttgcaattgtatcccaattacttgagtgatttctgctgtggatcattggttccttcctgtgttgatattgatctgtgaatgagttgacggatcgtgacactccccctcgccttgtcctcttctaacttcatggccacatatcaggcatcctccacctgttgagcagagcagtgggaaaacgagaatgaggagaaggcgccgcagccggcaagctcgatctcgtcgcgcgcgccgaccgtcgcgccattggagcgccagaagcgggcgggtggcagcatggcaaaggcttcgggagctcctcaaccaccgccgaggcgctccgcttcgtcgagcaccgccagcgcccatgccgccgcgcgcttcccttttgccatacttcccctcgtcctcgccggcggcgaccagtggagcgcttacgtggcagaaccagaaccagacgtgtttcgacgggcgtaaataaggcccatccacacaaggccttgcaaggcttaaagccgggcccattttgaagcctatgtattccacgcctagtggcctagtggactaggcccacaaaactaagctcaaatctcacttgagagattctcacttaggccgagtttagatctaaactttttcttcaaacttctaacttttctatcacatcaaaactttcctacatacataaacttccaaattttccatcacatcgttccaatttcaaccaaacttccaattttgacatgaactaaacacagccttaactcatttttacaagtgccattgataagttactactccctgcattctctaatacattttggtatttgtttatgataaatatggtttctgatagctaatggatctaaatgtactaatattagaaaaaataaatacttttgaatacaaatgtaatcataccactatgttacggggaatgtttcaggtgcgacctcccatttgggaggaaacatggaaccccgaaccctccatctccaccatctagacgcatcctcctctcccgccaatcattttcaaaagaaataaaaacacccaccactaaataatcattttgtattttagttcctagtgttcactttctctttttctctatatctctcttccccctctctctctctctccttcaacgcgactatcaaaagagcaacattagtttacttcttcgatgttgtattatgttagtatttatctctacaaaacctggtaaaagttagaatacttttatctagaacaatgtagtatcccttatatttcttatattttaagatgggaagtatcatataattttgaaaattatataaaaatgtcaagtgagaatttgtatatcacttgaatctattgtactagagcgagtcggagtgggtgagatgtcaccacgtacaaatttacaaaaagcatgtgattagctctagacaaggttctaattaaagaagtttgagatcaaagagaggaagtgtttacatctaggggtgaaaatttttggcgtgtcacatcggatatacggacacacatttaaagtattaaatatagactaataacaaaacaaattacatattccgcctgtaaactgcgaaacgaatttattaagcctaattaatctatcatttgaagtattaatattgcttattttttaattccgaatttcagttaattttaaattgtattcctacttgaactcttttttctttttgctaattttagattttatttttatttttattttgaatattaattaatctcgtattgggttcttatatggactcttctctcaatattccttattttaattttgaatttcagttatttttaaattgtattcctagttggactctctttttcttttctaattttgggttttattttatttttattccgaattttgattaatctcgtgttgggttcttatatggactcttctttcaatattgcttatttttatttctgaatttcagctctttttaaattgtatttctacttggacattccttttctttttctccgattaatgtgggaatttctagcctccgccgcgaacgtggtacttcctttcaaagctatcttttttattttgaattttagtttttctattttatttttattttgaattttacttaacctcattttgtgttatagataatctctgatttcaatattttttatttgttattttgaattgcatcttgggttgccctcatgcgattgctactattcatcacatgagcagttggccctcctcccgcagccctagtaggacgaatttacgaaaaccttctctaaagtccgatgcgcctttttttaattgtcttttttgaaattatttttatttttattttgaattttaattaacctcattttgtgttctagatgatctcttatttcaatatttttatttgttattttgaattttagtttttctattttatttttattttgaatttgaattaacctcattttgtgttctagatgttctcttgttacaatattttttatttgttattttgaattttagtttttctaaaatatattcctactcaaactcttatttttatttttataatttcgaaatttattttattttgtattctgaattttaattgatctcctatcgtgtttaagatggattgttattttaatatttcttttttattctaaattttagtaattattaaaaggtactactactctaactctcttttttttctactttcaatttttttgttttatttcaaattttaattaatctcgtggtgtattttacatggattattctttcaatattccttatttttatccgaaatttagttgtttctaaattgtattcctacttggactttttttttccacggttaatgtgttaatttctagcatctggattgagttttttacatttgtaatttgaatttaaaaggattttttttcaagaatatgcaaaagaaacatagaaacaatctagatctgatgataacgcccatgttcttttgctagtttttagtgtgcccattatttattttaccaattatttatttctttttatgcctggtatattgaaaggtgtaaatcacgttaaaaacaatgataggattatatgcagaagaactattttactgatgtctcacatgaaacctactctagttctgtttccttttgctatgttcctttccaaatagagtctagtgtcctgatgctactgctatacgccatactcaatatgagttgtaacgtgctaccatgtacgtttctatagtgcttatgtggaacaacaatatgtttccaaaattttattcattaaatctcaacccttgagatctaaatttactatgatctagtggttaatatttttctctttttctccgattaatgtgggaatttctagcctccacagcgaacgtggtgcctccttttaaagctgtcttaatagtataatagatatgtagtgtaaattcaaaaattaccgttggatctaaagttaaacgtctaatatttgttgacatcatgaagattaaaaagtttactccagataaattttgtacaaatggttgaatctagaaataaaatttttactctcggtggtgtaaacaaatctcaagcatccatttttgggtcaaacagtagttttcaaattttcattatatttgtgatttgcactacatatttttccgtttatacccataagttgactacatagtaagacattataactgtagctctatggtcacaagatatcctggtgctactagctgactggtgaaccctctaagagcatactaaagaatgagcagactcatgggccaacaacaatcacgggtccagccaagtaataatgggtctagtattctcgagcctacactacagcatggccgcacgaacagttggtgggtaaggcatttaatgcctccctcaacgatgttgaagccccgcgtgcaaccttctcctccaaaggcaaggcaaggcctgtaccttgctagtggacggatccagggccccgcttacccttcggagtggacggcgcccctccggcacctcaaggagggatgatattcttggggaggcttcggtatcgttaccccggaggggttatcgaagcctataatatcccccaacagttctttttgtttttttttcgcaaatacgcaaagtgcgtatcatttgtattgagaccaggcttttgttttcttttgtgggcatacacaattaaacatacaaatgtggtgtgatcttgtttgctgattttttttatctccacttgtgcagctcttctgaaccaacaactcctgatcccttgctctcaacttgtgatgtgaattgcactgacaaaagaacagaaggactagctataaatcgctaaagatttttttttaataaaattcacacgaatgtaattacggtataattacaccgcaattggacagtagttgaataaaaaatgagattggttagtagctaatctggttatggttgcatgccctaaaccgtgatatcgtgggatagattcccattacctgtgccctttctcttttttttttccgccagttagcactcatctcaacgtgaattttttttccgccagttaacactcatctcaacgtgaattgtatttcataattaacttattggacatatttttatttccccgagatgcaagcatgattcattataaaatatgttggtcaaaacaagcacctagtgtccttgccagaaaaaagaaagggcaactagagtataaaaataagcgaggtcagtgagacgctgacaattaagattttttttttgagaaatgaaaattaatatgtcaagacgcggcaacagccgcctcatttcttctttgccatatccgtttgttagcaggaacagaatcctgaccttaatgccatggcactgtggggcgggctgggtcaggcggcgacggtggcgcagctggtcggggcggacatcggcggcctcatcaccatgatcatgcaggttgcgatgacggctgcggtgggaggagcggccagccatttcggaagtcgtggccaatctagagaaggcgctcgagctcgtccgttgcgacgggtaggcggtagcatagcgtgggctcccgagacatcttatgtgaataattgggcaatgtataatgtagtaataattaacgctgtttgcttctgttctcttttgtgcgcatgcacaattaaacattggtccaatgtggtgtgatcaactaacaaaatcttatcatttttgctgatttctaatgtccacttgtgcagctgtgctgaaccaacaacccccggatcccttgctctcagcttgtgctgtgaattcaagtgttaagttaggtgcctcccaatctcttcctgttcatctgtttgcaggtaggagtatgaggaagatatgaagattggtgtaaggaatagttgaagacgcacggattttaactggttttgctcccattagcacaaaaaaagatcaacaaaaatataaaggccttgaatgttctgaattttctcttgacaccttagcagccctgcaactgctatttcttcgtattttccccacaccttctccctgctcttaaaactaagaatctcgttcatgtctgtgcagcagtatccttcaggattaaagcggggttcatagggctcagagtgtattcaatggatgattgcaactgacgtattttcccggaaatgtttctcaaaaacctgataataggtacaggctacagagttccaagaatatactggatagtaacggacactgggcttcctttgcgcggcatttcatcgaacacttggagctcaagaccaatcatgccagtataccatagccctttcgctccttctctctttcaagagcgcttgaggcgaccgcgagccatggccgggcgtggcgtggagggcacgagactgtttgcactatctgctcgactgctccgccgcgggcgccgcctcggcctcgtcgtcgtcaagggattctgcatttctgctgtactactcagtagtatagtggtctcccttcctccactaccggcggtggccttggtgggcacagcaatgttcttggaagctaccgaagctaagagagaggaaagagaagaaacaagggatgactatgcccatttattttctgtaagaagtttgacataaccaaaatgaaagaatatcacgtcaaaaaaaaagaaagaatatgtaaatcctcattatcaactttacatagcaaaaaaaatgcacgtagctaggagcctaggaagcaaatagccgggtgttaattaatccatgttcgcggtgagcattcttaattctgctagctcgactccctgacaggctaaagtcccctgaacctgcagctccagggtttgctggctggtgaaggcgaataccccatataccttctactccctacttcactgacaggtggtgaaagtccgccatagcttacactgcctgcttcactggcagctgaaagtccaccgtggttaatattattattatgtgctccattgacagaagaaagccccgtgctatgctccactgcactgtagggatttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19323 - DNA, 703 bp, Oryza sativa
ctcgacgacacgctccgggaggcgcacgagcttgtgttgtcgtgccaggacaagagcgccgtgtacaggttggtgatggccgggggcaggctgaaaagttcagggatgttcagagcaggatcgactctacctctcttttttccagttattagccacatggacatcactcgccgtttcgatcgaatttacaacatcttgcttccaaacgacatggccgggccatctatgtctcctgtctccatgccccaaatccctgtcccagcctcccaggtacacattgaaatgcatacatatataatactccctctgctcaactttgatcgtccgtcttatttgaaaaaattttataattagtatttttgttgttacgagataataaaatatgaatagtattttactcgtgacttatgttttaaaattttttcaaaaaaattttaaataagatgaatgatgaaagttgggcatggaaaaatcatggctgcacttaaaatgggatggagggagtatatatatcctcaaactttcaattgcactttgtacttggcttcaaagggaagcttagaagttagaactcagctctaattttaccattcttccattatgtgcatttctctatactaggatactgctaagatctgttggaactggaaggaaccccatagagtccaagagtttaattttaaggagctcgcaaaggcgacca

SEQ ID NO: 19324 - DNA, 741 bp, Oryza sativa
agtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttttgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatgtaaaaaacttgggcactcagcgttgtgtaagatcctgagatcccgaacccatatatctgctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttt

SEQ ID NO: 19325 - DNA, 705 bp, Oryza sativa
ggggggccgcctgcaaatgggcggcgagggggcatggaattttgcaggcggcccccttgccgccctgcgctagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatatttttttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggctttcattttcgtgtgttgtgtgatagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgttgtgctgtgtggactgtgcgcgctactggatctgacactaccgtgcaccgcccaaagtg

SEQ ID NO: 19326 - DNA, 5650 bp, Oryza sativa
ctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggtaaatggagagaaagacttattaattagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcactacaagagagctcgatgtacgtacaaataaattcaaaattttattacgtagcgatttcttgtttaattactaatcaatttcatacattcatatagtttattcgcatgagggataacctgaccacacacaaggaatttatcgcggcggttcaagaacaacctcatgggattcatcacgaagaaatccttgatcccaagggtgaattctactacgacggaaacacaattcaccggtccttagcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtgtaaatacatatatattatgcatgtatatacatataatataatataatataatatatatatatatatatatacatatatatatgtatgcatatatatgtattgaaacatatatatgcatggtttatatatatatatatatatatatatatatatatatatatatatatatatatatatatagatatatataaaccatgcagcaacagggccatgaaaaaaaaaaaaggtcagctcgatctttagtcccggattggtactcccggtttggaaaccgggactaaaggggagttacgaaccgggactacaaaggtttctccaccagtgaaaggtgctaaagatttcacttttttttataatctacagcgaatattttataccgtttagtagggcacgtttaaataaattgtacatgtagctaagtacacttcatgtcaagttctatgtgagagtaagatttttttttcagtaacactaacaataaaaatctcggtgctccaatagtagcatttttccagcaccaaaaactactattagtgtttttgaatatgctcaatttacatgttgatacataaaaaataattactgttgtaaattatttaccttgtagggtagaaaaaaaaagctagtgcttttgattttgtaagataggtagcccatgtactgaacttatggtcagaactaggggtgaaaatggtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttataccgatcgtttccgtatttaccgtattctcgcggaaattaccgtttcttataatatggtaattaccgtattctaaatatgtcgatattataggacatgtctatacttgacccacagcttatagattgaatgactcttcaataaaatctctaacttttgtacatggctaaaatgaagttaatttataatttatatagtataagcttgaatttatgtatatatatataacatacttatgtaaagttaaatatatgtttttatagtttaatgtttccatatttgttaccggtttctgatctgtaccgacatgtttccgtccgtattgttccgtttccggttttccgatatttccgatatcgttttcgtttccgactttaccgtttccgatttcgtttccgagaaaaatatggttacggaaatggttgaggctgttttccgatcgtttccgaccgttttcatccctagtcagaacatacgcaactgctgccttattgttggcacggttaaatagttaatgacatgcttttcacttaccttattttggtaacatttcattaatatctataacttataataaagtaatagaaaaaatagcctccacattagctctcaagatctagaaactttcatattaattggaataaaatgggaaaaaaaaaggaaaactcattgcagacaaggattctttctttttatttttttaaaaaaatcacattatagatgtgtagtgtccgatcggacacctgctgacctgcatagaacaaatcttttgcagtttgcaaaagaaaaatcttttgcaaggaaaaaatgacctaagctggctgctagagtacccgtgtacaacacaaatcacaagtgtgcatgtaagtagtactcccaatattggctcattaacagcacatcgcaatcaagaaaaacacatacaaagataaaatccgtacccctatcactgtgtttgttacttcgagcagagacgggttgtagtgcctgtatgccagtttatttcgatcaatttgacttgtgcaaacctgatgatagctttagtgaaaatcacagcaagcccaagccatcacagacggtccactacagccatatgcatctcaaattgggctgagatgggcccacgttaaaaacttacttataggccggcgcatactaccacaattctggcccatatggaggcacgtcaaccgcgaccccctttcggcccagcgattcgtcgccactagaagaattttttttatttataattttttttattaaaagtttgacaaaaataattttccattttgaaaattgacggaagtagtcgcctaccgccctctgggagggcgatttttaaaaatcgccctctcatagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttacaggcggcccccttgccgccctccgcgagggcgattttgtactgtgcggggggccgcctgcagatgggcggctagggggcatggaattttgcaggcgggccccctttgggggcccccgggggcctccgttaggagaatatgtactgtgctctatatttttgtataaatatcaatagttatcaaatctttttatattgaaaactatacaagattaaaatctccaagactggtaaaatacaattttattattttttagggcatatttggattgttaccgtacaaatatttttttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggctttcattttcgtgtgttgtgtgatagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaacgtgcccgtgggagtacgtgagtcggtccgggggtacggcacggccaacccgtcctgcctgtataggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcatggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcgccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtactcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacaacgctgcaataaacatgatcggaattagacagggctgcag

SEQ ID NO: 19327 - DNA, 955 bp, Oryza sativa
cgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaaaaccgtccacgggaccaactgctgctcccgccagcggtagcccgagcaggtacgacacgtcctgcagtgtcggagccatctccccacagggaaggtggaacgtgtgcgtctcaggtctccagcggtctacaagagtggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactc

SEQ ID NO: 19328 - DNA, 1830 bp, Oryza sativa
  unsure (1)..(1830): unsure at all n locations
tgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgagcaatggtggctaacaaacgaggcaaattatcataagaagcttcaaatgtgccatacctcatctcaatgattttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacgaacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcncagggtacatgatcaccctctgatataacaagtccagagaagtcctcatttgcccaatcagtggccattacatcaccttcctcatcggatgatgcgtcgtcgtccacttcctcattatccgaatcttcccttttcattcatcaacaattataccgactctctccccctcatccgccatgcccatagcctgctcctcccttggttgattttcctcattttgcatcgatggtccaacaacatcccttgcattgataggacctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaattataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgc

SEQ ID NO: 19329 - DNA, 10183 bp, Oryza sativa
caagtgttcgatgaaatgccgcacaacggaagcccggtgtccgttactgtagtctgtacctatcatcaggtttttgagaaacatttccggggaaatacgtatgttgcaatcatccattgaatacattctgagccctatgagcccagctataatcctgcaggatactgctgcaacagggcagacagacagaggattctgctgcacagcagggagaaggtgtgggggaaaatacgaagaaagagtagtagcaggactagctgctaaggtgtcaagagaaaattcaaaacattcggggcctttatattttgttgatctttttttttctgtgctaatgggagcaaaaccagttaaaattcgtgcgtcttcaactatttcttacaccaatctacgtatcttcctcatactcctacctgcaaacagatgaacatgaagagattgggaggcacctagcttaataattgaattcagagcacaagctgagagcaaagggatccgggggttgttggttcagcacagctgcacaagtggacattaaaaatcagcaaaaaaagataaggttttgttcattgatcatatatgatcacaccaaattgtgtatgcgcgcagaagataacagaagcaacagccttaaatattacatgatgagaaatacattgcccagttcacataagatgtcttgggagcccaggctatgctacccgtcgcaacgggcgagttcgagcgccttctcgaggttggccacgacttccgaaatggctggccgctcctcccactgcagctgcaggcagcgagctgctatctgcgccaccagttccgccgcctccagctgcctcggcgttggctccggtgccggccgcctgtccagaaacttccacagctcccccgcctcgatcagtatcagcgccaaggacaccaagctttggtgaccaatcccgtcctgctctagccactcataccacctttgttttgttgttttcccatcttcttcactctcctccttgtcctcttctgtgttcttcctctcttgctgatcacattcttccctcttctcctcttccacacattcttctgtcttcttctccttccattcttcagagaaatatggtttcttccccgtcaatacctccagcatcacaacacccaaactgtagacatcgactgtcgggttcagagtgccatctataatgcactccggggccaagtatcccaaggtgccttgtacgagaagatcaaccacatggtccgggccttcccatgtgagtgccagctcgaagtccgttaagtgcggtgcccagcttatgtcgagcaggatattggacgtcttgatgtcacggtggatcaccggccgctcagcgtaggactgcaagtactcaatggccctcgacacacctagcagtatctcgatgtgcatcttccaggatgttatcactggcgacgacgaccgtgggccgtgcaggtggctgttaagggagccgttctccatatactcaaggacgagtaggatctcttccagctttttccgaaacggtggcaggagctggcgcttctccttcacacagctgccaaagacgcggacgatgtgctcgtgactaaaggaacggaggatgctgagctctcttatgaggtctattttccctatgcaaaagtaaatagtacggagcatgcgtttgatggccacctcgcgtccgtcgggaagcctacccacgtacaccgggaagtagccccttaaaccaatttttctgtcaggagaaaagttgttcgtcgccgttgcgagcttcttaaaagcagggttggaaatttcggccgtttcggtgggtcccgatagacatgagctccggtcaaaaatttcggcaaacactgttcatggtcaaaatccccaaattcacggtcaaaatccccaatttcccatcccctcctcacttaccaaaggcggctgctgcttcgctatcctcctgcagctcgcccagcaggcagcaggtcgccgtcctcccaagctagcgaacagcggcggcggcggtgaccggaaccgaaggcggcgggttggttggagtggccagcggcggcgctccacggcgcgacgacgacacaagccgcgtgggcctcgcgaggctggacttctggagtggccggcggcgtctctgcggctcttcagcaccacgacgacgacacaagccgcgggcctcgcatcctccgtttggctggagttgccgccggcggctccatcgctcttcggcagcacgacgacgaccggacgatgacacaagccgcactagccttgcatccttgcgtgtttcattctcttgttcctctgctttggatttaatagactcgatgcttatctatactctgatcttggtcaaatttctttcttttttattgtttaaattcaaattttgtttgagaatttcgtccgaaattaccgaaaatttcggaaatttcggaatttcggtgacccccgaaatttttccccttcccgataggttgaaccttggtcaaatttctttcttttttattgtttaaattcaaattttgtttgagaatttcgtccgaaatttcggaatttcggtgacccccgaaatttttccccttcccgataggttgaaccctgcttaaaagtgaattcttttactccatggatttctgtccgaacaaactttgtggcaacctagtatatcgatgaatacacatcggaaagaaaagaggaactgaataccaaatcaaaagagttgcagttggtagtagtacaagtacaaacaattgaatgcttgagtcttcccatttcaatgtatacctgagcggcagggactggatttgggggcacggggaaagcaggcgtagatggtccgggcgtgttggttggaagcaggatgttgtagatacgatcgagacgacgagtgatgtctatgtggctgatgaatgggaagacgaggaggtacgagtcgatcctgctctgaacatctctgaacctctcagcctgccgccctgccatcaccaacctgtacacggcgctcttgtcctggcacgacaacacaagctcgtgcgcctcccggagcgtgtcgtcgagcccggtcagcggccgccggatctcaggccgccgaagcacctccggatcctgcaggtgctgcagcagctcggcgatcgtgaagacgcggcgggcgagctgctcgcactccttcttgttctgttgagccgtcatcgcagcctgcatgatcatggagatgaggccgccgacgtccgccccgaccagctgcgccaccgtggccgcgtgccccgtcacgtcccacagtgcgatggcactaagatcaggattctgttctttgttcctaacaaacggatcgacaaattaaggtgaaatgcagaggacggctaccgcgtcttgaagacttgatcctcagcgtctctctgaccttgcttattttatgctctagttgcccccctttttttgtgagagagggggataaggacgttgcttgtttttgacacaaattatatgacggaatcatgcaactgcctctccgtctccggtaaataaaatatgtccaataagttcatgaagtggacgtgactacgacgtaaccgtacactggattgtcatgaccagcgacctcactctcagatcgggttgctactactacacccaacattgcatgtattttttttcttcttataaaattttctcttaaattactcatctgatttacgatctgttacaccgttgtgttcgtaacaattaagatcacacataatctgttacctaacccattgccatccctaggtgcaaaggtaaaaaaatagcccagagcagttacgtaatgctctcccctagtttagcaaatttaagcaacgtgccattgctctgaacttgcacaatcacaacagagcagagataaaaacggtatgaaattttccagctgtaccggtaccattttcgatgaaatagtaaaaaaataaaaatttagtttttctaatttgtatatgtgtcgtattgaagttattactaactagtttcataaatatagaaaaatcctgtctgcgccaataccattttcaaataaataatatcattatcgatagttgttatccctaaatgtttgttttgaacttgtaacaacagtacaacgcaatcaagaaaaacacatacaaagataaaatccatacccctatccctatgccagtttatttcgatcaatttgactttgagcaaacctgatgatagagctttagtgaaaatcacagcaagcccaagccatcaaagacggtccactacagacatatgcatctcaaattgggctgaaaaatgggcccacgtaaaaaacatatttatagggccggcccatactaccgcacgtcaaccgcgaccccgtttccgcccagcgattcgtctccactagaacagaatccctcgacgacgacgaggccgcggcggcggtgccaacagcggagcagtcgagcagatagtgcaagcagtctcgcgccacgccactcccgaccatggcatgctgtcgcctcgagcgctcttgaaagagagaaggagcgaaaagttcaactcgccggagaggctatggtatactactggtatgattggtctttgagctccaagtgttcgatgaaatgtcccgctaaggaagcccagtgtccgttactgttatcaggtttttgagaaacatttccgggaaaatacgtcagttgcaatcatccattgaatacattctgagctttatgaacccagctttagtcctgtaggatactgctgcaacaggccagacagacagaggattctgctgcacagacatgcatgagattcttagttttaagagcagggagaaggtgtggggaaaatacgaagaaagagcagtagcaagagctgacaaggtgtcaagagaaaattcggaacacattcagagcctttatattctcttgattgattttttttttgtgctactgggagcaaaactagttaaaattcgtgcgtcttcaactacttcttacaccaatcgtcgtatcttcctcatacgacaggaagagattaacagatgaacaggaagagattgggaggcacctatcttaacaattgaattcacagcacaagctgagagcaagggatccgggggttgttggttcagcacagctgcacaagtgggcattataaatcagcaaagaagataaggttttgttcgttgatcacatgatcacaccacattggtatgtttaattgtgtatgcgcacagaaaaggagaggagaagcaacagcgttaattattacatgatgagaaatacattgcccaattattcacataagatgtctcgggagcctaggctatgctacccatcgcatcgggcgagctcgagcgccgtctcgaggttggccacgacttccaaaatggccggccgctcctcccactgcagccgcaggcagcgggcagccgtgtgcgccaccagttccaccgcttgcagctgcctcggcgttggctctgctgatggccgcctgtccagcaccttccgtagattaccctcctcaatcagtggcagcgcgaaggacaccaagtccctcctctttttcaaatcctcgtggagtttttgcgtcgtgtcctctttctcccattcttctctcttctgcgcctcttcttcacactcttctctcttgtcttctctcttcttctcctccgactcttcttcaaagaaatgtggtttcttccccgtcaataactcaagcatcacaacaccgaaaccgtagatatcgactgacgggttcagaatgcctgtcataacgtactccggtgccgcgtatccgtacgtgccaacaaccgtatcctcatggcctgggccttcccaggtgagcgccaacccgaagtccgtcaagcgcggcacccagttgccatcgaggaggatgttggacggcttgatgtcacggtggataatcggctgctcaccgcagtactgcaggtactcgatggcctgcgacacacctagcagtatttccatgcgtgtcttccaggacgccatcactggcgacgacgacgacgacgacgttgggccgtgcaggtggtgatccagcgagccgttctccatgtactcatagacaagcagatgctctttctccttttccttccggaacggtggcaggaggcgccgctgcttctcctcgaccaacacatcacagtagccatatagtggaacaatgtgcttgtagcggatgggggagaggattgtgatctctgccatgaactccttgtaaccctgaagtgagttccgactacggtgcttgatggcgaccacccgctcatcaggaagccttcccatgtacaccgagccgaagctaccttcaccgatctttctttcaggggcaaagttcttggtcgcctttgcgagctccttaaaattaaactcttggactctatggggttccttccagttccaacagatcttagcagtatcctagtatagagaaatgcacataatggaagaatggtaaaattagagctgagttctaacttctaagcttccctttgaagccaagtacaaagtgcaattgaaagtttgaggatatatatactccctccatcccattttaagtgcagccatgatttttccatgcccaactttcatcattcatcttatttaaaatttttttgaaaaaattttaaaacataagtcacgagtaaaatactattcatattttattatctcgtaacaacaaaaatactaattataaaattttttcaaataagacggacgatcaaagttgagcagagggagtattatatatgtatgcatttcaatgtgtacctgggaggctgggacagggatttggggcatggagacaggagacatagatggcccggccatgtcgttcggaagcaggatgttgtaaattcgatcgagacggcgagtgatgtccatgtggctaataactggaaagaggaggaggtaggagtcgatcctgctctgaacatccctgaacttttcagcctgcctcccggccatcaccaacctgtacacggcgctcttgtcctggcacgacaacacaagctcgtgcgcctcccggagcgtgtcgtcgagcccggtcagcggccgccggatctcaggccgccgcagcacctccggatcctgcaggtgctgcagcagctcggcgatggtgaagacgcggcgggcgagctgctcgcactccttcttgttctgctgagccgtcatcgccgcctgcatgatcatggtgatgaggccgccgatgtccgccccgaccagctgcgccaccgtcgccgcttgccccaacccaccccacagcgccatggcagtatctcaagttctcaactctcgggaggattgtgttcttgctaccaaattttcgcggaattatggatggacaaagggtcggtccagggaaggagatgactgacgcggtgagaggaattttcctggaagtgggttggtgtggactgtgaaatgattttttttttctttaaggccgacaaaagctttgggtttgtgtatatataagagagaaagcaacgagtggaatgaattatattttttttaacagtctcacacagccacagctcagagtttagacttcaaagtacgtccctgtccagttagaggggtaaaaagttttggcgtgttatataggatatacatacacatttaaaatattaaacgtagactaataattaaacggaatgtgaaggagatttattttacacatattatgatgtggatatactccctctcaatccccttcatttctccttgcttagggattaaacgaccaaggccttagttgtatatatggtgaaaatcaattatgaaatgagaagaaaaatcatccccaactgatctatcttcttctacttctgttcttcttcttcctcacgtgtcgttccaagtccacccgattcccgcgaaccacgccgccggcgattgggtcgtgacacgcacacgcctttagttagttggagtttaacgcggagacacttgaagttgaagaagcaaagcgcgtgtggctattttgattacttaattaggcaaatgattttatcgtctagtgctgagttactgacacagtgatccgaaagccagcgaagcaccagaatatattactcccaccatttcagaatgtttgacaccgttgactttctagcatatgcttaaccattcgtcttattaaaaaaattatgaaatatgtaaaactatatgtgtatatgaaaatatatttaacaatgaatcaaatgatatgaaaaaaataaatatgtaaaactatatgtgtatatgaaaatatatttaacaatgaatcaaatgatatgaaaaaaataaataaataattaattttttttataagacgaatggtcaagcatatgctagaaagtcaacggtgtcaaatattttgaaacggagggagtattatatcgacctgatgacctccatccctgatcaccttgtgtcaccaatattcttccgagttgcgagagatggcgatgtggggcgggctggggcaagcggcgacggtggcgcagctggtcggggcggacgtcggtggcctcatctccacgatcatccaggcggctggcacggctcggcagaacaagaaaaagtgcgagcagctggcacgccgcgtcttgaattcttgatgatcgccgagctgctgccacacctgcaggatccggaggtgatgcggcggccggaagtccggcggccactggccgggctcgaggacacgctccgggaggcgcacgagctcgtcgcgtcctgccaggagagcagcgcggcgtaccggctggtgatggccggacggcaggccgagaggttcagagatgttgagagcagcatcgattgttacctcctcgtcttccccttcatcagccacatcgaggtcacccgtcgactggatctcatccacaacatcctcgttccaaacgacacgacggtgccaccatctccatcagtaggctcctcgactcatgacctggtacgaattgttgctcgagtactgtacgaattgaatggcatatatccagtcatttgcagatcgagaagctttctttgttgaagagaagcttattagcaaactaactaccctctgtgacaggtatttgtagatgtcgttagaaaggtggcatcccatggaaagggaggcgaggtgttcaccctggtggagctggcggcggcgaccaacaacttcgccgctgacagagagattggttatggcagcttcggcactgtgtacaagggaacctttcccgacgggagaaaggtggccatcaagcacgaaggcgcggactcagtgcaggggcaccgggacgcgttcctatcagaggtcgacatcctccccacccttcgccacaggcacatcatacgcctcttgggctggtgcgtggccgagaaggagaactcgctcgtctacgagtacatgaagaacggctcgcttcacgaccatctgcacggtggtgctccatcgtcttcatcaccctctccggtgacaacttcgtggaggaagcacatggagatactgctgggcatttcgcgggccatagagtacctccactcgcacgccgtaacgccggtgatccaccgcgacgacaaggcgagcaacatcctactcgacgacacctgggcgccacgcttggcagatttcggtttgtcactcaaaatctcatgggacgatataaagtgtagaaatgcccccgtcatgggcacctctcgatatgccgacccggagtacattagcaccgggagattgacgttggccatggatgtctacagcttcggcgttgtgatgctggagatgttgacggggaagacggcggcggggcttgtttcgaacaacaagaacagcttggtgtcgtttgcgctgccaaagatcgaggccaagaaactcgaggaagtgctggataggcgcccggcgcagaagccgacagcgaggcagctccaggccacggacctcgtggcggcgacggcggcgcgatgcctgtgtcttcaggggaagaaacgaccggctatttcggaagtcgtggccgaacttacactggtggagaaaccatctttcgtcggtcggccgatttccacaatagtcccggatacaataaaaaccggggctaaagatgatctttagtcccggttcaaaagggtaacgggcatatttgatctttagtcccggtttgtgttaccaaccgggactaaagagggctgcagg

SEQ ID NO: 19330 - DNA, 2636 bp, Oryza sativa
acctttagtcccggttggtaacaccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttattgaattacatacaaatcagaggtgcctaaaaggtttgcaacttcatcctccaaagtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataatatttgtgtagggtttttttgactcatgtagatggatcggcaatggatgtacgctgaccgcgggtccaaagagattattgacggcgtgcattattttttgagagtggccgaagctaccaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggggaggaggaaatagctgctgatggtaacgacgttgcggatgatcttggtcagatgttgcagaacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgaaacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccccccggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaatagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggggagcataaaggtaccgtctggatactccacgaatatcaagcgaataataagcacgaaggagaagaagttcacaaactaaagtctcat

SEQ ID NO: 19331 - DNA, 1138 bp, Oryza sativa
ccatgctggcgccgccgcctccattcatgtttctttgtatagagttgcaacggtgtcatttttattttatttttttggatgttttttcacactcaggatcacgatacaaccaaccacaaaaaaaatttaaacttgaactaccacttagctaagtctaaaaatagctagcgtaccacttagtctactttgcaccttcactaaaattagaccataactcctttagtaaaaccctttgatcagcatgttaaacataatgcactctaccattatatgaaattacttaatctaattcaaaatataaccacatgaaatgacatatataagttaaacagtacataaagatgcaatttttttatttttattttatttttttgatattttttttcacacttaggagaacataggaaccaaccgtataaaaaataaactcaaacggacaaaatatgtgacttttagaattttccaaaactctatcgaaacggacaaaatatgtcatctattaaaataggcgtaactttctcatacggacttggaatcaggcaaataatatatgcacggacatctacagaaaaagttacatccgattctccctgctttgctgggttcggcgatattaaaacctccaaattccgcttgcaagattgtgttttcgaggagagaagtttttcggtagagctttggaaaatttgacatgccacatatttcgtctgtttgagtttattttttacatggttggttcctgtgagttcctcagtgtgaaaaaaatatcaaaaaataaaataaaaataaaaaagttgcacatctctctcctctgcactagttcggagagaggagaggagaggaaaaattctacaggtcacatattacgtccatttgagttcaatttttctatggttggttcttatgtgtccctaagcgtgaaaaaaaatatcaaacaaataaaacaaaaacaaaaaatttcagggggggtggggcgccagccactatggcgcactccccctagccacctcagcatcgcctgtaacgtcccgcctcccccaggccgggcccacttacatctgatagctttcataggtcatagactgccctcacagaccaacacatgtcttttctgcacacttttcctcactcgtgtgca

SEQ ID NO: 19332 - DNA, 1171 bp, Oryza sativa
attagcaaatgtttactgtagcatcacattgtcaaattatggtgcaattaggctcaaaagattcatctcgcaatttacatgcaaactgtgcaattgattttttttcatccacatttaatgctctattgtgtccaaatatttgatgtgacatttttggccaaaaatttttgggatcttaacacacccttagtgagatggtcccttgcttgtatttttggaaaacaaaataggaccatgaggggacttcaaagggtctgaaatggcatctttcctacacctattcaattgcttttatcttgtataagatgccattgattcagacctgaaaagacagcagcacatgggctgaggaggggttggtcgaccccttggttcggccgaaccaagggtggctcttcccttgttggcagttgctaagcaccaatttcgaccgtcaatatactcaataaataaaaggaaactagcatttcttatacacatattagttacaaataatgttgttccacttgtccttggagaatattatggatacagggattattgttaacgaccaaatttggtaatatcggcatcggagatgaagatgggatctaagcgaaatcgaagataagggtgttgtggaaacagagcaagaatcggctgcaatctaaatcggctacggttaggatcggcagagttcgagtcggacggggctagccgatacagccgattccggcaatacgatttggtgtatgtcatcgggttgagttaatatgcttcatggtggttgccacgcaaggatagagtcctgagaaggcaactgtatctattaattaggatattttatgtaatttccttaaaatatgtttgggcaaaagtctgccgtaaagacttatggtattttagagtttgttagagataatagtcgtgtccgagatggatatatcttgtaattctcgggtataaatagaccctgagcctcatgtaaaaaaagggacacacattcaatacaatttcggcgcatcgccacccttttgcttttgttttatttcgacgagttcttgctttcgggttgagctgcatcggttttaatctttaacaaaaggtaaagcttgttatggcggtttgcattctcgggattagtgcttccatttttatgacactctaattttgttcatgtaatccgtcgagt

SEQ ID NO: 19333 - DNA, 25672 bp, Oryza sativa
  unsure (1)..(25672): unsure at all n locations
gattaggttagatattgacgttgatttaggttatataggatatctaccactctatgaatttccagcggcttgattgtctagatattgttcttcttttcatactaaatgctgcatcagttgagtntgatctattaagtcgtgcttagaacttcaatctctagcttgtcttctggttgccgattagggtagtatcggagtttcagccaatcttacctgatttaactacttttatcctatatgcttgattgatatgttaaatctgccctttatgttaagatcttgttgcatttaagtatattaggcttctgcttgatgtattctgcttgctttaatatcttaatatagagtagtatcggagtattagccgatacatgctagatctatctgatcggctatgctataaatgtatctagtcccattattaatatatatttcgatctaagtgatttatactgtctcggcatggcgtccgatctatcccaatcacttgatttaagtatatatcgatatagggagtatatattgttaatatctacagccgatcgagtaggtttagtttctccttatctattcacaactgccgatcgatgtacatatgacatcggctcaaagataaatgatatgtcatcggcacttagccgatcggctatcgtttatagatttaattacggtttctttgttgttatttcttgttgattgcaggatcaaatcaactggcacgctcatacatccgaaggcgagttttggacctgcactggagttaagcagatctcccaggcctcgtgttttctgtcaacaattatacaataaagtgaaggagaaaatgcaccagcatgtaagtaaacacacctccagcgaatcacgtgaaagcacacggattgaagggcccacaagtcaaataaaaccgacataatttgggctaatccattgtgcaccatcctaggggcctacttgtcagcctcgagagagaaggtcggtggagaaaggcggttgccttggttcagctgaaccaagggtcagccgaaccaggctcagcccctctcacctccaccttccacgtggcagctcctggttggtccctgatagcggttatgggtgcaccgacctctacaaccgtcattggagactataaaaagattatacattctcacttcacaacacacactcaaggagcaattctctctagtattagtagagttaggcttagtcttcggtttcctagtcttctcggagattcggatatctttttagtattttactctatttgtaagactatgagcttaataaagaatgtatcttctttaattattaatgtttatagttctactactttattagttatgtattctatgactagtttatacttcgtttacatgcttcacttgattaggctagtcaatctatgccacggtatttgttaaatgatcttaatgtgttgcactagttctaacttgtctatccgaagggtgggagtcccagataaattagtgatattttttagcaatgtaagcatgatacttagattgattaaatactgttgggtgcggggtgtgccccacggaaaatagaggcaagcgacaggtgctaacagccctgtccgtctttcgtatttctccatgtttgggtatgacgtaagagttcgtaaaatgccataaccatgctagcagaccagtagggaatggtctctcggtggttcttgggcgcctagaactaaatcctagccttgtaagcatgtatatgttaagtatagtctaaagcattataaatattgaaatgcatatgaaacttagctctctttcgtccttttccacaatctagtgtattcttattacagttgaatcttttgtgtaccacaatacccatactagactatggtatattacccataccatgattatgaatatagtggctcaagtctttacaccgccaccttccctacgggaaaacagataacgatacccttggaatactctcgggtgaaaagctacagtggtattgttgatgcgaaaacacgcgcggcctgagagatctgcttagctccaatgcaggtccaaggcttacctcgagtgctaacggcgtgccagctgatttgatcctgcaatcaacaaggaaacaaaagaggggagattagtcaaccgatagccaatcggccggtacgccgacagcgtatcgttggtggtccccagccgattggatcggctatggacgggatatatcaaagaatatgcatgctctaagaatgccctctcggctaatgcactgtccgcagagataaaaacatatgagctcaagacaaagcttgcaaggacagccgataaagtaaatacagagcaaaaagataacgtaccagctcgtaccctggcacatacctatacaggcgagccaagctatagcaaggcgccgagattgaaccgatggtcgaattagcggccctagccgatacgatgcagtctcgatgccaagctatagcgaagcccatctatataggtggcggatacacatgtaacgatctaagaaacaagcatatcaggtaagatcggctgaaaccccgatactatctctaattatgaataattccatgttagtttccagggttctaaacacgactagggatgatgcatctcaaaatatgtaaataaacctaaagtctaaacaatcaaggaattaaacacttttcaagatggtagatgacttagctaatctaatctagtaagacgatttagccgataccggcagaaaccctaaagcgagagacagccgatagagctaaatcgagatactaagattagattaactaaggcatatgataatgatggtcatgataaaagaactaaaacatctaaagtgatgtaatagccccgatagcacaagccatcgagacgggttacctcttgcggagagaactcaccgaaaacaagaaaagtaaaaagggtggcgatgcgccaaagttgtattggattgtctcccgtattacagtgctagtgggttaatatttatacactgagtacaaggtaagtccgttatggacacgactcaaaccttctaaactctagatacaaacaagactatttacagcggtctctgaccaaaactgaccaaaccgacgtaactaacctaattaatatatacaactgccttcaatgagctctatctctatttggcaataacggttattccaaaattgggtccgtgccgagcccgagttgcattatgatggctggttcatttatcagccgactcggctggtcctggtcgctggcttctgttctcggccgatgcaatcccttgccgtcgcatagttaaactcgagtcccagcatatttcggtatcaaatctatcctgattttcttcttccttcctgagtttttgttgctaaatttcaccgttaacaggtatccgtgcacttgtggatttatctatgaccgtatcaaatatactctccgaaggttcaaaaggagaaacgaccgtcacttcttcgattggctcggattcggggagaggttccgtcaaagaatttttcaatcgtgagatcaggacgaaaaaaagtcactctctagttttatgtcgaggactcttgctgttggtgcatctagaagaagttttcctaattgatagccaatcagaagatcgaagtcatggacttcgaacatgtgaaagtctaggatggcctcgatattattgtgccttacaggcactccacatagaatcccacaaccttcaataatagaacctaaggcactccggaagattttatctatgcgtactaacggttcatcccctaagcaagtaaatgcaaaggttgcggatatgatgttggcaccgacaatgggattgtagagaactttcaccatatcctttttcacgagataatgcatagttgaggatgaggagctaatccgcatggcttcaggagaaagctcaacctcccttaaccactcatcgcttatgatagtaattaattctctcaccgtctctttgaggaaactttcctcgagcggattagagggactactcgggataggtggtctcttttgacacaaatagtccgaggtgtttccataatcttcaaaaagatcatcctcgaactagaaagggatttccgaaggctgaatttcttcttcctccaattcccgaggttcgggtgagggctcaaaggttgaatcttgcgatgtggagggtatatgctccgattcaaaggttgagggctcctcatgtgtatactcgatttcctagatggttttgcagtggacgaaaggggtgttcttcaggatgtgatccaagaacttcctttcttttgccatggtttttttgtgcgaatgaacctcctgcagaaatatcgagatacgaggcagactctttgtttagacccaaatagaagtgttgtaacaacacatgattgggtatagacaagtctgggccgaattgagttaataatgagaacctagcccaggctgctccaatggattccttctcactttgttgaaagccgagaacctccatacatagagagacaacacattgtaacggaaagaaagtaaggtagaacctgtttttgacttttgtccgttcactatgtgtctttcaaacggtatgggtgtaccattacttcgccccctctataagagagaagagaaataactcccactttaaggtttcttgtgtcagacacaagcacaattgctcgaactcacgctgatgatggtagaaattttcgttatcgcgtcccaagagggattgctcctaaaccatggctacaaagcgaggacagagttcatggccagatgagaagatggattttgaagagggtgatggctcacaaaactcgcccttagaagcgaaatttttttgaatagatagctactccatggtagagaagaatagaaatgaagaagataaaaaaatacgaggatgaaccaaattcgaagataatacatagcaaccgttccccgagaacggcgtcataaatacttattggtatttgatactatcacagataaatccgtaagcgcacggataccgctgtagcacttcacctcaaagtatttcaaaggtatcgaatcacatggaacatgtgtgtaaaatgtaagaaacaagattcaaccaagaacaacaactaatggaaggcttaggatagggatgatttctatgggttttaaagttcttaattaagttaaggtaaaacactatcagttgattcgggcaccggttcacccctggtctgccaagagactccggcctatagctccatgatatacccaaacatagaggattacaaaggatggacatggctgtcactacctatcacatacctctacaagcacacaacaatcgaaggtaacctctaacctagacaccacgtatatgttattgaggagtactactttagccttgcgcagaaactttcttctttatccagagtcttagtactagagcacccaatacaagtatcaagcgacgagcccgcaatgatgagaatatatcttacttaaataagaaaactaaatacgcgaaagaaattatgaatacttacttatataaaagcattagccgaggtacgatagtggagagagtgttgacaaccccggcactcctccagactcccctaaaaagaaagccaacatctccggcacttctccggaacatcctcggagagaatgccgacatctgaggtactccttccggagcttctcctcattctcttcctatattctaactctactagagagtaacctaaatatgaaagtaagttgtagtccactttgttgtgtgtctcttgagagtaaagtgagagctccttttataggcatcctatgatggtagttaagtcgattaacacccctaatcgccattgggagccaatcatgtagtgccacgtggaaggcggtggcgaggggtgcaacccctggttcggccgaaccagggaaactgcttttgttcaccgaccttccctgggagactatcaggtgggcccttatgacggtgcacggtggataggctcaattatgttggttttgctctaatttgtggtccctccaatccgtatactcgcgtctgattggccggaggtatatttcttcgcatgacgtgtggttttcgtccaaaatcacctgcatacaaatatttatcaaacttgtgagaatgattagtaatactccctccgggttgataatacttgtcgttttggataatggtaaagtcaaactttaaaatttttaactacaaataatttttaaaatatttatcttaaaaatatgaaaaccatatgtgtagattagtcttaaaaagtacttcaataaaatcatatattttttgatatttctatatatattataatagaaaatagtcatcaaagttacttttgggagaccgtgcccttgtccaaaacgacaagtattattaacccggagggagtaaccactactattaagtttgatgttttacttcatttgcttttatgtgggaattgactgttagatttggtatttaaggaccgtcaacactgatccagggattgatacagggaaacataataggttttggtttccgaaatcggggactgacacaggcgatgcgacgcacgaccctcatggaccggcgcaccgcagctccacttgtcacagccttcctctttggtggcatcttgttagtgtggagggcttgagagtttgcgttcgataccccacgaacggcgccaatgttagaacaaaatccaacagttatcgaacgagacaaagtgtgtatctaataccggtattatattctttcttctgccccctctctgaggggcaggctacatatttatgtgggccagtgtttcggggcaacccgggtggccgacaagtgacccccaccttcgggattaatcagtaaaatcctaggcaaccgggataggtgatccattaaagcttgagccagcccaatctcgtagatcccgggatcgccatcgtgtacatgctcccgtgatccatggccttgactgcagcccctccactacccgacccagagcaggtggctagggcagtggcggagccagcgacgaaaacctgtggggtcaaatctataaaattctttaagttttatattgttgcaatgtaaatatcagtagtttttagactattttgcaaaaacctgaccccacagattatacctagctccgccactgggctagggtaggtggggggtggctaattagcgcacgcatgctagcaacattgctggcgtgccctcctcccttgcgtgattttttattttttttgctatttttttttcacgctcgccagctggcgcaccctcctccctcgcgcgatttttttcttttttttcgtgatttttttcactttccttttttttaatcttcaacacacgtgttttcaaatgttttgagttgaaaattttaaatcttgacttgaaaattttcaaatcttaacttaaaaattttcaaatctccagttgaaagtttttaaatctgagttgaaagtttttaaatctaaaaaaagttttaaatctcgagttgaaagttttcaaatctcgaattgaaaattttcaaataccgagttaaaagttttcaaatctaggtcgaaagttttcaaattttgacttcaaaaaattcaaatttcgagttaaaagttttcaaatctggattgaaagttttcagaatttgacttcacgtataaatttcttttgtatctattactgaaaaaaatctttagaaaaaaaatcttattttaattatcatcattatcttaacggattagttagtataggtgtgggccggaaattacgctccggggggcgcatacgcccgagagaggaatctcgagagttggtgaggggtattaatgctcacgtccaatcatcataatcctcgcgtggaaggggcggcaacctccggaggctgggaaaccttacggaggctggccctccctctccatcctgcatcagactgtaacggaatattccttcaggcttactcagcagacgatgagacgagctcactataggaggacttgaagtcagtgggtcaatgggcttcggcgacgcggtgcttagctagtttggttgcttgcttcccacggttccgtgagaaaatttgcaaattgttgagagggacagacagggacgattgctgaactagacagtagacagacaggagggaggaagattattctacgacttaatcttaaccgtttctcttgtcaatttggatgatagcagcaatacatatcagagcttttatacctaattaaactagcaatgattaaggtcttaattgctaaatttcttagaccaccgtatacttagaccaccgtatagttaatcatgtgcttgtctatacctataccatcagtggcggatttagaaagaaatagcagtgggatctaaacaaattagatagagttatagtccccctcccatatacatatggtaaaaaatttcagtgggatcttcgtgtggattctcatagtcttcacgtcagaaatgagggctccagaccccgccggccccatgctagatctgcccctgtataccatgcttatacataagctgctatgattttggtggcgtaggcacacagcgcttaaccgctcaacggcatagatcatctcaattaaggtcaaccagggcatctgactgtaataaagataattgtatggtctactctctccattcgtttattataagataatttttaagtttgatcaaacttttaacaaaatataacaacatctgtaacaccaaatttgtgtcattaaatctaccatttaatataatttttataatatacttgttttattttgtaattgttgttatattttttctataaatatggttaaacttaaagaagtttaacttataacaaaatcaaaacgtcttattgtgaaatggagggactagtacgcaaaacatcccttagctgctacataaccgcacaaactcgatcacacggtcatgtgaggcctgagtaggatcgtaactgatagttgcgatcctgagggcttgttttgtgagatgatatgtgaggaggggagactctcctggacatacgcgaacgaggattggtgtgatcgaagcttccaaattatggtacgttctaaacaactaatagagttatagattatttgtggcacgcttctaaaaatatgatttcttccaaaacttttctacatattatccagttagaacgcgccctaagtgtgatgctgttttaacgaagcaatcatcacccatttacacggataatttagtttgagtaattagtatttggagaaacatctgtatttaagaaaaagtgagcaacacgaaagatctatttttttccccgtcttgggctaatgggatgccagcggttgaagtctctgagatatgcaggaacaatttagctctccagtttgttcgggttaaagaaaaaaaggaataggccatgctttcagagtttcagatgcaaaccatcaagtcaatgcagtgatgccaaattcagtagtgccgtatatgatgggcgtgggaccgtgggcgacgactaattaggtgcgtccgccgcgttcttgtcttgttcaggaggttggaattttttgctgcttgtcaaattcattgaccacaagtctccaactcaacatcatcctcagggtgtgtttagtttacgtcaaaattgaaagtttggttaaaattgtaacgatgtaacagaaaagttgaaagtttgtgtgtgtaggaaagttttgatgtgatggaaaagttggaagtttgaaaaaaaaaattgtaactaaactcggcctcagagttaaaacacaaattaaacatgatccaaaaacatcaagtaaacagaaatataattcgtctgataatatcgatcgggagcatataaacttcattcaaactttattattattactactcgctcatgcagagcgtctgaagatcatgcagaattacagaatgaagcaaacatgatggactcaactcgactacacagacatgcagaacacagcattacagtacacacagactcgatcacactgaaactgcttattattaagatgaagctaggaatgggcggatatatatccaatttgaattgaatccgatcatgaaattaaatgcagttcagatgatatccaacccaattccgttgcaacccgaatgcatgatgtggaaatccatgtgttatgtgtatcatcacgtagtccatggatttccggatacccaaatatgcgataaaatgaaagcttgacctgttcggggaatcatgcagtacccttggtacttgatctcgatcggtgctcgccgccgtggcgattctttgggtgtcgccgcggcggcggcgccgtcgtcgtcatcactggtggtgatggatcaagcacgagctgcgcctgcgcagctgccggagcttagatgcttgcatggcttcctccgtgcacgcgcgcgtggatcacatcacggagcaggaggtgggatcctcctccatggagtggacaaggtagtaagggaagacggcgccggtgggggtgcatggctgcggctgcggcggtggcccggccgccttcttgcctttcctccgtttgccgcccttccctccgttctgcttgtgctgctgcccgcccttgttacctttgttgccgctcttgccggcgttgatctccctctgctccgaagattggtcagctcaatcggctaaagaggaaaaaaaaaaaaacaaggagtaattttgatgagccatgtatcttactggattgtttgtgcggcggtgatcgcccccaccagcggcgacggcgaggtggcggtccatcttcttctgtaggtgggcaacgttgacggcctggagggcgatgaggcagttgttgatcctactgttgacgtcatcgagcttggcggcgagcccgtcgctggccacgaacctgtggagcctgaagagcagaccgtccctgctcctgccgcaggactcgacgagcttgagcgcgtcgtcgagggcgtccttgagacggcccagaatcttccgcgtcgtcgccgccgcgtctcccatggccaccttcttgtactccctcaggatgtcgtcgacttccttcacgcgctgggctagctcccggcacctggtcttgttccggcgagccgtcttcactgccttggcgatcgccgaagccaccttcggcaccgcgcccacgatgctgcccaccggctccatctttgaggttgttgatcacccggggctgcttgctttgctttctctaacgttgcggtactgctcttgcaagaagaggaagtgtggccactctacttatcgtggaggccattgacggctggccaaacggatctagtgctacgatgcgaacggtgagccgtactatcttatatcatattcacgtgaggacaatgctttgaaactatgggcctgtctagattccatcccagaattttataccctatcacattgaacatttgaacacctacataaagtattaaatatagactaaaaaaataactaattacacagattgcgactactttgcgagacgaatcttttaagtctaattgctccatgatttgataatgtggtgctacagtaaacatgtgctaatgacagattaattagtcttaataaattcgtctcgcgatttactgatgggtactgtaattaattttttattagtgccccaacaccctatgcgacatcctatataatatctgatgtgatacgtcaaaactttataccctaggtctaaacccgtgttcttggatcacaattgaacggatatgattcatgttcaaggagagcgtggtactatactgtaacggaatattcctctgtccactccgcgggtgagctttcacgacgcggtgattagtttggctagctgcttccctgcagtttcgtgagagcatcttcgtcagaattgccaaaccactccaagccaaaattgagcaaatgtgagaaaaaatactctccaactggctctataagtatgcgtttggttcatggaaggttggatgggatatcacagttcatattttattggatatggcgatctttttttttttaagtgaatatgacgatccagttttttttatttggttatagggatgaaggtagatctggtgatgcaattttttgtttggttggaggaagtagggtggatttgcaggtgtagtcacctctcacttgagacggtgaatatacccccatcaaattaatacataacacaaatcataaattctccaacaattttacaccactacctccattataaatacacatagaaaaaagaaaaaagaaaaagaaaaaaggaaaaaaagaaaagaaaaaagcagggtggatctaggggctcagcgccgccgcctactcctcctcccactagctgctgttgctcgcttcctcccgccgatgtggcactcgccgcccgcatcgtcgttgttgtcaccgggttcgcatcgtcaccgttcaccggccgggctcacatcgtcatcgtcgtcgccgcggtgctcatctcccgcgccggatctccgagctcaccgccactccctcctcccgccgacggggcgctcgccacccacaccggccgcagcgcatcatcgtcgccatcactaggcactcatcggcattgtcgtcatcagccggctcgcatcgtcatcgtcgtcgccccctctctctccatggaggtgacgcgaccgctcgccccactcgtccggtcgctcgggcggctgcatccgggtgatttggctagagccagccatccggcatgtgaggagaatattctcctccgggccgccatatcccgtctccgcccaccaaccaaacacctaaaaaaacgggctgccatgtcctatccacccaaatcctcccatccaaacacaccctaagccatccaactagccaaaatacacccaaacacaccctaagccatccaactagccaaaatacaccactggctggccaaatctggccagccgctggctagcccatcctagggttcaatattttttattgggggtaccaatatggtccaaaataatttgattttttcacaaaactatgatggtagcccgcgtattcgactcctctgacttcgcacgcgaacagtagaggcgcacagtaaaatgagtctagcgctacagtgtgaaacaccacctctatttaaacagtggaaaacagtaaaaaatcgctggtttgatgtactgttcactattactgtgctacactgtagcgattgatcttgatcgtcgattattcatcggacggctgagacccatgtgaagtcggtactgtgcttctctgacttcacatccgatttggtagcccgcacatatgcgtaggcaccttacttaatttgtgtgaaattttattatgaatgtctatgtacaggtagttttctatcaaaaatattatttttctttatcctaaactaaaactaaacttttttaacatgctttgaactttggtttgcacagtgcaatataagtcccatggcggtttgcacgtcggttttagctgacgtagcgcctatgtggctagtttgactcggtctttatcccacgtggtattgacatgtcgcttacatggcaatctaatcttaaaaaataataatcgtgggcccacatgtcagttacaatgaaaaaataattaaaaatagtggggcccacgtgtcattactccagtgacaggttgttgcaaagcaacctgtggaatagggcgaggcgtgagccttatcccagaactaaaacttgatacattagagttttgcagctaaattatttaaaggtcttgggtttttcaaatgaaaccctaccactccttgtttttagccttgcatgtcatatttttttcatggcttgctgagtacactgagtactcacccttacttatatttatatttatagagttagaggaagtataccttgacccttctgtcgaggcctactttcaggagcaagtcgagtacgatttctcggggtttcaagcctagttcccaaacatagcctgtggatttacggttgtcatcctgtttctagtgctttcctttccatgtttccctccactgcttttatgcttccacctatgtgtaccttatctttccagtgttcctaccagtctggggtttgtccacgacggtagtagtttgagacctccttgtaataaagctttgttatttctaaatttcactattattctatgagtaccagcttgtatattctgggactggtactgtaaacacagttaatgttgtgaccttcagcctatgccggtttgtattcttgattggcatagtttggggtgccacagagcccaagcaaagaagcacgggtgtcataaatttcggctcatctgagccgaacagggcagaccaaatggccgacagatatcccaaagtggttcggagtggaaaggtattttgtacaccccaggtgccatagcacctggtatatgcatatggtttaaatagttatatggaaaattcataaattttgacaagataaattacgttaatataagacactatacaatgcaagtcatttacacatgaagaaacaaaaatagcaaattttatctacgctttacatgtacaattcattgcctgattttattagttttgtttctctagttgtacatgaaattgagtcttttatgtttatctatagatttatatcatctatctattatattattaaaacagctttgaaaggaggcatcacgttcgctgtgaggctagaaattttcatattaattagagaaaaagagaaaactttacaccgttagatcgtagttgtctaaattttaagggctaagatttaatagaaatatacgtagaagttttaatatggcctttagaatcagatacggatacgtgtgttatagaaattggccagcatgcagctagctagacttttcttaccaaactagcactaggaaacaaaattgcaataggaatctagggaaaaaaactatgtccgtgtatgattttgtatccgattgctatggtggctagctaaaaaaaaagagatactacaaagcaatcaagtttctcatctgccgtctccaacaaaataacaaagaaataggagccagagaaagagaaggtatgacatagacgagagaaatagatatatttgatggctggtccatttgttcaattacctcggataactctttgtactctacttctgctataagcgatagaaatttccacattaaaccaaaaaaataattgttcaagtaaaaatacaatttaaaagtaactaaaattcggaattagaaataagcaatattgaaaggagagtctatataagaatccaatatgagattaattaaaatttcaaataaaaataaaataaaatcagaaatttaaaaaaacaaaagaagagttcaagtagtaaaaataactaaaatttggaattaaatataagcaatattaaaagaagagtccaaataagaacccaacacgagagtaattgaaatttaaaataaaaacatgaaaaatacaaaaataaaatgagagtggaatacattatataaataactaaaattcgtaataaaaaaaataaaaagtattgaaagaagacaccatctagagagattaattaaaaaacggaataagaaataaaataaattctaaaatataaaaataattataagaattcaagtaggaatcaatttataaataaaaaatatcggaatgaaaaatatggaattttcaaaaaaaaaggccatttagaacactgcgatgacaaatacaataaagaggagagaaaacaataagcctgtaaaggaatagagtggtggtggttgatgggacatcaaaaactataaaaaaaacccgaaatagaatcacaatgacaattaagaggagggacgacggcatgccattaagaaacatggttacggcagtcggcgagacttatagaaagtaaaaaataaaccccaatgataatcatgttcgattttaaaaatctttgtgggtgggccgtagatgagtacagtggcgaagccgctaacgttttggtgggacttagtaaaaaggaacacaaacaataattatgtttattttttaaatcccaatgataacaaagagaggatgcggcggacgggccgtagtggagtacattggcgacgtttgacgggacttctaaaaattataaaaacgaaacccaacgagacaatgaaatctgaaaactacaaggtctaattttcaaagttataaagaggataaataaaagtagtgatagatcgagcaatcaaatataggggtgacagaggagtaagggtggcgactgacgtgacttttaaaaacttcaaaattagaaacacgggaatgataaattttaaataaaatcatatgtaaaaaacaaataattttatactggtgctagccgcgtaattgcgcgggccacccaactagaaaaataattataagagttaaagcaggaatatattttataaataaaacaatatcggaaagaaaaatatggaatttccaaacaaagaaatttcatctagaaaacagatgacaaatgacaataaagatgggagaagcagcaggccagtaatggagtagagtggtaacggttgatggggcatctcaaaactattaagaaagccccaaatagaatcccaatgattattgaaagtaggaaaaacggacatgtcgttaagcaacacagtcaaggcggttggcgggacttctaaaaagtaaaaaataaagaggggaggcagcggcgaggcgtagaggagtacagtggcaaagccaatgataatttggcgggacttctagaaagtaaaaaatgaataccaacgataattatgtttgatttaaatctcaatgacaataaagagatgaggcaacggacgggttataaagaagtacagtagcagtgtttgatgggacttctaaaaattatagaagtgaaaccccaacgaagataataaactctaaaaattataaggtccaatttttaaaggttctaaagagaataaatagaagcagtggtaacggttgatgagacatctaaaaactattaacaaaaccccaaatataatccaatgacgattaaaagcaaggacgacggataggccgttaagcaacacagtcacgacataataaaaaataaacccaatgataattatgtttgattttgaaatcccatggacaataaagagggcagttagcgggtgagccgtagagaaatacaatagcaaagccagtgatggtttggcgggacttctagaaagtaaaagatgaatctaaacgataatcatatgtttgatttttaaaatcccagtgtaattaagagatgaggcaacggatgggtcgtagaggagtagaggaatacagttacagcgagtgacaacgtttgacgggacttcaaaaaattataaaaataaaacccaacgacgataataaactataaaaactacaatgtctaatttttaatttttaaaggttcaaagagagagaatagaagcagtaatagatcgagcaagtaaataaggaagggggtgaggaagaagtaaggagtaacaactggtatgactttcaactataaaattagaaatacggggatgataaggtttggtcttttaaagtcttaaaacaacgagatagctatttaataaattttaagtaaaatcattttaaaaaatagataattttaaatgggtactagccgcgcaattgcgcgggccacccagctagttccaattaatgttaccatttttttaaatttttctgtaactttttaaatcgcatgtatataacgggtgccatggccgaaattgctattgtgcggatatccacgcgccctccccccgcacggcgcaaccacgtgcacatgccgacacgcggagatgggggatggcgggagggcacgggaagagggggctcgtgttggtttttccggtttttacaaagtttgggcgcttaactaaacagacgtttagcgtgcatatttgcaaagcaatacttctgaaccgaagatttctgtgctcaagaggcttggagttttgtcagaaatgcatccctgacgaagacgccaccgccacgccatgtaagtaacaagattttgatactgaaatgttccgaaactcgtaactacatccctgaagaggacgccaacgccatgactgaacgtgtttcctttgcaagacaccattgtcttgtttcctgctggtgagaccatatcaatattttttcggctcatcttggccacacagccagatcgaaggaaccgagggggtcgcagttttaaactccgaaccctatttatcttctcagatggccgttactatagctcggcccattgagaggagcccgcgcaacccattaattaaggtgcaagttgggtgggggccatttagcctgagagaatttggtgaataaaaattgaaaatatatattatttttgaattttttttgcaattatacacgtgtctttaaaagatttacgaaaatatacgtgtcccgctgtctggccgcgcgccacccagtgcagccgactgatgtgattacatgcatgcgctgccttcatgcattcggtggcgcggccaagacgtgggaccgttggtcctgcgcgtacacgccgcgccaataaaccggtcacgcaggccacggcgtgatacacgaatattttcgtaaatttttcaaaaacacgtgtataattgcaaaaggttcaaaaataatgtatattttcatgcgtgcgccgcgaggacgacgacgacaaccagccccatcatttgatatattggaggaaaaaacggtatatttgtaaatgaaaaataatctattatctactaaaagttcattagacttcctataaacgctcttatgccaccacgtaacgctctaataaattagagaaaatcgtaaaatttctatgaaaaaagatctagtcattgatttttatttaaattggtggatccataatttaattttacaccgtcagattagattaatctccgggctctcggatacctctcctgccaaagccctctccacgcccctgccacctcccacacgcccctatttctgatttttttttccttttgattggtggttaagatatttaatggcctattttatatagaaatttaattaaattttcacttctcttttctaacgtgtaggctgagaactgactatgcaccgcttgcatccatgcacttcgcatgcattcgtggtttatacttattgagttggtccttttaaaaataaataaacaatattttaagtgatatagcttttatgttgtatataaacaatttgtgatcgatttgaaccattctatgcatttctttacttaaacgatttcaggcgtgaactatgcttcagagtaaaacacaaatattacatgttggacccaagaccactaaattaaagacgatcataaaaattctcactaaaatgcaaaatatccaggaaccttttattatggaattggtatatatcttttgatggaaaatcatgggggcaaaacatgcaaattttccaccattggatacgttttaagatgcatgcgtgggagagagaaaaaaaatcgaatggcgcatggataccaaggatcgaaccggcgatcaacgcacaaaacgctagagcatgtgttcactactgagctttgtaacttttctattttacaatgtaattacatatatctttcttgtatcacaattagatacgagttatttacactgctattgtattataattacatttacaagatttttaggggattttgtatcaaatgttagataggcggtctctatttttttaatctaaatgacaatgagaggccgttagaaatacatgcaacgcctttctatcattagaaatatacacaatgtctttctgccaactgtcccaccacccctatcctcacctcctcttgcctctcctttactccttttttcctatagtagttgagataatatttataacttattataataaatatcaaaaaactaacttttagattacccaaacaattattatttgttaacaccgttatatttcttacaattaaatctctatgttatctatattttaatttatgaaaaataaatattattttgggtaggaccctatgcatcatatctaaggggaaaagaacaacaacatatattgtaatatcatctatcgctttacaaacatgcataattaaattagctctacaatgttttaaattatactttagatcgtattttgaatctttgcatgaaatcccaacggacatgaaaattatgaaaaacatgacaatataaagtatgtcactatatacctttaaacagactaaattgaatttataatgtcagcaagtaacatatcctatctttatctttagatttataaatatgcttaacatggatggtccaatctattcggcccctatgcggggtaacctaaagtatcaaccctatttaccaccatgtataaattctacattttagagatcgactatattaactccctaaataataagcaaaagagcatgggggtacatgttttctctttgatttctattaaatatgtatggtatgaaggtatttcatactaactttggttaattacggaacacaaatcatactaaacttatattagtgccctaaactaataagagaatagtgagagtacatatcatgtcatttcctatttgatttccactaaatatttatggtatgtaatatatcctaaaatccataaagacaagtataatagtgaagaaaaaaatttagcaactccaaaaacaaaatatgataaatattttaaaaaaaacacgcaccatacaaccatagtttcataggaaccaactctattgttgtgccataatattttctcatgaattcaagattgtatggttttaagtaattttagtttagaatttatatgttgcaagagtaatcaaaagaaattcatagccaacattcaaagtaattgcatacaaattatttgccaaaatagacttagaatagagttaatgaatatttcaagaaaagtccacctacgtagaatcattattttaaattaaaataacaataaataaggtgcccacaaacattaaaacgataataaataagatgcgcgggctacctttctagtttgtgaataaaacttttatatatgtattcttaggctccgttcgttctccagttttggagagaaaattttgtggcacgcaaaacaagaaatctcattagcatttgattaattaaatattaactattataaatttaaaaaatgaatttatttacttttttaaaacaacttacatatagaaactttcttaagaaaacacactatttaacagtttagaaagcgtgctaacggaaaacgagaaagttgaagtttggagttgaagaattgaacaaggccttaatgatctaaaagcaaatgataaaaattaaactacgataaaaaaccccaaaatcaactccgagtttaagtttgaaaattcaaattttggataacaagcataaccataagcgatggcaacggcgaacatccggagaggagataaatggacaacgtgcagattagttgctgcttgatcgtgcgctgtgcgagagacggccggggccggggacgtgcttccgcggccaacttccaagcaaccgcggatccactctcggcgtaaccggagaagtacgtcggctctcgccgggatgagtgacggagcgcaaggttcgcctcgcaactcactggagagccctgacctgccactgccagcccaaaggacatgacctctctgacataggcaatgggctctcacgtgttcgatgaaatgccgtgctgagtagaccaagtgcctgtgcattctaagtatatattgcaaaatctgtccaagtttcacgaaaggtgcgtcaatttcaatcgtcctcttttgataccatccgatggtatgcattgtgctaagggctcgaacttgcaacctgcaggctgagcatgagcagcaactaagccagaggacagctgctgcagagaaacgctcgaacctgtaaccctttgggaaactatgtagttacctcgagaggatgacctctcgttgtttgcatatcactcaaataattataaaaaaataaaaaagatgtattaacatgtgatataacacttcacaaacatgcaagttcaaatttaacttctacatttcgtaacgaaaaaaacaaattaaactgcagctagttaacgtatattcacggtcaaatttgtttttttgattgcgagatgtagaggttgaatttgaacttgcatgtttgtgaagtgatatatcacatgttaatacatcttcttttttttaaattttttcataatcatttgagtgacatgcaaaaaaaacgagaggatatcccctcaatagattaaaatccacttttgtaacccttgtagtggctcagaggtaagtaattaacttctgttcgttgcctggctgttggttcctgcaacatgaaaaattgctagatttgaaggatcttaattctctcgatcccttggtttagccaatctaatcaacaagtcattgctctgatcaaagtggtaatccacttctatgtgcttagttcgcgcgtgaaagactggatttgctgataaagtggtcacaccaatattgtcacaccacaagcatgcagcctgcggcagagctatgcggcgttccttgacatgcatacataataaaacagaataccatctgttcagaacttgtaacaacaacaagcccttcccatgtaagaaaacagatcttctgtacttggaattaattacaaccgttggtcatcaataatccaatgcactaaacaagaaggtactaggaaaaaggtattaaaagggtgggccaggtataaaaggtgaaaggttaaaatggtaattgacttttatagttgatttgtgcagttaagggcaaatgcgtcttcttttcaatatttgggtctgtattctctgatccgttcgggacagcaagctcgcggcgaccgtggcggtcgctgccgctgtcaaccgcgcctccccgatccgttctaggcgaaggtggaattggaggtggtggtggctgtggtgcaggcgcacgggctccccttccttcggagtgtgccgtcgatgaccgcgagctcacggcgactgcggccaccacggaccgtcgctgtcgctgatttcgagtgtgccacccgctctgcgtggacatgaattcaccggaatggattatctngtgggcatctatccacacaacatcacatgacctgagaggatcagagtagaatcactgtagcatctcgcgtgattgtctgcacagcaagacctgtcgagcacttcatttgtcgccgtcgtgcgagtactcacgctcatgtaggtgggacgaagaaccatagcggcaagctggtagccgaaacatttccatagtccaaactgcaaccttttgacaagtccaaactgcaaacatttccatatgtcatatcctttatcgtggaaggctacatatctatatatcagatcgacaagactatcgtggaagagataattgattggcatcaccggcgccagccgtgctacccatcgcaccgggcgagctcaagcgctgcctcaaggctggtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacacggacgaggcgaacaccaacaacagcagcagcagcggaaccaacggtctaacacccaacaccacaggcgacggctgggaaccaggacaaaaccctaatcttcacttcactttatcttctcttcagggcggaggaactatatatatttatatagagcaagggtgagtactttcgtactcagcaagtcacgggaacttaggtgtttaatgcaagcttggaagagaggcaaggttgttttgcaaatcttttgtttgaaatcattttggaatcactaagtgatttatttctttctatgtttgggcgaaaagagacttgcgtctcgattcaactttaagagatgcttttcaacagctcatttagtaatgtatcgacctcccgggtcagatcattacttctcggctcccagagccattccacttgattagtcggctcccagagcctttttcattttctcggactcccagagtccagttgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagccttttcccagccgactcagggttacctcatgccacatagaaggatcaaatcctcacataaacataggcctttttaggcgtgcacaaatcaaactccaaccaccttgatcggtaagtgagcaagcttctcgttcttgccttaccaggaacccggtttgtccgaccccaccccggcgttcccaactattggcatgcgaggtttccctgaaccgtctagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttggaggctttacaaacccatttcccaagttttcgacaagcaacggtgtatgtgggatatttggtatacgcgctcagagagcacgaataccgaggtaccacaagggtggagcgacaaggattcagggtagtacgacctacagaaattggtgcgactactgggtaggtccgtcggtttagcacgcaaaccgaggccaagcatgttaagtgtgtgaatctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattattagtgccattaaatagatctcaattttacggaattactggaagtggaacggagtcaatcggatgagcggttgagaagatatgaattttggaagtttaattggagtttctggaataggagaaatggtttatggaattttatagaaataatattctcaagaatattattgacagtcactgacgtgcgggaccaaaggaaatgattcatggaattttggaataaggaattgatttatggaacaagggaaaaggatttattaaatccctgggggctgcagg

SEQ ID NO: 19334 - DNA, 9371 bp, Oryza sativa
ttttggaataaggaattgatttatggaacaagggaaaaggatttattaaatccctgggaaaagaaaatggatgagggacgtgaattagacttcctcaggtggcattggtgcggcccaagggttgaagggggcttggccgagccatttgggccggcgcggtcgcgggaaaggcggcccattagggcgcgcgggagggagagggggcggtccggtggaccgggtgcacctcgcggggtcccgggtggggcccacatgtcggcggcaaggctcacggtggggagagcgcacgcgggtgcggtgctagggtttggtgggtgcggtgtgcgggcggtgcgccgggtggattggatggcagcgggcccacatgcagccggttggcgcaccgtggaccgcgcgcacgggagggggggaggaaggaggcggctgaccggctcggctcggtcaaagccgaggtggcgccgacgtggcgcctacgtggcagccacgcgggccggcgggaggaggaagaaggggcggccgagatggacggtggacggcagccgagttcaccggagctcgtcgcgacgattcgagagagagggagtacaccggaacgatgggacggacgagaggaagtgagccaccggaccggattcgccggaaagaggccagaggcggcggattgcggcgacgcatgctggcggcgagaaaaaggggaaacggcggaggggcgacaaggattaaattcaaggtggtgggagtatctccggggttcaaggagttcatctccggcgtcggatggggcagagcgacgccgtggagatctggcgacgagcggcggcctccgggagcgagcggcgatggcggcaagcctatggcgggtggtggcgaggctaggggctttgtctacgcgcgttcgggaggactaccgagctaccgcgcgagctataggagggagagggcaagcgagaggggagaacggagggaggcactaccgagccgagacgggcgctgtgacgagcggccgacagcgcgggagcgagctctccggcctcgggccggggtaggggaagaagatgggcggccggagccctcttcggctccgcgcgcacgccggcttcccagcacacgcgagggcggaggaaggcgaggacggcggcagcaaggcggcgatggcactgcagcggtggagactgaagtgggagggatttgagagaagggagtcggctttatagtggaggcgaggtcggttcgcgcgggaggtcggttcaaaccgaccttagggcggtcagggcggcagctggcggtcgtgctcggagctagcggccaagcggcggcagaggcggtcacgggtgtgacgccaatcggggaaaaagcaaaaaggggagggagaaaggagctcggctccttgccgattttggacgagctgagggaggagagagcgcgtgggagagagaggtgctgcctccgcgtcttggacacacgcgcgctgcggcgcagaggtgggggcagcggcagagtgggcgcgggcggctgcgcggcgcaggcgggccagggcggacggtgaccgagggctgtcggccaccacggcgggagcgcgcgcgggaacgagcgaaggcggtggcgggttttgggcggcgacggcgggaaccggcgtcggcgcgcgagagagaaaacgagagagagagagagggagaaacagcgagagcgagagagctctttctctccgctcggcttggcacgtgcgagaggagggtggaggacggcagagggaggaaatgggccgaggggagggggaggagcggctgagaggagatgggccgaggagaaaacggcccacaaaaatccgagggaggcaaaatagactttttcagaggagattgatttggagagaaatggagagatttagggtttggattcgaattcaaatttgatattcaaactcgagggtttagggatgtatcaaggggaattcaaggagaagtcatgggaaagattcaaaaggaatacttgggtatttgttctcgggaacataggggagtcaaggaaggaaacaaaacgggggtttggacattttgggatttggaaatgtgtttggcgaggattcaaaggaagggattgactttcggatttagatttcggagacttgaattgggagaggagatttgaggcggaggattttgatttcgatgagagggaataacgggattaaattgagatcttggcacaacttagactcgcacacaaagaacgaaaattttcgcaattaggattttgccgaattagtttttaacgcctcacgaaaagcggagcgttacagctggccacgacttcggaaatggccggccggtcctccccctgcagccgcatgcagcgcgctgccgtctgcgccaccagctccgccgcctccagctgcctcgccgttggctccggcgtcggccgcctgtccaacaccttccacacgaccacacctcccctacctcgatgaacggcggtgtgacttcagccaagacggcggggattgcgttccgatcctcctccgaacagtcgaacaccttgtgcacgtcctcctcttggtaaaagagtgccctcatccccgtcaacacctccagcatcacgacgccgaagctgtacacgtcgatcgttggcttcgcgatcgctgtcgtggcgtactccaggtcgatgtatccgaacttgccatagaaagcatcggccggaacacttctcgtcgagtgatcgcagcggaccgacgcgccgaagtcagccaagcgccaaagcgtggcgcccaagtggcgtcgaacagcatgtttgacgagttgatgtcgcggtggatgatcaccggtcgctcgttgtagcactacaggtattcgatggctcgcgacacgcccagcagtgtctcgatgcgcatcttccagttcaatgacgtcctcaccggcgacgacgaggacgacggcggcggcgttgtaccgtgcaggtggtcgtgaagcgagccgttgttggtgtactcgtagacgatcaggcgctcctccaccttcttcatcttccggaacggtggaagaagctggcgcttctcctgttccagcacgcagctgccatagaagcagatgatgtgcttgtggcgaagggaggggaggatggtcacctctgccatgaattccttagctgttgtcccgtacgtctcgtccttgtgcgtgcgcttgatggccacctcgtctcgcccgtccggaagaagatatccaatgtacactgtgccgaagccgcctttaccgatctctctgtcagctgcaaagttgttggtggccgtcgcgagctccgcaaaggtgaatttctcaccttcgtctccatggagcaccacattttcttgcaactcctaggacgaagtaattgagtttctctctttagcaaagcaagcaagctagcacgaaaggtaaacaatttcagaaaagctcgatcgagtaacacagttttgtattgtacgtaccacctgatgagagtgggaggctgaagatggagacggcatagtggacatgtcgtttggaagaaggatgttgtagattcgatcgagacgacgagtgatgtagatgtggctgacgaaggggaagacgaggaggtacgatcgagtcgatcctgctctgaacttctctgaacttgtcagcttgccgcccggttgtcaccaaccatggtcatgccctgacaggacatcacaagctcgtgcgcctcccggagcgtgtcgccgagcccggccagcggccgccggacctccggcctccgcatcacctccggatcctgcaggtgcggcagcagctcggcaatcatgaacacgcggcgggcgagctgctcgcactccttgttctgctgagccgtcagcgccgccagcatgatcatggagattgttagatagatctccctccccttgagcccaacggcacaaggggccttgacacgcgccctgatcgggggcgcccagcccaatagctggtgggctcccgtcaccctgcgccatataaaagagaggtggaggccggggcggcacaagacacgaggttcgctgccaccgctaactccacccacaaaaccctaatccgatcgagagggggcgtagccagtgacgcaaagcttcaccgccgcgccacgcctcatagacgccgccgacggtcgtccacgccacgaccaccgacgccatcacgaccaccgtcgtcaccatccacgacaagcccgcgacgacaacgacgatggccggcacttcttcatcctccaacacctcaaccggtcggtctctaaaccctctcgtttcatctctatattgttgttcatccacccgatagaaccacctggctagatctaaacctaggcgatcctagagagaatcctaacagtggtatcagagcgagaaccctagtgtttatatcggttcggggaaagaaatccaaagaagacaagaaaagaaaagcaatgatccgaatggatcgaaaagaacgaaaccctaaccctaatcccttaccacgtcgccggtcattgtcaacgccagcaaaggggggagggcaaagggcaccgccttggggcccctcgatggctgtgcatgcacccacgggtgcacgcgcgtgccggcgagggggccgtggcggcgccgccatctccttcgtcgccgcctactctctctcactcggtggggctggtggcgcgttgggggagaagagaaaagaaggcgcggcggcgcgagggccgccggcatcggctgggccgaaatgagcccaagagggcgcgcgcgcaggagcgctttgccggcccaggcctaggttgcggttgcgcgcgcgcgcgcactcggccgtgggccagctttcctccgatgggccaaaatggcatcatgaacagtagcatttttcctttaaattttgtctattttcatgcaaatttcaacacaattttgaagcgattttgcatgctttacctctgtttaaaatttgatccaaaggagtaattttttacagagtgtaaataacagaattgctactgttcatatgtattttataaagttattccgctacaaatagataaaattgatgaaaattagtgtttctaaaattaaatttcgaaccaacgggagaatttaattttaggaacattaattctgtgctatgatgttgtaattttctgaccaacgttgataattgcaatgttatagttatagctttatatgttatgtctatttttacccaacggtgatgtaggcttaatgcataatatttttaatgttaattttgctctcaccgtacatgattatttcaggtggctactgcttgatgggttgcattaaagatattccgaccctgaagggagataactacgcagaatggaaaagaaaactcgacattgctttcatcttgggagaggtggactgggtgttgactaccccatgtcctatagaacctgctgcacttgtcagagttgaaaatgagtcagatgctgactggcaaagaagacagagggacaatgctcccctcataatgtcgtattacattgagcaaaagaaatggtccttagtcaacaagaaatgtttggctgtggtaaagaacacgattgagccaaccttattgggctcaatcccagagtgtgacaccatctctaagtaccttgaaagaataaagagccaatttactggttcttcaaagacttatgctacacagctaataaagcagcttgtgacagaaaggtaccatggaggtggtgtaagagaccacattcttaggatgagcaacatggcttccaagttgaagccaatggatttgggcatctcagatgactttcttgtccatttggttatggcctcattgccaaagcactttgacaactttgttgtcaactacaatataagtccagagaaatggaactttgaaaagctcatcgctaattgtgtgcaagaggaggaaagaatcaaagagtccaatggagactctattaactatgttaaagataacaagaaaaagaactacaagtcaccctcctcaaaagcaaaacagcctcagcatctgccttagcaacaacagttcactgttgaaaaggatcagtgtctccactgcaagaagacagggcattacaagaatgattgtcctgacttcctgaaaataatcatggcaaagaaaggtgagaacattattacatttgtaaatgaatctcattatgttggttattccagatccacatggtggattgattctggagcaactattcatgtgtctaattgtttaaagggattccgttcgacgagaactacgtaaagaagcgaaagctccattagagtcgccaatggagttgaagcaaaagttgaagctgttggagatcttcgcctagagctcgcgaatggcttcacacttttacttagagatgatttttatgttccttctttgcaaagaaatttaataagtgtatcgaaattggatttcggtggataggattgccattttggaaatggaaaatgtaaactatggtataataatgcatgtattggtcttgctgtgttgcaagacgagctttatttgttatctcttcctgagaatgtgaatgttgtgtcctcgttgacaaaagaaaacaagaaaagaaagagaactcctgatgtctcatcgaaattatggcactgtcgtttaggccatatttcaagggggagaattgagagactagttaagaatgaaattcttcctccattagagttatcagatttagaacaatgcattgaatgcattaaaagaaaatttgtaaagagcataaaaaagtgtgcaaaacgaagcgtaggaattttcgagatcattcacacagatatttgtggtccatttcctgtgaaaagtgtagatggctatgactcgttcataacattcacagatgattactcccgatatggttatatttattcaattaaagaaagatcagaagcattggataaatttaagatattcaaagctgaagttgaaaatcagcatgacataaagattaaagtagtaagatctgaccgtggggggagtactatggtcggcatacgccttatgggcaattccatggaccttttgcaaggttcttgctagagaatggtatagtagcccagtattcaacaccaggtgaacctcaacagaatggggtagtgaaaggtgtaaccgtacccttatggatatggtgcgcagcatgatgagctactccaccttaccattgggtttatggatggaggcattaaaaacctcaattcatatcctcaacatagttccaagcaaattggtgcccaaaacaccgtatgagctatggacaggaagagtaccctcgctagctcacctccatgtgtgggggagtcctgcagaggctaaaatatttaacccaaaccttgggaaattggatcccaaaacagtaagctgtcattttattggctatcctgaaagatcgaagggttatcgtttctactgtccaaacagttatacaaagtttgtagaaatgagacacgccgtcttcttggaagacgaaatgattaggaggagctcggtagttcgagaaattgatcttgaggagaggcaggtgtctgtaccggctccgtcgactcaagagccttttttctctctacctgctgatgttgtgcctgcaatgcatgacgttgcggtactagcacctattgttacccctcctgtggcaacattgaatgaaagtgaggaacctgttctacaggattcaacaaaaattattgccatacaagaggaggaggtgcaacagcctcaaacagagaatgtgccaaatgtggaggcccctagaaggtctgaaagagtcagaagatcggctatctgtgatgactatgaagtttataatatagatagtcgcatatggaggatgatcccacctcatatgaagaggccatgagaagcgttcgctcatctgaatgattggaagccatgaaagatgaaatgaaatcaatgaaactaaacgatgtctgggatttagaagaaattcctaaaggagccaagacagtaggctgtaaatgggtctataaaaccaaatatgagtccagagggaatatagaaaagtttaagacgcggcttgtggcaaaagttttcacgcaaagagaagaaattgattacaatgagacattttctccagtctcttgtaaagattccttcaggattataatggctttggtggcacattatgatttggaattacatcagatggatataaaaacggtatttctaaatggagatttgaaggaaaaagtatacatggcacaaccgaaaggttttgtcgtgaaaggaaacgaaaatatgggatgtcgtctaaagagatccatttatggattaaaacaagcttcgagacagtggtacttgaagtttgatgggacaataaagaaatttgggtttcgagagaatattgaggacaactgtatttatacaaagtttaagaatgggagattcattttcctagttctgtatgtaaatgacattctactggctagtagtgatgtcagtgtactgcaggaaacaaagaaattcttgtcctcaaactttgacatgaaagacctcggtgaggcttcatatgttttgggcatagagattcaccgagacaaaacaaagtatgtattgggactttctcaaaagacatatatagaaaaggtgttgaagaaattcaacatgtacagatgcagtgccacacctgctcctatagtcaagggtgaaaagtatgggacatggcgatgtcccaaaaatcagtatgagctcaacgaaatgaaaacaaagccatatgcgtcagctgtgggaagcctacagtatgcgtaagtgtgcacacgtcctgacttggcatttatcaccgggttacttggcagatttcagagtaatccaggcccagagcactggaaattggtaaagaaagtcttgcgttatttgcaaggtacaaaaggcctcatgttgtcttatagaagatcagagccgctccggatagtggggtattcaggttctgattttgcaaaagataatacaaagtcaacatcaggatacgtgttcacccttgcagggggagctatttcatggaaaagctccaaacagactatcactgcagggtctactatgtatgccgagtttatagcatgctatgaggccacggggcaggtaaactagcgaaagaagttcatacccggtttaaaggtggttgacagtattgagaaaccactaaagttatgctgcgacaacgaacccacagtaatgtacgctcacaacaatcagtcaagtggtgctgccaaacacattgacataaagtactattttgtgaaggacaaagtccgggattaaacaatcagtctcgagcacattagaacagaaaggatgctcgtggatccgctcacgaaaggcctaccacccaacgtgttcaaggaacat

SEQ ID NO: 19335 - DNA, 380 bp, Oryza sativa
actccacccacaaaaccctaatccgatcgagaaggggcgcagccagtgacgggaagcttcaccgccacgccacgcctcatcgacgccgccgacggtcgtccccgccacaaccaccgacgccatcacgaccaccgtcgtcgccgtccacgacaagcccgcgacgacaacgacgatggccggcacttcttcatcctccaacaccttaaccggtcggtctctaaaccctctcgtttcatctctatattgttgttcatccacccaatagaaccacccgactagatctaaacctaggcgacggacgtctgcgccgactaggtgcgcccactgtcgcagcctgccccagcccgctccacatctcgccgtggtgatctcaaagaaat

SEQ ID NO: 19336 - DNA, 1936 bp, Oryza sativa
  unsure (1)..(1936): unsure at all n locations
gacggtagacaacaatttattccgtaaagcccatttcactgttctgcaacactcttcattggtagctccttacatcgaggagcacttgactctagttcgcgccaggaacattggtaagtccgatgcatggattacacggcatcacattgatactttccccgcgtggctacgacaacatctcatgggtaacgagtcgatcaaccaacaacttgccttcctggcgaggggaccgtctgggttcggatttcgggccggaaaccaatttttttttcccccaaaaacgatatgaacaatgggtcacatttacacgagagcccaagacatgaagagcacgaaccaaaacagcgatgttcgtgtcaatgccntggnacncnnannnnncaagtagggnaggttgcngtgccatcgaggacatatgggaacttgactatggtcctctcaaggttcctctgttccggtgccaatgggttaggttgactggtggaggcgtaatgattgatgacagtggatgacaactgttgaccttaacaaggttggatactcggacgaaccttttgtccttaccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcatttatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatatttaatttactatctttcatatgctacttatatatgactattccaatttttaaaaggtttaaatcatgcatgtggcatttacatatgttaattaaagtttttagcatttaatttaatataattcctacgctaagtatatatgatgattacaatttttattaattttaaatcatgcagtatgtacatacatatctttattagagtttttaccaatataataatatcattcatatatatgctaagtatatatatatattggaatttttattaattataagtcatatatttgcttattacgatttatccacttaatttattacagacaaaaataattttttgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttggtaagaccaaccgggactaaagatcatctttagtcccggttgttctcaacaaccgggagtaaatatcttttctttactcccggttgttctcaacaaccgggactaaagatatcttagtcccggttgttctcaacaaccggg

SEQ ID NO: 19337 - DNA, 1508 bp, Oryza sativa
  unsure (1)..(1508): unsure at all n locations
cgattgaacgtgaacgagctagggaacatgaacgagcgaacgaacgaggacgaacgttaacgtgaaatgcaatatatatatatatatatatatatatatatatatatatatatatatatatatatatatatgttacttcgctataatcctaatacatctttttgtatcttgcagaaaagacgtgttgtcggagtcgtccgtcaagcctgagtggaagagctagccctagaaggaattggagcaggcaagtgatgtaataatataaatgattgttatatttgtaatgcaattaattaagattattagacctgtaattggacttatcatataagattgtgtagtgttctaatattatttgagttttaatataagattactttatttgtaattagacttagtatgtataattattgactacggaattggggcgacaagtagcaattgactattgtagtcttaattagacttagcatatacgcacgaaacacttagcatagatgactattttagtcttagcatgtaatattattggagttttaatataagattactttatttgtaattagacttagtatgtaattattgactatggaattggtgcgacaagtagcaattgactattgtagtcttaattatacttagcatatacgcacgaaacacttagcatatacatgactattttagtcttagcatgtaatattacttgagttttaatataagattactttatttgtaattagacttagtatgtaattattgactacggaattggtgcgacaagtagctattgactattgtagtcttaattagacttagcatatacgcacgaaacacttagcatatacatgactattttagtcttagcatgtaatattatttgagttttaatataagattattttatttgtaattagacttagtatataattatttactagctagggttgtacaatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaatgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaatgaggtgcagcgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19338 - DNA, 1141 bp, Oryza sativa
aatacctataattatttaaaacttgtagctttgatgagaataaatctataggcatattttaccttcacaaccatttgagccttgaaggtaaggattgccatggtatcctttggagcagttgcacatgtaggctgattttgctccactggaataattgaggcacacgctatggtcgcttttgcacgcgtacgatgtgagatttttctgcgcttccacgcagtctcggggaccccagatagcccagtcaaacttcaccggcgctcggccactgtaggtgttgttaaactctagcagagaagtcaagttgctggttgagaaagtgaaattcgagtagtccattatcgctgcatagctgcagggggtgtgttcgtagattcccgatgtgttcatgctctccccgaacgacaccttgcagaattccatgcctctggggatggttatctggcaacatcctatcctggagcaggttctgttggtggcgctcaccactttaccacccgggcaggaggacgcgcagccgctcgtgtagttgctggttgggtcggaaatgtaagccaatgactggcacccgacgaaccgggaacttgttggagtccgacagcatgaaaggtgtgtatgacaagttgaaccccccaccgctggagtacattctcttagagaaggggttgtagcaagaagaagatatgggggtgctcaccctgatctgaccaagctggagggagatgctgaggacctccacatctcggtagaatggttttttgttgttgcagtcgatattgtaaaaaggcaatgcacagtcgccgtcagatccgatgccaaaagggtaagggatgtctatgccgccgcaggtgtgcaagcattgcgcctctgcgccgccggcgagcaacgccgcccagcaacagctatggccgtgagacatgatattgttagctcaccataagaagccatggaagtatgaacttatttgtcgatgtgtttctcttctgatcgtacgcgtacttgtgcaccttagtccgacgaattaatgctagtatatacttcctccggcccaaaataaagccatttttgaggttggcacgagtattaagaaagtaggtgagaatgattggaggaagtgtgtgattggttgaaaaagagaaag

SEQ ID NO: 19339 - DNA, 2939 bp, Oryza sativa
tgcagcccagagaaggcctactctgagggagattattgataaactgaacgagttagaaaatgtgaggaaggcacgtataggccaggtaacgtgacattcgccatcacgacatcgcggttatgtctaattcaccagaaaattgcgtattttcctcctttcttcagcttatgacttaaatttaatttgtcaaattatgcggactcagcgtatataatgaacttgacatttactaaggaagaaattaaaacaatgctaggatacatttgttgattggtagctaaatatttaagtaaggacttatttggttaatctcacccacaccgcaagaggattgagaaagatttagaggggaataattccatatctattaaggccctgtttctttcagtttgggattattataatttagattattgagtcagattactataagctagattgttataatctgtagtataataagcgattagttatttctttcctagattattagagcctagattattgggtttgcaagtctaaagagggagtggggtggcatggtgggtaattttgcacccaataatctagaaaaagctcacctaaatgagcttatcagattataataagctgggctccagattataataagctgggctccagattataataagctatagcaataagttgtctgtttctttcagcttactccaaataatctggattataataatcccaatctgaaaaaaaacagggcctaaggtgtgaatttaatcatatcccctcaatccactccaactcctcccttattagggcatgtacaacagttagagataatatggtttttaatcattaatgtatccaaatactttttttttctcttctttcctttctttcactatcatgcaacaaaatttactctaataaatgctaagagtcgactctgagccgttgtcatgcataacaaccatactcctttctctttcttccatgtcatcaaattacttgcatggcaatagagagagaccactaataaaaaccgttgtacatgcacttaggattaactgaaaaaggcctaagagagattctggcaaggatccacattttggtactcagttttgctaactcactaatagagaaccgatctttcgtagattaaaaaccggtattaaagttgctttactaccggttctaaaagtccaattccctataaacaactttagtctcggttgatgttactaaccggtactaaaaatgcctccagagttaggtcaaaaggaaaacgtctctattcaagtcagatgtgtaaatatagttggtgagatggttatactcgtgagagataaggtgagagatcttgagtttgaatcctacatcccacatattttttttctcttgctatatgcatttttagttttaccggtactaaagatcgacatctttaatcccaatttgctcatctcgggtgctaccaccggtagtaaatgtggttgtaaaccgggaaaaaaaacgtttcccctgtagcgactgtataaactacgaagtgacaagtgactgaataccaaattaagcctagacacagggactagtatgtatggcaagctaggtttcttcttgagtatatagtatgatccctctgatcgttgtgacagagctcagctgggtgtaaatcggagcgccttgtgatcgaccctctggaggtgcgcttcccatttgagaaggacagggatgtatcctgcgtgctgcagctgacgaacaggtccgccgatcgcgtggcgttcgccgtgcaggtggacgagtccaagtaccgcgcggtgccggacaggggcgtcgtgcagccgcggtccaggcggtacatcgtcgcgacgtcgcgagcgcaggcgagcgcgccgaccaacttgcagcgcgacgactcgttcctcctgcggagcaagagggtggagggcagcgccgacgacgactttgcggaagacttcgaaaagctgatgggcaaggcggtggatggggagacgatgaggctgccggttgtctatatcgcactgcctctacctcctagcagttaagcgatttatacgcagctgtctgtcctcatgtatcagagatccgctagctagtccgaataatgtccgatccgtcgacatttgcgtcttaacagcctcgtgatttatatatatgacttttgtgaaactaggaagatagcccacgcatatgtgcgggcatttgtttaatgtgtttatgtgcagttggtttttttattgaaatatcatttatactctattcaaatttatttgagatttctatgaatgttggttatgattttcttctagcttgttacccttgcaacataaaaatttggtaaaatttgctacgggacataaaaaaagtgtaattagccaggggataccggaaaaatatgtatttgctggagaacaaaaaaaaactggtaattagctgctggacactcgcggtattattttattatttcagaagaaaatagagagataaacagctgtggaattacggttttacccttcaatccagtcaagtttcactcccctgtgggacacaccagtcagggatctttttttactttttctctcctattctactccttcctttcttcttcatgtcttcttccacaatggcctgtacctccccatgaccccacccatcgcggctctcgtggcgccaccgccggagtgcgacaacacgcaggacctgccccggatgttcgtgttgctcaccccgaccgaatgcaacacgtcgctcacctacacgcagtggaaggaggcggacgcctccatgcgccaccgactctcgctcaatgctcgtgccgtgctcggctacaccgcgcagaggatctttgcgcggttcacggcagtcaccaagctcacgctcagctgcgtcggggctccgggacagacagcctctccgacgacgcggcatgccaagtggccatc

SEQ ID NO: 19340 - DNA, 10746 bp, Oryza sativa
tgcaattatgttgggtgccgagaaaaaacttgtgcacacatatacacatggcctcctccggttaacgccacaaatcgccaatgtacgtagcggcaaacaccactcaatccatcgcacactagctagaacacaagaaaaatctcagccccgatcgatcgaaatccatggcgttccagttccacacgctactatcagccgtaacaatatggctgggcgtagcggctgctacggcgaggctccatgccgccgtcgccggagcacgagcgccggcgtcgccgccgtcggccggcaactgccaaaggaagtgcggcgacgtagacatcccctacccgttcggcgtctggaacggcagcgagtccgacggctgcgccgttccaggcttctacctgaactgcgacgtcgacgacaaccacgtctacaggccgttccacgggaatgtggaggttctcagcatctccctgccgaccgggcaggcccgggtgacgaactccatctcctccgcttgctacaacaccagctcccgcgacatggactacaacgactggcagatcaacttcaccggcacgccgctgacgatctccgacgccgacaacaagttcaccgtcgtcgggtgccagacgctggcgtacatcaccgacgacgacaacatgggcaagtacacgagcgggtgcgtcgccatgtgccagggaggcgacctgacgagcctcgccaccaacgggtcgtgctccgggataggctgctgccagacagccatccccaggggtctgaagtactaccgcgtcaggttcgacacgggcttcaacacctcggagatctacaacgtcagccgctgcagctacgcggtgctgatggagtcgaaggccttcagcttccggacgagctacgtgagctcgctggaatttaacagcagcaacggtggcagggagccgttggtggtggaatgggctatcggaaacgacacttggggaaatacaagcccgcagaaaggttgacacctatgcatgtgtcagccacaacagcaagtgcttcaactcgtccaacggaccaggctacatctgcaactgctccgaagggtaccaaggtaacccctacctgcaggacgggcagcacggttgcacaggtatgaaaactgatccatttaagggtgagagaggaattgtatacgtgaatatatacacataaacaaatgaatcacatagccaagtgagaattggtgtggatatttcttgattttaaatgcttttacggtactcatttactagcagaattgaaatatataacagttgattatcataagcatttaaaaagtttagccaatgcaaggtaattaacattcatctactgtaatttggaatgatttttcaatttaatttattattttattactatatatttattttaagttcaattttaccactttaaaatttgtactacactaattaaattttgaaatatactttatcacaattttacgggaatttactagctagattaaaaaatatttaaatatacccgattcgcctcgagaaggtgacacctggaataaattaaaaatatatatctatctaattaacttgtttagttgtaatatcaagacagttaagatgtactatatttccctacactttttaacatagcttatgagagaaaacatgcatcagaattttttttttgcctttatcttttgattagtttagtatgagtcacagaatctgaggttcattatattattaatatatgattaatacacaaaacatcacaatttcccacaagaaaatcatattgcccatgtatatatgatagcaaatcactgtttatttttacctatgtttgattaatgcagatatagacgagtgtgcggatccgaagtacccttgttccgtgcctggaacttgccataatcttcctggcgggttcgagtgcttatgccctcgcagtcgtcccaaaggcaacgcattcaatgggacatgcgagagagatcaaacccttcatactggaggaaaagtagctattggtactccattatcctcgcttatcattccaagttctttttccttatccaaaaatcagtagctaagattttccttatgttaggccatagcatccacatgttccacaccagtttatatggattctccacaaaagaaaacaaaactaattttaatctgtttgattagtcatggaccccaaccgatacgtcactctcagaacttttcagaaaaagaactgaaagtgtaactacatagagttctaaaccgttagtccgttacatgatgtcgacctgtaattaacttatttatttggaataggaagatgattgcatccccgcctttgcatttaggatgtacagtacacaagcatgcagtttaattttgaaagttttttcttaagataaacagtatctgtatatgcagtgctgaagcacttgtttcaattcaacctttagtctcctttacaaatattcatttctgcaggaatttccggttttgctatcgttggcctcgttgtttttcttgtacgagaagtgatccagcacaaacgaagtatcaaaagacaagctctgcagagacagactgacatgtattttcaacaacacggaggacagatcttactagaactgatgaaagtagagagcagcgctgagttcaccctctacgacagagagaagatcgaggtagccacaaacaatttcgccaaggagaacattgttggcaaaggagggcaggggaccgtttacaaggctgtcctcggcggcaccactgttgcgataaagaggtgcaacgaggttgatgagagcacaatagccgacttcgtgcaggagctggtcatactctgtcgtgtcaaccacccaaatatcgtcaaactagtcggctgctgcctgcagttcgaggcccccatgctaatctatgagttcgtgcagaacaagacactgcaagagctactggacctccaaaggagtaggaagttccacgtcacactggcgacccgcttaaggattgctgcagaatccgccaatgcacttgcacatctccactcactgccgcgcccaatactccacggcgacgtgaagccagccaacatacttcttgctgaaggattggttgcaaaggtgtctgactttggttgctcaacgattgatgagaaaacccaagctgttgtaaaaggtacaccgggatatctcgacccagactatctacttgagtaccagctcacagccaagaatgatgtatacagctttggggtcattcttcttgagctcctaacgggtaagaagccactttcaaaagaacggacgagcttgatcccaatatttcaaggggcaatggaaagtggcaaactcgttgagctcctggacagtgacatagtagatgaagccaacatgggagttatctgtcaggcagcatcactagctagtcaatgcttggctaatccaagttcatcaaggccaacaatgaggcaagtggcggagcagcttcgacgactagcattggcagatgaagtacaacaatgcccacaaccgccgctagtgctcgatggcctcatcctcacagagatggggagcacaacatcatcatggtacacaggaagtggaacaagcggggtttataaccttgagaacaatgtcgttctaagcacagaattcgctagatgatccatagaccccttgtgctttattgagtgttacaatgtgttgttttatctgtgttagattatgagttgtgttgttttatctctgtgttagattatgagttaattcttcccagttgtggtggttgacgggcttcccaatgtgtgcggctgtaaccatgcattgtgaggaacaagtgaaacaatcatgtttcacaatatataataattcaagtgcatcaaacacaagtagtggtagtcatagatcaaaacgaaattatctgcacaaagtttgagtttgctattatgagtcgaggtctagatcgtccagtgtgaagacaacaatcctgttgcaatcaattggtgaaaaagatttgatgagagtaggaaaacagaccttggacgcatgagatatactacatcccgttttcaatatatatccggctagagttaatgtaacatcctagcctagggcttaataggattactagaatactcatagttgcaacttcttttccggaagccgatttccaaagaactccagggttaagcgtgcttggcctggagcaatttggcatgggtgaccgaccgggaaattcttcccgggtgcgcatgagtgaggacaaagtgtgcagaaaagacatgtgttggtctgtgagggcagtctgtaacctatgaaagctatcagatgtaagtgggcccggcctgggggaaggcgggacgttacaaaatggtatcagagccgactctcgcggtttcacgggcgtgtgtgtcgcagttgcgcatggtctctcgcggtttcacgggcgtgtgtgtcgcagttgcgcatggctggtgtggatccggagtggtcacacagcatggcacatgcgctggcactggacacacggacgtggccaagaggggacgttcctggcctggggttgatcgacgggggcgtcgatctctcttaagggggtgaggatgtaacatcccagcctagggcttaataggattactagaatactcatatcaacaagttgcaacttcttttcaggaaaccgatttccaaagaactccagggttaagcgtgcttggcctggagcaatttgggatgggtgaccgaccgggaaattcttcccgggtgcgcacgagtgaggacaaagtgtgcacgcttaacctggagcaatttgggatgggtgaccgaccgggaaattcttcccgggtgcgcacaagtgaggataaagtgtgcagaaaagacatgtgttggtctgtgagggcagtctgtgacctataaaagctatcagatgtaagtgggcccggcctgggggaaggcgggacgttaccattaaccaatggattccttctcgtattgctaaaagttgagaatctctttatggggagaagctatacaggttaacagaagaaagtaaggcacaacctgcttttcaactgtcacaccctaaaaatcgctaaattataaattgttgtgaaaaaggaaatttttagaaattatttaataaataaagtaagtgtttgaataaaatctatgaaaaattttaacattaaattgagctagataaaattttattaaataatttgagtgtccaagtattttccggatttttcccggaattatttgagcattggaagtatttttaacaaatgaaacatcatttcagcaattatttaaaataaaagttaattgaaatcctctccctagtcttgggccgaattcggcccacgcctctcctctctcccatccttggcccgcagcccctctctctcggccgaagactgctttagcttcttcctccattccctctgacgcaaggggcccacccggcacagtgccgtcttcctccttcagccggcctcccgtcccgtgccctcgaatttcgtctcggttcttatcccgacgaactcgggataaactctaaatttccgccgccgtttcctctcgaatgcgcatcgatctcttcctcctccgcctatataaaggatgacccaggtctcctcttcgtttttcccctcttttcccatgctgccgtgccctagtcgcctctccctcagctcgccctctctctccaccatcgccgccaactccagccacgccgcgccgcccctctggtcaacgcgggcttgcgccttcgcctccctcggctccgcaaggccgagctccaccctggccgccggttcctttgcgccgaaaccccgccggaagctttcgtcgccatgaaccagtgggtcgccgccgtgtttcgatctctagccaccacccaccgtggactccatggtcgccagaccttgtcgtctcgtcctttggcatcacaaggaccccgggaagcccgtccaccccttctcctccgccggagttcgctggaacgctggtgtcgtcatcatcccgaacctcaccgccgctgtaagtgttggtaagcatcgccgtgtcctcctcttcctccccattctataggcttccgtcgtcgtgccgctgttcgccgtcgccaccgccaccgctgtccagagccaccggcgtcgatccagcgtggctgtcacgtcatcgccctgttagccgccaccgcattgccacgttgtcgttctatccacatggcatctgcgccagcgacacgtgtcaccacgtggccgctatcctaaacgctatattggatttgatctcacctgtcagatcgtggtcaaaggcctgtcaaagcaatcctagccatccatcccgtggacccgtgaactatctttgtggacttggttcatggtagacccagtctaccgcttgtatctatgacgagtgggtcccatctgacactagccctttttctctcttcctagggctgacgtcatattcctcctttatcacttctaaaataattaaatatgatgtcataaattacttagttgttttctttataggttttaattgattaaaacttcattaattcataactaattcatatgaacttggaataaggtcgttcaagtctcaagatctacctatttatgaactttcattgtactgtttatttggtttttattagtgttttacctcgttttgcgttctaggtttagttttcagtcgtttcggaggctcgttcatccattggagaagttcctgaagacgaattgaagacgcttgtttgcaaagcaagtcacacagatcctaaacacaatcctttgagtatattgaacctatatttaaattctccatttcattcaaatgtgcatttattttcaaatgtcatcgggatgtgagccttttccctatattaaggcataagatgactttattttcctacgggttataatttgactagcttgggccttacatatttgttcagctagatattagatataattgcttagccatgcttagaaacattagcacactatgggattcactctaattcagtccttaattatatcatgatgtaccgttatggtattgatttaattaaactaaatacgcttaaatggtgggttgtgggtgcatggtttgatagtcacaaccataacaattaacgtccgattctcgaaatctctggaagatatacctgtacttaccacatacctgcatgggctctaggctaaacttggagtgtagcttaacctagccaatgtaccaaggcaaggatggacgtgatggagtatggatgttccgtgctgcggtctatgctgcttccggattcacctaggcacaagagggggatgcccgctgccttttgaggagtgggggtgaaacctgaggtgtgtatgattggttaggaagggttatacaaaaggttctgtcacagtctctttcctgtatgtcgtggtggcatgttggcgcttggtaacgtgttgtgaggctgtgtcttgtgggtaaagttgtacacctctgatcaaagtaaaactattcgaatatccatgcccgcggttatgggcggtcaaccagctcaccgtgattattctcaccttaataatttgacatattgaactgagttagtacaggtggtttggttgggcctatgcaacgagtatgttgtatagcgttggattaataatgtttaattaattgctgtactattttacaaatacttaactctttgctaaatgctgctttcacaaatgaaccctatattatgccatcctttggtatccatatgtacttgcatacttgtcgtgtggcttgcggagtattccatgtactcaccttgcaataatcaatcaaacctcggttgaagaaagaggatccagaaggagaagacctttggcttaaatcccagttgagctgcttgtgggagtagtgttgaaactttgctagattttatgttctgctgtagttttctccgtggtaataactaagtacctcttatgtaagtatttatcgcattagttattatgatgaatctgtatattaagttgtcagtttgtgtacctcggttgattcctggacgaggatttaatgcacaaattagtttgaaaattacttatgaatttttgggcgtgacaagttgacatcaaagccatctcgattgtaggtcaagccaaacggttaaacccataaggacatgtctttgccaaaacaaaaagtgcatgtttcgaagtcaagatggaggcccaaaccaagtcgatttcgagtacgtttctgagtcgaggaccagtatgcactaaaatgggcgcccaggtcgcattcatgcttggattggggccttctttatgcaaatggaaagctaaaaaaataacctttccaatggttctagtcccatattcaaattctttcctagtcatcgggaatcgagcgagcaagctaacgtccaaaatctgttccggtactgtgccgccgcatttttgccttccggacgcctatcatgttggagcccattatggtttgcacgaccctaaactttatatattagtagcagcctccacctttagggtttgggttttgcttacattaatatgttaagaacagtttcatcgatccttcggtttgtaagacctcaacttgtgagcttaatcattcatatacaatttggttgtattctttcttgttctggtgtgtgttcttcgatttgcaattagggattagccttctcagcgaggccaaccgggtttcgacacggttgataaccagaggagacgtggtgctgcgattacggggctcaagagcgtgttcattcagaagccggatcaatttgtgtcgcgactccaccaaatcgactgtttatcacaacatttcggaagatcgggtaccctacatccacatcaagtggtattagagctccaggttatactaaattagtttttgttttcgccgtaatcctagagtctacagaaaagccaaaaaacaagtgtagtcattagtttcttcccatcccagacagtgtttagcctttgcataattctttttcagagtctgtagtgttgagttttagtcctagtttaagtttttgttgctggtttagtgcgtgttttagtctaggcttatgcgccatggattggatggcaaggtcgatcggttctgatgacgtgtagcagatcgatcaaaggtagagcccgactgggatatggattggattcatgttggatgagttttgatattgtcctactttgagcaggagatattcggtataaatagggagggagactatgccttgagtaaaaccatgtttgagagattagatagggtttcgtgagaaacttgtgaggggtgctaacgtgctgtggctgcaccctgtgaacaatacttgagtaataaagaacatattcaatcatcaaggcatcgacgatctcttctggtttcttaagttttacattattgttcggttttggcattaacttgtgagtctttgttttgctgcaattttgttcaagttaatccatccaaaacctttataatacttcatagatcaaatctgcaaagtttcgttgattgattcttgttagattcgactttgcttaagttttagggtttgttcagatttactgaaattctgagacagctggcttttgagggtattttctcttaaaccgtttatcagtttgcaaatccctccggtggagttgttccttggtttgtctagtttattcctaggctgacggttcgaccgcgagaggacctgtgttcagaccgatcctaataggtaggatagaccatcggacgtgtgttccattggtttttgaggatgtggcgtgttttgatctatcaagatttggatatttgacttgcgttgaaataatctaccattcaccccctctctggtatgcttgattacttgtgttcgatcctacagctgctgcagcttgcttaacatccattgcagctaatgctgggctcctgcattgggcaagattttgggatcgatttggggctagggttaagaaggtcagccggggtattttgatccctacgaaaatacacagtagacaaaaaaaatgattcatatggcgtatcaggttatacatatcatggtatggatccagcttttataatgttgaagtggcatatcgttccaatctatctattatattattaaaacaactttgaaaggaggcaccacgttcgctgtgagggctagtaaatcccacattaatcggagaaaaagaaaaaaaaaagaaaaggagagtccaagtagaagtacaatataaaaatagctgaaattcggaactaaaaataagtaatattgaaagaagtttccatatatataagaacccaatacgagattaacccataaatcgaaataaaaataaaataaaatctaaaattagaaaaggaaaggagagtccaagtaagaatacaatttaaaaatagctgaattcggaattaaaaataagaaatattgaaagaagtttccatataagaatccaatatgagattaaccaaaattcgaaacaaaaataaaataaactctaaaattagaaaaggaaaggagagtccaagtaagaatacaatttaaaaatagctgaaattcaaaattaaaaataagcgagattaaccaaatttcgaaataaaaataaaataaaatctaaaattagaaaagcaaaggagagtccagataagaatacaatttaaaaatagctaaaattcacaattaaaaataaacaataatgaaataagtttccatataagaacccaatacgagattaataaaa

SEQ ID NO: 19341 - DNA, 2815 bp, Oryza sativa
ttagaaaagaaaggagagcccaagtatgaataccatctaaaaatagctgaaattgggaattaaaaataatgaatattaaaagaagagtccatataagaagccaatatgaaattaattaaaattcggaataaaaataaaataaaatccaaaattagaaaaggaaaggagatcccaagtatgaatacaatctaaaaatagctgaaattcggaattaaaaataaggaatattaaaagaagagtccgtataagaacgcaatacgagattaattaaaattcagaataaaaataaaaatgaatccgaaattagcaaaagaaaataaaataagagttcaagtaggaatacaatttaaaattagctgaaattcggaattaaaaataaacaatattgaaagaagaatccatataagaatccaaaattagccgacggttgacgggacttctagaaaataaataaaatgaattccaacgatagttatgtttgatttttagaatcacaatgacaatgaagagtaagtggcggacgggttgtacaggggcacagtggcatcgtttgatgagacttctaaaaattataaaaaataaaactacaagtccaatttttaaaggttcagaacttctaaaaagtaaaaaaaacaattataatcatgtttgattttaaaatctcaatgacaataaagaagggaggcagcgcgcgagctgtagaggagtacaatggtaaagccgcagactgtttggcgggacttctagaaagtaaaaatgaacacaaacgataatcatgttcgatttttaaaatctcaatgacagtaaagagaagagacggtggacgggccatagaggagtataatggcaacaattgacgggacatctagaaaatatataaacgaaatccaacatgacaataaactctaaaaactataaaatctaatttttaaaggttccaagaagaataaatagaaatagtgatagatcgagtaagcaaataaatgagatgacataaggagtagcgactggtgtgacttttaaaaactatataattagaaacacgaggatgataaggtttggtcttttaaagtcttaagataatgagatagctatttaataaattttaagtaaaatcatattaaaaaatatatgtttttgtttgggtgctagccgcgcaattgctcgggccacccagctagttatacaaatactaatgatatttttcaaaacaagcaaatttacacacatgcaagaatccaattaaccattccatgtaatatagccacgtaaacttgtaattgaacaaatggatgcacgttccatcatgcaaccaaaaagacaacttgaaccgtcttgctcagatcaacctcattggctatacttctgcatcatccaattccgatctcgtgaattattgcaccaaagtctgaagtcccggccctatttcaacattgagtgtcgaattgtctatgggcctcattaagttgattccatcaacatcgatccatccatccaaactagagtagtattctgtaaactattggtctacggggtataacaataagttatttcaagcaacggtaaccatcactgatcaccaccgtgtttccaacaatgcatatattaatccttgtgcttactcggtcgtatgccgtcattagatgattcttcgatccaaaatatatattccactatcgatgacatagtcttgcgttctattttttctttgattgcatgtgcatacgacatgtataattatttttctttgattgtgcatacgacctgtaattatttttcttttattgtgcatacgacctgtcataattaattatttaaagtgcagtatacaagctatgttgtttgttttacctactaaattatggaaggcacttttaccaagacattgttaatatcccacaaaattttcgtacaatggaacatttcaacagttgctacaagaagatgcatgcatactgatcaaattaagatgcaaaagcgactttgaccggtcgcaggtctttggaccaaattgttgaaaatggtcagtgtgccatacagaaacgtagcactgttcatgcacgcatggatgatcgacactaatattatacttttcgcagttaaaagcgcgtcttaattaattacttgcgatgaattgatgtataacataactagtattccccgtttcacgaagtaagactttctagcattgccatatttgtctagattcattaacgtctatataaatagcactactacagaatgagtttttgcaaatgggcgaacacgattttcgcatctggttgggccatccgcatacgcgaaatcgtctgcaaagatcgtcatctttccatgcggccagggcacccgcaagcgaaaatccaattttcacatacgggcgcttacgccgatcgcatgcaaagagaaaaaatagggaaaaaaatttcaaaaacaacaaccctagccgcaagcggcgccaccgccgcccgatcccgccagacgcgcccgcctcctgatctgggcgggatgaggcccgtcaccaccgtccccgctcctaccgccggccgcacccgccgacgacgccccagttccggcgccggccgctctcgcctccggatctgggcgggacaaggcccgccaccgccagatccaggcaggatgaggtccatcgccgccggatccgagcgggacaaggcccgtgtcgccgcccactcgtcatcgtcgtcggggtcgccccagctgcccccacttgtgtcgtcgtcgtcgtcggggtcaaccccttcttgtcgtcgtcagggtccccaccgcggagggggcagcccgagcgatggggatg

SEQ ID NO: 19342 - DNA, 4004 bp, Oryza sativa
ttgaaaactttcgaactgtggacagggaaacagccggcttcatttttacatgcttaccacttaaggatccgcatgcaaaaattagttttttaatttttaaatcaaatttatggcactaaattaattcttatgaaaatgttgttaaaaacaaagttgtagaactcattgagatctaccatttttctttaggttatttctccatttgaatttgattgaactatataaaatatgaattttaaaatataagaatttcaaataatttttcgagtagtaaatattttcagataaaaaaaattgtcaacaacaaagttgtaaaatgcatcaagatctacaacttttgttttggtcatttttctatatgactttgtttcaacagtttgattttgaattttaaattatgacaactttaaacaacatattcaaatagtaaatgatttgaactgaaaaagtcatcaataacaaagtggtataactcatcaagatctgtaacttttcttttggtcatttttttcatccgataaaatgatttgtaacattgttcacagaatatacatatctcttatatagttttataaactataagagagatatgtaaattttgtgaaaattttaccatcactttatcggatgaagaaatgaccaaaatagaagttatagatcttgatgagttatacaactttgttgttgatgactttttccgctgaaatcatttactccttcaaaatagtatttgaagttttaaaattcaaatttttaattgataaaacaaagtcactacaaaaagtgcccaaaataatagaagtaagaacacaataacatgacagagtatgattttagaaacattaagggaaaagaatcatccaatttaggttcatatgagtgagataatctagtttcaatttttttcaaattttatttccgcagacggctacttaacacgcccgtatggaaaaattgatttttccatgcaggcgcttaagtgagccatatgcaaaaatgacctcatttttacgtccggacctcttatgagttcctatggaaaaatcgattttttcatacgggcgtcttaagcagccatatgcgaaactgccgctcgatttttgcagatgccactagttatggtccgtttgcaaaaatcatgggggtctcgtacagaaaaaacacttttgcagtagtgtatgagccatgctagaaagtcatacattgtgaaacaaaggaagtagtattatgtatattcgtgcgagatgtatactttgctttgtttatacatggagtatgtggtagagattttttgattatggcagtattcgttatgccataatctttcgttgggttttccacgcgctaccaagcgtttatatgtatacaaaatttcagcacagtatgaacgtaatataccagtagtgaaattccatatgtatgttttatatatatactcctagctaacacagcttctttcttgctttaatagttacttcctgtagctgatctcgcccaagtgaggatcctatcacaaacaactagagctctcacgtgaagataatcaatgtaggatttagggatttttcttctcgtcaaaccatatattacctttggcatgatcgtgtaaaacaacgtatgcgcatccactagaatgtgtattcctaaacccagttgtaaactcaataactaataaccaaattacaaacattgttcgtcaacccgtgccagctattattattgctatctatgtatctatctattatattattaaaacagctttgaaaagaggcaccacgttcgctgtggggctaaaaattcccacattaatcggagaaaaataaaaaaaagaaaagaagagtccaagtagaagtacaatttaaaaatagctaaaatttggaattaaaaataagcaatattgaaagaattttccatataagaacccaatatgagattaatcaaaattcaaaataaaaataaaataaaatccaaaattagaaaaggaaacgagagtccaagtagaaatacaattttaaaatagctgaaatttgaaattaaaaataagcaatattgaaagaagttcccatatgagaatccaatacgagattaatcaaaattcgaaattaatataaaataaaatccaaaattagaaaagaaaaggagggtccaagtaggaatataatttaaaaatagctgaaatacagaattaataataagcaatattaaaaaaaatccatataagaatcaaatacgggattagttaaaattcggaataaaaataaaaataaatccgaaattagcaaaagaaaataaaataagagttcaagtaggaataaaatttaaaattagctgaaattcggaattaaaaataagtaatattgaaagaaaaattcatataagaaccaatacgagattaatttaaatttagaataaaaaataaaaataaatccaaaattagaaaaactaaaagagaattcaagtaggaatacaattttgaaacaactgaaattgaaaataaaaaataaaaacattagaaaaacgtattaactaaaattttttaaaaaaattctgaaattagaaaaagaaaaataagatttcaattatgaatacaatttataaataactaaaacttgtgataaaaatagagaatattgaaagaaaagaccatctaaaacacatgacgagataaattaagtaataggcctataaaagagtagagtggtggcggttgatacgacatataaaaattgttaataaaacaccaaatagaatcctaatgacgattaaaaggagggacgtcaggcaggccgtgaagcaaacgagtaaggcggttgctgggacttctagaatgtaaaccccattgataatcatatttgatttttaaaatctcaatgacaataaaaaggagaagcagcgggcggggtgtataggagtatagttgcagagccgctgacagttgacgggacttccacaaaatgaaaaatgaattccaatgatagttatgttagatttttagaatcacaatgacaataaagaataggcggcggacgggccgtagaggagcataatggcattgtttgacgagacttctaaaaattataaaaaatagaactacaagtccaatttttaaaggtctgaaacttctaaaaagaaaaaaaccaatgataatcatgttctattttaaaatctcaatgacaataaagaagggaggcagcgggcgaaccgtagaggagtagaatggcaaagccgctgacggtttggcgggacttgtagaaagtaaaaatgaacccaaacgataattatgttcaattttcaaaatctcaatgacaataaatagaagagatagtgaacggaccgtataggagtataatggcaatgtttgacgggacatctataaattataaaaatgaaacccaacgtgacaataaacactaaaaactataaaatccaatttttaaaggttccaagaagaatgaatagaaatagtggtagatcgagcaagcaaataaatatggagatgacataaggggtagcaaccagggtgacttttaaaaactctataattagaaacacgaggatgataaggtttgctctttcaaagtcttaagataatgatatagccatttaataaatttgaagtaaaatcatactaaaaaatatatgattttgtttttggtgctagccgcgcaattgcgcgggccacacagctagttatttaaacaacaacagttcatactaatttttttctgcggggcagttcatactaaaattagaatccatttatattacaactcgctaattattaatttcatctcaactcacatgggtccacgaccgatgacagaaacttttgaatgttttaagtagtagtgatagagatagagataaagataaagaagtaaagatagaaatagagattaatatgacattaaatttatttcttaagaagggtctatctcttacaatttgctaaaaaaatatttcaatttgttaataccacattaattttgaattctagaaactaa

SEQ ID NO: 19343 - DNA, 641 bp, Oryza sativa
tcaatagagggcggcaaaggacccagatgaaaaaagtacggccaaaagatttttctatgttatgttaataataaataaagaagtatttattggtaaaacttgttaatattgttataaaaatgtgttgaagttggttgttgcgcaatttcatatgttaagtgaggtattattttgttccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgcccctaacatgtgaacgtggtggggtatggtgggtacgcttgattggcaccgaaagatacatgcatgatcggcgccgaaagttacattggtcgtatgcgccaaatggcgggcaaatactcgtatcacacgcgaataaaggagcctgcatcggtgcggcagaaagtagtcgtgcatgcgccgaaaggtatcgtgcatgcgccaaaag

SEQ ID NO: 19344 - DNA, 5847 bp, Oryza sativa
ccgcgacgccgagcaggcttctcgccggagcaactaccgccttgtcctcttcaggcaactataattttgctccaatccaacagggttcagcgtgacggccatgacaagtaggcccagacatctgccacgacaagcgtaaacatgaaaatttttgggtctatactatcgtgtgaccaagttacatggttttatatagtttacagattgagatttctgctattggcgccgataagcaagcaggcagaggcgcgctcggcgcagggcgcagctacgggctgctgccatcggcaggcaaagccgcagcggcaggagcaagttgcaaaggaagcctaggagcaaggcagaaaaaaccagaaaatggaaagaatgaggaagagaatggtcttggcattgattgtttttatgattgtcacaatgaacaacatgattgtcacaatgttatgtcctacaatatcgtgcagcgtgattgtttttctcctttattattgttctgtgctagctcttgccatgagccacatctattttttttcctctgccgctgagtggcgcatatgtgtgagggagatggtgaaagtggtcgagagatgtatcggcaaaaaatgaactgtagcacaaaagcaagagctgagaactggcagctcggtggcgacggaagggtcaaccctgttggattggagcaaaattatagttgtctgaattcccttttcctctgtattaatcgtgttggttcctgacaaacatcatacattgaaaactatttattggcagaaaacatgttgcattattgtttcttacaagatagcttgtgtgttagtaatacctgatgatgtaaagcttggcacagcaatagctatcggaaaacagcgttatcaaggcctctagccaccaacctctcatttttcacaagcatgtgaacgtgcgttacaaatatgctaaaaatcaaacagcattacagcgcacaggctaacgctacatagctcgatcggaagacaatttcttatttcccatcacacgtatttgacatatccgatctgaaaaatcaagtttcaaatattttgttccagatgcaacacatagctaaacataaaggtcttttagagacagaatgaggtagcaggcgacaaccaagctagttagctagaagatgcagtacacagtataaagaagctgaaaattaagcaggatacaacaacagcgaagtagcgaacagaggacaagagctagtaaagttgggcgtccgtgcgagtgtacaccccgagcgcatcgaggtaacaccccgcgcgggcgaagaagccgacaatgcacccgtcgctctcccccggagccgtgaatggagtccctccgcctccggcgccttgcccaaacggcccgtagctgaggcattggttcgtggagaacgtgagcgaggtaatgacgactgtgtcaggtgacgctgcatccaagggaccgaacgttccggtgatcccctgaagtgattccagaggcatcagttcaatctgcgagagacaatgcaatggggtacgttacattctaccccaagataaatgtatatactctctctatccctcgacgccgttgactatttaaacatgtttaaccgcttttcttattcagaaacttttgaataagatttaataaacatgtttaaaaaaatcaacgacgtcaaatatctaggaacagagagagtatatatcgatgacagaccgattgaaaaaatatatatattcgtccactaaccttatacgcattgccaccaggaccaccccatggaccaacaacttgctcacttccgtcatggtcggcatatgagaactcaatagaatcgatgacgtcaccactacggatagtcacactcactagacgatgtggctccggtgcatcgacgtagtgggactcacctccacttctaccccatggcccaatcctggtaagcccagtctaatttaccaaaaatgaagaaaaacgaaggattagtgtgtgagcacagaggaatgagatagataggaacagcaaaattttacgctacttatatctctaggtatcacatgcattgctatattaacggccgtttggttggagagaatttttaggagggattgggagtttagagggatgagactattaagtgttttgtttggttgggagacatgggaattttgatgggatggagattgggaattgagaaaggaactccctccttttcaatacctgggtaggggcaggtaattgggagggaattcctcctttactttttctaagcaaatctcatccatccgtttttaataatgacttaatcttcaactaaactccctattaatttccatcacctctaccaaacaagatattgggattaagaatcaaattcacatcttaatctcatcatcaattccctcgtgtaaactcccaatccccttccctcgagttaccaaacaagttataagtttaatactgaaaattgtgacactccttctatttttctaaagaataatggtaaaaatagctatgttcagaatgtcaaattgtagtgctagtcatgcctatacttcttgttattgatggccaaataggctgtctggccccgcccagccaatgcacgaccaggctctgacccgagatcagttgggccagcacaatctgacctaaacatcagtctaggcccaccaacggctcagacacgacccaataagactcgggttgtaccgggccggcacgaatgcacagaagactgcagctgctcctcggtataaatctattttctccctcatctctttgggccgtatcttatatacctggaataagtatattcttgcatcctttatatcttcgggccgtgccttataaggctaaaataagtctattttgggctgtgccgtgccgagccagctcagcatgccgagacagaggcctagtcacgggctaacaatctgaccgggccggcatgaggctttggacaccagtcgagccgtgccatatctagactgaaccaaaccctgtgccctgagtcgggtcgtcgggcccgatcctttctgtcatttgtacctgtggtgccggtgcttcctgcaggtgggggttggcatagacgccaatggcatggacgaaggagtccgcgcagccgaagaagccgacgatgctgccgttgccgcgcatcgggatctggaaaggacttcctccgcctcgtccgaatggaccgcgcctacgggcgttggtgatcagcgtgagtgatgtgacgacatccctatccggtgcctcgttaaatgggcccatggtcccgcatatcccagttagaaactccaaagggccaagctctatctgcatggacaaaaaaaattgtaagaaataaaattgcatcaggcttgctctacgtcgagtctcgtggaagataaatttaaatcgccctccgtccctagattattcttttagaaacacagaataaaataaatatagacgctcacaacgcatacatagttatctctattaactcacacgcatatcctaactctatgagcacatacgaaacactcttttaacgcatatcctaactttgactaaatttataaagagaactatattatttgatatgagatatgtatcatttttatagtttattatttgaagtgatagatgttaatacttctttttataaaagtttatcaagcatttacaaacactctaaaatcgtagattggagggagtataaggtgacaagtttctttttttttaaagaaaatactaatccagcaataggaaaaatggactagaacttggtgggcttggtaaaatacattttaatgagttaagcatgtactcccgaatctatacaatctatctagattcattgtattaggttatgtcacatccaatcttaattaggtttgtttttttttagcgaaggaagtacgtggttagattttttgtactaggtgacgtcacatccgatctttttttgttttttgacaaatggagtgctcaccgtataagcggttccaccaagaccgccccacgggcctatcgaatgcttctgcccatcacgatcactgtaggagaactcaagtgaatcgatgacattgccactatgaatcgtcacgctttccaaacgccgtggtgccaccttgatgtcccgatgactccctccgttccaaccccatggcccaatcttcgcgagggaatcctaacgagtatataaacattcgataaaagtgagaaaaaaaataaaatcacatatagatagatggaaacaacttctcattttagaagttatatatatattgatcacctcatcatcatcgtcttctactggtttctgcttagggttaacatagataccaaaagcgtccacgtaccacccagcacgtgcaaaaaagccaacaatgctgccattgtcctgcactgggatgtggaaaggagttcctcttacttctccaaaaggtccgtagcttcccttattagtgataaacgtaagcgatgtaataacaccagcgggtgccctatcaaatggtccgattgtcccagaaacttccgttacatactctataagaccaagctgaatctgcaagaaaagtttcaaaataacataatactactagtaaacctattataaatttcactagttgtgtgcagagataatgaatgtataccaatcattttatctaaaagaaaaatgcaagaattgaataataagattcatagtcaccttagtacgtttgttccctttatttgggccatagccgccccatgtgcctgatgtgtgctgctgcccactgtggtcaatgtatgagaactcaagtgagtagatgacctcaccgctagaaattatcaagctttccaaccggcggggtgccacctcaatgtcatagtgactggaaccaccagctccaccccacagcccaatcttggctaccttagcctatgtgttaagccatcaaggggaaaaaaacacattgtgaacaccaaatatgaaaatagaagttatgtatataaatatttaaaggaattatttattggtaattttgttaatggtgtcgtgcagaccaatcatctgttactacaaagttataacccactgcttcctcaagaatacatgcaaagatgacacatcattattcactaacaattattacatttaagcatcatacaaacatgctatattgtctataatttaataatttattaaattttaaagattttaaatgtaagcatgttaaatcatcccacataatcataatatttcaatatatctctccattatttttttataacatcctatatactatatatagttcatcctcacttagttcatgtcatttttcttttatcttattaagtcatatcacatcaatggttcaaattgtctctcttcttttcttctctcatcaaaccatatcatcttacttttacatttgaatctttattctacatactatttaaatttaaatcgcatcaacttatataaaatcatgtttatataagcttatgttatttaagttatcttacacattatttttacattatttttagttattgttatcataataaattcccgtaacagcgcagggttttaccttagaattatttgactgtcccgtagataaatgtcccattacaagagaacaacaaaattacttccttcactgattcgttctcggttggttagtaaaaaagttgttcttcgtgtgtaaatgaactactagaagtgtaaaatataagagtacttctatcataacgcctcaactttcagctaggggaagatttagggggaaaaggaaatcctagagcaatcaacagtagggctaagaattttgatcccgggccaatatatatatatatatatatatatatatatatatatat

SEQ ID NO: 19345 - DNA, 13719 bp, Oryza sativa
atttcgattgtaggtatatagcatccatacatataattagttaggtatgtaatcatggattgtgatataaagttagctttgagttgttttgttgataggtataggtatgcatcgaattcttatatctaggtatatactcacaatttgaaaattttaaaaaatttgagtgattttgtgcatttgaaaccatggtgcccgggcaccatggtgccccatatgagtgtcctatatatatatatatatatatatatatatatatatatatatatatatatatttcctccctttttttctagctttgacgttggttagtgcaaacaataaggggtgtatgtagtagttgagaagagaaggctttcaaaagaaaaatggtaatgtcatatggacgcatgcatagttcacaaagatactattggtaactattaatataataaacaatgggtgtgtttagttcacgccaaaattggaagtttgtgtgtgggtgtgtttagttcacgccaaaattggaagtttggttgaaattggaacaatgtgatggaaaagttggaagtttgtgtgtgtaggaaagttttgatgtgatggaaaagttggaagtttgaaaaaaatgtttggaactaaacacggcatgtgtaggaaagttttaatgtaatggaaaagttgaaagtttgaagaaaaagttaggaactaaaccaggccaatagcttgctaaggggaccgagttacacaaggattattctaaaaacatccacaatgtatgccataagggggtcttaaccaattaaggctttagggtgggtagtatacattatgaaattaatctttatagatgaccttatgatgagctagcattaggtataaggaccacccataaggaataaataattcatctctgttctctctcctgctcacttgctcacaaggttgtcagtatcccgatacgtatcctagtatcttacgatactacgatcctaccaagccgaaacgataccgatcccacctagtatcctaattttcatagtatctcgatcctactattcattagtacacgatcctacgaaatcttaggtggtatcccgattctacgatccctacgatactacaaaatattatttaaaataacatggtatgaaaataatataaataaatatgcttaaatttatataaaaatcagttaaatatatcaaaaccaacttggtttctcttaataaatgcctatatttgcatgacatataccattactacatttttttatatagaatggctacatataattaatataaatattaattaaacttaaaaaaagaaaatctcatagtatcccgatactacgatacgatcctatgatacgatattactttgagcaaaacgatactaacaagtatcccgatactgacaaccttgcttgctcaaaactctctcctacatgctagcattaggtgatatttttatatctgtggggcccaccttatttcctaacaagttcataccattgttgggtatgtaccacaactaatatcacctgttgtaggacccatctatatagaccacttgatctcatatcctaaataaacgatagaataacatacccatgcctgtttgccataggaatttaacacttatcaatcattataaaaagggaaatttagtgtgcaattgtagtggtgaaaatgggcaggtacgattggattatagcattcggatatcctaacctatattttactttaaatttggaacctgaaatgggtagtgtcggacaatatatcactcatcccgtatcctatccaatattacttccttcgaatcggcttcgggtacggatatctatttgcatctctaattcataaatattaaatataacgaaccaattatagtgtcaaaagagataaattacgggaaaattatacaatattgcacgtgagctcgtaaaatagtgattaaccaatccttttatcatgcatgtccgtaggtggacttgtaatagattttcatatgtgttctataatatgggacatatgagtggatacaagtcttcttgtatcataacccattttttttaggattcgaattcaaacttggatagtatcgggaatccttattttctcttccatattcttcccgcgagtctcagatcgggcaagctatctggaaatacccgtccattttcaccctatgcaatggtgaatgcaagtccacaattgggaaatgtaatcaattcatgcagtagtagggatgaaaatgatcagaaacgatgtcattattttattacttttatggaatcggtcatggtatggtcgtaaatttttggtattcatgaatttaactatttagcatcaacttcgatatgatgttgataaaagttagaaaaaaatctaaattttatatatggctagaaatgaaaacgatcggaaatgatatcatttttacattagttttatgaaatggtatcggtatggtcagaaatatatgtatcattttcacccttatgcgatagtacttaccaccaaaattagtttttatggttcttttttgtacaaagtagtataatatttctggcatttcaccaaggatgtacacatacgtatttgtaaacataaggatttcaatcatggcaagtagagtatgtattatatttctgagtgaattttttttttgcattcactgacttttatgattgtggaaatagtttcactgactttatatatgtggcattaaataactacttcctctaatattcccaattgatcatcatatatttttatgtattttcaaatgatgatcatattagtattcattcactaagtttattcaatatctctgtgtgagaataataaatatcttggtctgttagtgcactgcattgatcgagttgttaccaaattaaatatagtatggagagttattggcttttcttgattttcatgtacttctataaaatgtgtggatcaattagaaatggaattgagtatttattatctcccgcctcccgcaaagctaacatatacatacatctcaatcatcgtcataattatgaatttatcatacctggtcctgtgatgacgacacggctctagtataaatttctgtctgtttcaactcatggataatgtcatttatagcaggtctgctgtgtctatcaacctcgacgcagcgtacagctatttcaacgcattttttcacttgctggcactcttctttcgcgtgcattgatgtgtccccgatcctattcctccaattatttgcaacctacgaatcaaaatatgagcaatacatttgttgattgagtacacatagacatggttccgccatgcatgcatggtgtctgcttagatgaaaactgaacttgttcttctaagggcacccgcaatgggctctctacaagatatccatgttagtatattttcctacatggaagagattaaatgaagagagagagcaaaactatctactaacctggagatagtctatagagaaaaacgaggcaatgcattagaaagctatagatacccatgtagacatactattgaggtggtttactattaatctagtctattgctgagatgcacatgttttatagagagcaccttactttaccattgcgggtgctctaagggcagtcccaaccctccacctaggatggtgtctatggtattaactacattggcatgtaggacttttaacttatgtggcactatattaattaagagagagagtgaaaaaagaaagaaactgggtctcatgcaagatacagcttcaacacgagaacctatgcactagacactatcaagttttgtattgggagataatagtgtcttcataatagatgaagaataaatatgattgataaagaagagagatgatgtatttattaatggcccattttaagaaattacgggttatgaagtgtagtttctattgtgatgtcttattgacatggcaccatagacactacttatggacactatgggttgagactaccctaaagctacgagaggggttggcaacctatcctccccgttacgcaaaacaaagcatatattattgcatgattaattaagcattaactatttttttaaatagaattaataagattttttaaaacaactttcacatagaattttttttcaaaatacaatttagcaatttaaaaaatttgcgtgtaaaatacaagagttgtgagttggaaaagcaggggaagaacacaacctacgaatagacaagttccgctagccatgcacttcttttttacttgggatggacgacatctctctttgaaaggaaagttctccagctacaaaagacccgtgcttgttatgccttttttttattggtcacttttgactaggcacaaataactaggtaatcataacttttgcacaatatgctagtttcggcattgatatgattatttaaactagtactccctggatcctaaaatatatagtacttactccatttattttttataggtatttttttaaattaaaaaaactacttttgataggcatatttcaatctaaccacctaccatcttaatgactttctcgtatttaatgcgttgctctccattcttccacttaagattggttatatgagcatcgagaaatgtaaatataatgaattgcttgtttacgatgaataactagtagcatatttaaatggatgataagtagaattacttatccttggtcattgtgacaagaagaaatatgactatcaaaaatagatgggggagtaacttttagctactaatctgaacaaggaaaactgtttggctagattcatatctaaaatttgttatattttgggacagagtgaatacattgatgggttggtggaggtgaaattattattagataaggggtaataatatgaaaaaaattgcaaacaaattttgttgtaaaaaatgataaataaacaagaatagagggggtaatttcttacgagatcgacgaattgttgggttgatgacatttcgccatattttgagtagcctttatgtcccaccattatctggatgattataatacctaagctgaatatatcattcttatttgatattttacgttgtgccaagtattctggtgccatgtagtacctgcatcatatcatcagtgatgttaaacaaacaccatatcattcggttagtactaataagaaagaaagaggacatatctcttgacgtcctctctacttactctgaacctacgcaaactttagtggtatgtgtatgcgagccaccgaagggccttgataccccaaaatctgctatttttggcaccatgttattatctagaagtatattggccggtttcaggtccagatgcaaaattggttcttccaatcctccatgaaggtaactaagaccttcacaaatccccataattattttgtagcgtgtgcaccaatcaagcccgcgagactcttctgttaaagtggcaaaaaatattcttgaaatgtgaggattacttttttttgtttacatgttaaataattggatagagttcgcaaattaccaccatactcaccatgcagataattctccaggcttccacgcggcagatattcaaagcatagaactttgtatatcattttacaaagtacatcttccccattaacctccatgagttcatgtcttgcttcattgcaatagcctataaatcgtacgatatttttatgttgcaccctcataaggttgctgaattcattgctaaattgcacatcatcaagtcctcgcaagtcatatagcttcttcacggcaatctctggcccatttgtcagcactccctgttgcagttgtatttcgatctcattatttcattaatatgtattactacaagggtacgccgtaagtgggttatcggagttcattattgataccacttgaaacaaagatatgagtatcatatctcacaaaccttgtaaacctgaccatagccaccactaccaactatttggtgatcggagaattttttcgtaatatcttctagaaaatgtaccggtagatcagttggcattgtacttggatggtttaacttctcctgtttacagatttgctacctcttcacctatatatacacatgaattattaaaactttcgtataagaatatttagagtttacataccttaaattaagatgagtgaattgcacgttattaacgaaattttcacccaagctagatataaaacctaaagataaatatttacatttattgtcatagtttctgggtagtcttttaattatataaataatatatatcaggattaatttaaaacaaagttgttctttttatgataatcctatctattaattaaccattttatgctgtattggtccccttccttccccagaggttcgatttgtgtgtcattagaaactaatttggaagttcccaagcattttgaaaattttataacctttgatgctgtaacaaaatttgaaattatataaaacatggcaataatgtaagggaacattttacgaaaaataaaatatcacaggtacaaattcctattaaatttaaaaatatatttttcattcaatttttttgttagaaatattcaggatgcaaaatcttttgtacaaatataccatcggtctcgcacaaccattgcacgagaatgacgtgaaaatgacatcgtggccggtatcatacagtgaaagtgcgagaccgcgcggtctcgctcaagcaatcagcgctatcgcacaagcaaagagcgaaaccattcctagccgatttaattagcgattaattatcctgattagcgattaattaataattaattaatcactaatctggataattaatcactaactattattatttaattgttaatcaagtaattaattactaatcaaatggagccctttggacagtgtcgctgattgcttgaccgaaccgttcagtcccagctctttcattccgcgataccgtgtggtctcacgctgttgccgcgcgagaccgcgcggtcaaaattaaacgaaaagtatattttcaaatttagttcttcgtaatagtgccaaaatttccccacccgtttttttatttttttaaaaaaaatgttgtaaagaccctttttttagaactttgtaaagaccatagaaaacttactaggatgacatctttggatcatgcgtagagaaaaggtaaaatttattcagtgcatacactttatttgttcttatctttcgatcaattgatgatggtttgagatataaacatgtggtatgtggatgttgtactaaccaaagaaacaaatacacgagaccacttgcaagtaaaacagaccacacgctatctgctagctgtcatattgattcaagtgtatgttatcgaggctaactaccgttgcattagtacattttctttttgctatagagtcttttgatgacttatattttttaaaaaataatacagtaattacttaaaataaagaatatatgtatttacttgaaaatcatctctacactttgcttgtgaatttactccatatagtttcttatttcaactcaatcatgacgtaattacttctaatactatagagagttacttctattacatagcaaggttgcataaatgtttgaatatattcaagatcatcttgttttgtcacatattttaagggaagtacatggtgcaaatagatcataaaaataatatatgattaagaagatataagtcataaaaagattaaaaaaatacgtttttagctaaaagagaatttagtaggttgaagtgattgccgcattcttttcgggctattgggtttgctgattagctacacgtaaaacgagaaacatgattagcatatgattaattaaatattaattataaaattttgaaaattgaatttatttgatttttaaagcatcttttatatagaaagtttttgcacaaaatacaacatctagtagtttaaaaagtatgctaatgaaaaacgaggaatagataaggtgaactagctgtttagaacgccgccttaaccaagcaacgaccggtcgcgcgcaaactcacctgagtaagacatctcgttgtcgattaaggccctgtttagttcccacgcaaaaattttacaccatgtcacatcgaatgtttgaacacctgtatgaagtattaaatataggctaaaaataactaattatatagattacgactaatttgtgagacgaatcttttgagcctaattgctccatgatttgataatgtggtgctacagtgaacatttgctaatgacgaattaattaggcttaataaatttatctcgtggtttgatgatggattatgtcattagtttttttattaatgctcaaacaccctatgcgacaccctatataatactcgatgtgcacgccaaaactttgggcctgtttagatccctgccaaaaattttacgccctatgacttcaaaagtttgaatacctatacgaagaactaaatatatatagactaaaaaataactaattacacagattgcgactaatttgcgagacgaatcttttaagcctaattgcttcatgatttgacaatgtggtgctacagtaaacatttgctaatgatggattaggcttaataaattcgtctcatagtttactgacagattctgtaattagtttttttagtgcccaaatatctcatgtcatatcctatataatatccgatgtgatatgctgagactttacactcagtacatgtaagcaccctctaattcaatgcatctgcagctggatgtacatgcctgagcgagagccccacgccagcgcgtgcactatgcgaacacgacctgccactggtactagggtcaacaatatttgacgtcagtaaagcaatcggtttgaaaaaagaaacaccactccctttggagacttgacacttgtgatgggacgtgctccaagtctgcaaacacgtaccgtcatcatagctctcgtgacttttaaggctgtggctgtgttttgttcggtgccaacaaattttggaaatacatttaaagtattaaacatagactagtaacagaataaattatagatttgaactataaactacgagacgaatattttgaacctaattaatccatcattaggaaatgtgggttaccgtagcacttatggctaatcatggcgtaatcaggctcaaaaaattcgtctcgcaatttacatgcaagctgtgtaattggttttttcttccacatttaatgctccatacatttgtctaaacatttgatgtgacagaaaagttggatgtttgaaggaaaaaggttgaaatctaaacacagcgtgtgttcggatgccccttttcccaagctcgttttcctcacacatgttttctacactgctaaatggtgtgttttttgcgaaaagtttttatacgaaagttgtttaaaaaaatcaaattaatccatttttgaaaaaaaaactaatacttaattaatcacgcgctaatggaccactccgtttcccgttgcgcactgttccttgggaacaagcaatggtgaacacagcctaagtatattacttcaaaatataagagattttggttcgataagatatatcctagtgtttgcgtaagattcataatactaagatatatttctttcaactaaaatatcttacttcctatgtcccataatataagaatatttagagggatgtgacacaaccagtaaaatacatctatatggagagcctgtccagatataatgtactaggatgtcacatccctccaaaatcccttatattatgggatggagggagtatattttataaatttgtgcaaatgtaaaaatgaaaagttatacttaaagtactttagataataaagtaattcacaaataaaataaataataattctaatttttttataagacgaatggtcaaacagtgtaagtaaaatgtcaaaatcccttatattagaagatgcagggagattaggatggaggaagtatatggtattagtgttatttactagtttcataatatatataatctgataacaatttatttttcttctataatctgataatagaatcgtattgtgaatgttcttatgctttcctcatgtacatctttttctccagatcgaactagctagtatcttttgcattatacatctaaactaaattattttcattatagtagtctacatatttatcgatatgcatctaggtaatttaagatataccgatttagtttttcaagatgctactacaagattcctaacttttaccaagggggtttaaggtcggccacctataaaactgtcggccatacatattactgagtggttaccctcggcaacacgcacatgtggtcggtaatttatcatattgccgagggtaccctcggtaaccatgtacccgagggttacggtcggtctttttttccagagaccacgcatggttctttcttgccgacacatttcccgagcgtataccgtcggttattcttattctcaccgagaggtttattttcccgtcaaattgagaaccctcggtttctaatataccccgtcggacactaataatcatttccgagagttaaattaaacccctcatttactaatataccccgtcggccactaataatcatttccgagagttaaattaaaccccttggttattaatataccccgtcggccactaataataattttctagagttaaattaaacctctcagttactaatataccccgtcggccacttataaccatttccgagtggtatcttataactctcactcactgatatatcccgtcggccacatgctaaatagccgaatgttctcgtaactacccttattaaaatttcaaacggtcggctacctaaatcttcctgacggtctgtaggattttttgcttggacgcttggcaaatcttaggattctagtagtgagatcaataaaaaaaagagtgtatatgttaactttaataaatctgtgttcaaaagaatgcatagagttggcgtccaaggctggcatttcttttgggtgggggctcgtagtccaccgagttcatgttctttcttggcaggcacacaatcccaaaacaaatcagaactcgaaactctagctagctatgtcccatctgccgaagacattgtcgttgtcgccgtcaccgaatacccgcagctcgtcatcactatctccgtcgctactacccctccgccgctaaatctgtgcaggggagagccgccgccaccggaggagcacgggggagactattgccgccagatgcgcacgggggagggccttcgccgctagatccacgcggggcaaggctgccgccgtctatgcgccgctcctctgttgactgttggactgcgcttgagcccgccgcccgccgctcgctcctaccgtctctgccttggccgccagagaagagaagtgggagaggggagagggaagtagaagagatgaggagagggagtggagagagatggcttggaggattgggggagagaagaagaaagagaaaaagatgtggtagagagaaagattgtttttaatatatctgccacaccgtttacatattgattttttttaattgacgagggagtgcggtagatccgatgatcctggttcactcgtagacgatagatgaccacccaaaaagaatcttggtcgctcagaccgttcaatggaaaaacgatcaaggcagtagactttttcatgagttcttgaaagcaactattggtttttatggccaatttaatttgttgcagcaaaagtgtggctagaaattactaaggcttgccatcttaggcctggtttagttctcaatttttttcttcaaacttctaactttttcatcacatcaaaactttcctacacatacaaactttcaaattttacgtcacatcattccaatttcaattaaacttccaattttaacgtaaactaaacacccttagttaaagaatgcactaaaattggtctcatggcatgtgcaacaggcctgttaccctatacctatataataaatgagtagtctgttggaacgtaaaaattaaaaaatatatataaacaggagaaatgtagaaatagaaagtcatggcatatacaatcgccagaaattgaaacactaaattttgtcgaacaagttgtttgaatacttcatagggaattcatagtaaaattatagggatgatattatttagatagagttgagaggaaagataaagatatatagtgtatagtattggatttctcaaaggaaatcaaaaccaaggtttgagcttatatttgaaatcctaaaaaaaaaggaaatgaaggattcctatggaaaatgtctagccaaatccaacaaaattcctataaaaaatatcttgatccataggaaaattttcaatagaattttaatatattaggatagtggctagataggatttcaatcctacaaatttcctataaagtccctggaaacacagggctcttttggaacgcaacaataaaaaaacatagaaatacgatagaaatgtacatgcaaaaacataggattgaaatgttgtttcgaatacaagaataaagtaaaacacaatattctttctaaacaaagaagtgtatataggggtgtgtgtgtgtttccttaatgtgtgttcaaaccgtgatcattcgaagcgacacgcattatgtctttgacttcttacaagaaaagaaaacaagaggtcctaatgcatgctgaaatttctatgaaatcaaggccaaacgaaaattttgtctaggccccgtttagttccccaaattttttccaaaaaatcacatcaaatctttagacacatgcatgaagcattaaatatagataaataaaaaactaacataagtgctacagtaacccacatgtgccaatgactgcttaattaggctcaaaagattcgtttcgcggtttccaggcgagttatgaaattagttttttcattcgtgttcagaaaggccttccgacatccaatcaactatccgatgtgacatctaaaaattttcttttcgcgacctaaacatgccctaaattttctttaccttttccctccagttcgaaggatgcatgaatagtaactcgatcaattctgtagtaaccgagacctccaatcctagggaaatctccaattaattttcctttagaattcctccgatcgatctaaaggaggcctaatatcatgcaccatcctagctatagcatggaatgcatgttcatgaagacatcgatttaaaagcttaagtttgcacatatttacaaattacaataggttttcatatacttgacattaacctgtccttcacgacgctagctaagctctcatcacgcacatacatgcatgaataatatatatccacacagcacagatctaaatcgttgcgatccaaaagataattaggagaactcgtcaaatatagggaaacattcgatatatgaaatcaacgttcaaatatatatatttatgtacttaaaaaggaaggaaaaacaaacagatcctcaccgcttggtggagctagcaaccttggtgggcgttggcgcggaggatgatataatacggcgtgcaagctaagctaggcacggctgatcagtgagcaaaatcgatcgtcgaaattaagctgggcctctgtgccgggtgtgtatatatagagtgtacgtgtgttgtttctggttcggtcgagttgtacccccgtaccgagaatcgtaacgagcgatcgcttgcgtgaggaagtggatagcgattggttggtgggcctctcttc

SEQ ID NO: 19346 - DNA, 5122 bp, Oryza sativa
ttggtgggcctctctttccagttcccacatagctttcttatattttggcaccacattaattttctattttagtaagtttatatattttaagtttacatatctaaagtttgtactgttaaagtttatacacataaagtttatacgataaaagtttatatactcgatttaaatttgaattcaaatttaattatattttatataaaatatttatatacacatagtttatatgtacaaagttagcaatgtatatgtatatatatatatataaagtctatgtaaataaatagtttttagtgtaatatatttttcattctcttttttcacacttattttcaaattgattttaaatttacgaagaacccacgactaatcgcctaacgtcgttgccttttttttttttacgtgaggaaaccgcgtgcgggcgtgatttctgatcgttggcctccggcgccagcgatcgttcgcgcagtagccacggccagttgtaatgtacgagggaggggagcatcgaatgagagacgggggtaataattactagattaattagttgaccaaaaggcatggaacgagacgggagtaataatcaattaacgcatgtgcgtcagcaccgtaagagcaagtttgaaagtatagcgactgctaactctaaatcatctatagtcaatttaatatgtaatttatacaataattaccattataaatatataatcctacctaccatatacacattgtatcttagagtctatactatagatgagtataaatttgtagcccgctactcttctcccctattttatcctctcaacatttgtttatagccactactgtacctgctctaaggttgtgttcttcacccttttttctcaactcacatctatctttttctgcgcccacattttgtaaaatgataaacggtattcgccctccgcaccagaatataagaagttttagagtttgacacaggtattaaaaaagtaggtagaagtgaatggtgcagggttgtgattggatgagtagtggaggtaggtggcaaaagtgaatggtggagggttgtgattggttcggaagacaatgttaatggagaagttgttatattttgggataaatcctgagggctaaaagttgttatattttgggacggagggagtatgttttcctaaaattttctatggtagagttgctttaaaaagtcgtgttaatccatttttcatgttttcttttgactggaaatttttcaagtcttttaagctaatatttaattaatctcgctctaatcttctcctcccgaactcagccagtcagcctaggtagcatatctcgcccaagcgtattactaagcccgcgtttagcatgtactctctccgtttcacaatgcaagactttctagcattgtccacgtacatataaattttaataaatataaacacatatatatgtctagattcattaacatctaaatgaatgtgggcaatgctagaaaatcttataccgtgaaatggaggaagtaacttattataataacaaaaataatgtaaataactaagagtccaactgaaagttttaaaatattaaagtcgaaagttctgaattttgattgtttcgacagttgaattaaaaattttaaattttgagttgacagttttaaaaattcgagttaaattttcaatattttaagtaaaaaaataattttttttcaaatttagaaactttttgttgaaaaacgtcttataaattttttctcaaattttacaagtatttaaaaataattgtagagtttaaataaaactcaaattaattaaaaattaactgtgaaaaaaatgtttaaatagctttcatttattgtaaactgcttaatataaaaaaaaacacttaaagaaacgtttgcttcgtatcaggccctcaacacaaaccagcgcgtggcaacgcaagatttagtttttccggtcaagcacgacggtaccaggctagaattaagttttgtgaatgtgcaaacatccgtgttgtactgtaatttgttctaaaggaaaataataaaaatgaaaaaaaaacaagaagaaaaagaagggaaaatcgctcttgcggacagcatgtttgccgtcaagcggacggtcgatcgaaaggtatgtaccgtagaccgtgactttttttgtacggagggagcaggaaattaatatttgtaggcctcgacttgacttcgaatctttaacacgacccgcgcggcttcgcggaagcttcctcactgagtaccagtagcaatgtgggggcacattacatgtgaacgttttcctggtgtcttggcggcagtgagccgcgaagccgcgtggtcaccttgacaaggccaagtggccaacacgccgcgcccatgctgtcacgtacgaggatgattcgcggaccggcgaggcggcgacgcggacttccttgcctcgccatcgacatccgccgtgtttaggcctggtttagttactgctctaaactttttccttaaacttttaactttttcaccatgtcaaaacttttctacataggatttatttaagggctgtttgatacagctccaactcctaaatattactccaggagttaggtctggagtggagttatggagttgcctaaacccagctccataactctaatatattttatgagagagctccacccaaacagacccttagttttaatagagctgaaactgtttggctgagctccagctccaggaggggtggagctgaagctgaagatgtgccaaacaaacccttagttcacatcaaaattggaagtttgattgaaattggaatgatgtgacggaaaagttagaagtttatgtgtgtaggaaagttttgatgtgatagaaaaattggaagtttgaaaaaaaagttggaaactaaaccaggccacacgcaaacttttaacttttccgtcacatcgtttcaattttaatcaaactttcaattttgggtgtgtttagttcacgccaaaattggaagtttggttgaaattggaacgatgtgatggaaaaatttaaagtttatttatgcagaaaagatttgatgtgatggaaaatttggaaatttgaagaaaaattttggaactaaactcggcctttggcgtgaactaaacatatccttagattcaaaattttttcttcaaacttacaacttttccgttacatcaaatgttagacacatgcatggaacattaaatgtagatgaaaaaaaccaattacacagtttgcatataaatcacaagacgaatcttttgagcctaattacgccatgatttaacaatgtgtttctacaataaatatttgctaatgatggattaattaggcttaataaattcgtctcgcagtttacagcgaaatctgtaatttgttatattattagtctacgatcaatactttaaataggtgtccatatacttggcacacaaactcaacacagccatcgaagaaaaattttccattgtaacgtaaaaccttttttcttttagaaccatagcgtaaaacaggtccgccgatagcgtggcattcgccttgcaggtataaagcggaacagtttattagcgtgtgattaattaagtattagctattttttaaaaagaaatatattaatttaattttttaactaactttcgtttagaaacttttaaaaaaatatatatcgtttagcagtttgaaaagctgaaaataagagagagtggttggaaaaaaaaaaggcatccgaacacaccaaagtaccgcacggggccggacaggggcgtcatgcagcagtggtccaggcggtatatggtcgcgacgtcgcaagcgcaggcgagcgcgccggccaacttgcagcgcgacgactcgtccctcctgcggagcaagagggtggtgcccggtgccgtggtgggcgatgtcggttgcgccgcggacgacgactttgcgcgcggaagacttcgaaaatgtgagtttttcttttctttttctttttttaacggtgggagtatagcactagctgttgcgtgtgtcacaggcccagcggcaagctatagatagccggagttgcatccatatctagagcacccaagtgcaagttttgtgttctgtacgagacaacttgcccttcttctggtcctctcaggtctcagcaggttagtcaatcgcgagaactgcattttttcccctcttccatgcatgctaatcaagctgatcttctagctttatcttctagatagcctcgccatttcttttgcatggtttcccctattttttcagattgatcatgcgagaaatccgcatccacacttttttttttgtttttctcatttctcctagtcatggcatcatgggtacaatagctccatcgtccggccttcattgatgtgcgtttcaaaaacaaatatgcatacaagtaccctatgagattgagagtgcaaccgtgtgttatcaattgtttaactatatacttcctctgttttaaaatgtttgacactgttgactttttagaacgtgtttgaccattcgtcttattcaaaaaaattaagtaattatttattttttttgtatcatttgattcattgttaaatatacatttatatacacatatagttttacatatttcacaatttttttaataagacaaacggttaaatatgtgctaaaaagtcaacggtgtcaaatattttaaaacagagagagtatcagattatccccaacatgtagttatgagaatattgctttgcaatagttatgcttacacactttatagaaggacagtaggagataaatggatgacaaggagaacacgttagagcatgcaagagtgatgcccgtggaccttacatacaaaaagttagaagaaattacaaatggtttctctgaggagcacaaagttggcagtggtgggtatggagttgtttacaaggtatggttcatacttgtatttctatttttttgtaagtaatacaatatatactaccattaatactgggccaccagaaccctgatgccatatatgaaacaaattaaagccacttcatcaaacagggagtactggaaaataacacagagattgctatcaagaagctacatcaaatggtaggactggacgatgtgcaatttaagaaagaatttaataaccttatg

SEQ ID NO: 19347 - DNA, 547 bp, Oryza sativa
gttcatttggacttgaaacctgctaatatattactggatgagaacaaaatgccaaaaattgctgatttcggtttgtcaagactctttggttcaacacaaacttttacgacaagaacttttattggaacagtgtaagttatgcaagttgattcattgtgaaagttccattgatttctatacccttttctaatcattaacaacatgcagtgggtacatgccgccagaatacattgagagacgccatatctcaatgaagtttgatgtattcagtttgggtgttataatcatagagataatggcaggacaatcgggccgttctacaagtgctgaaatgtctccccaacaatttattgatactgtaagaattgttttttttttctcaaactttttatcattcactttctactttctgctttattattcactttggatttgcaaggtacaagagaaatggaaaaagaggatgcaggaaatttcgagtcatacatcatcacatgaggcagatagcctagaagtcaagacatgcatcgaaatagctgtaaggtgt

SEQ ID NO: 19348 - DNA, 220 bp, Oryza sativa
ttataggaaaattcacctcgacagccgttgggtccttcgaggtaaggattgccttcgtaccctttggagcagttgcaggtgtagccaggtccgttggttgagttgaagcactcgctgttggtacttttgcacgcgtaagagtccatcttcttccatgcctcctcacaactgttggcgctccggatggcccaatcgagcaccataggcgcccggccatcat

SEQ ID NO: 19349 - DNA, 1688 bp, Oryza sativa
gcaattagccccctgccgccctctgtatgggccgcaggggctatttctgcaatttttttggtcgatagattatttctgtaaatattaaaaaaaatctaaaaacgaaaaaaattcgtaagtagggatgcacatgggtcgggttaacccagctacccagcgacccagcccatgaaacatggggtcaaaacctcatgggcttacccatgaaatttcatgggtcatcatgggtcgaccctcagtgacccatggagcattatgggccgacccattagctaggtttcaggtcgagtaccaggcggcacgaccagctccgccgccgccgcatcgcgctggggctctccgctcctccgccgcatcatgttgtggagctccgcccctccgccgttgccgtctaccatggaagagcgagatgcgcaccctcaagatcgccgcttggatgctccgtttctcctccctgcagcgccatgcgcacccccaagattgccgcgtagccgccaccagcagacctcccaaccggccatagaagaaggggatggatcagatgggcggatgctccacctttcagcgccacacccagcatcactctcgccgcgccgccgccaacgacggacctcaacatgtgttgatgctgcaggtatgcaagattctctatttgctttgaatcaagaaattgggaggaattgattggacgtgtgcattatattgggaatttggcatagatttagaatcagttcctgaagggcaaagattcaatgaaagctaagtcaggttccaaaaggaaacgtgagtatcatcagattatagtgagaactgtgattcagtttgccctggaccttgatctgtttcttttggacctgtttaagcagaggtagattttgtctccttggctgccttaagatttttctacagacaatgagaaattggtcttttcctgcctaatatgtctctactctctagtgacctcctgaatagtatctagaaatttctgcttggccttatgtttgaatactaatgctagcaatggtacttggttcctatcagtttgtcggttttaggttgtttttgtacggcagcagagccaacaatgatactactcctccttaatagataatactccaaaagaaactctagttatatctttgcaagtatgtgctacacgcctacgcaacagtaaattttgctggtaggatgctttcagttattgccaggccagccggtgactcgattagccggtggccagggtagaagtgtgtaaatggatcgtattattccttggcattaacaatttgtatttttttttgctgatgttgattaagtgcgtaataatgaaattaatttttgcaatatgttatgttgttggtatgcagaaggtggtcaaagcatggagacccctcagatcgttgttggtgctatactataaagaagatatactgcctcgagttgatgattttgatatcttaacctggtggaaggcaaactcactaaaatatcctgtactctcacacatagcacgtgatgtgttagccattccagcatcacggttccatctgaaaatgctttcagtacaggagggagggtaatcaatgactacagaaccagattgacgcctgagatagttgaggtaaaaatttgtctacaggatctggatgagagtcgttgattgtaagtatatcccttttctggggatc

SEQ ID NO: 19350 - DNA, 1586 bp, Oryza sativa
ttttcctgctaaatgcttaaactaggtagaaatgatttttaactcagcaaatacttcagttcttttaaatggtgtacctggaatatccttcaaatgcaaaagaagggtcagacaaggggacccgttgtctccacttttgtttgttctaggggctgagttgcttcaatagagttttaatttctaagcctattcagcctgatgaagaaagtgactttccaataattcagtatgctgatgatactattatacttaggaaggctgatcagaaggattttttttttgtctcaaagacttagtttgtacaagctttaatagttattggacattttatatctgattttatagttgaggggcaacgtatgatactcgaccaacagttaatggatccaaagtgaacgtttcccttagaagagggcctaataaggtctatacatgcgcttcagctttttatgcggccgaagggctttgggcctagtgggaggatttttctttgccaactctgtgacagtgagtatgattttcatacttaaaccgcaatactagatacaacgggttcctcaactattaaaaccggtgcaatattggtcccaggacagtttggatgacggtttttagctgtcgtggcacccacgtggctaatttgaattggtcttcatctaacgtggcattgacgtggtacatgaagcaaaatttaatagtttaatattaaaacaaaaattgtggacccatgtgttagttaaacaatatggttaacatttcttccacctaatcctttctttgacatgtacggccaagcctccgcctccccattccccggtgtctttggcaacactaattcctcccgccacgccttcgcctccgtctcccttgacgatgacttcaagcacatggagagcaacacccaaggtgcctccgccgacatccattgaaaagagtcctctgaccaccgcaccggacccttccccacatgatgacgtcttctcctcccctcatggacccaccattcatgccttctccgctgccgcttccttccctgcctcttgaaccccagcttcgtgcctgccttgcagatgcaagcggtgatgacattgtcgatgggaaggagaaggggaaggcccccgctatggctggctatgagcgcgagtggctgtgcaggatcttcttccgattcaagctcgatgtcgatgggagtctcaccaagctagagcttgccgcgctcctatgcatgctcggcatccgcctggcatgggttattgttcccgatttcacaaaagagcagcaactcagacttcactagaagacaacaaccaaaccttgcctgaaaccaagcgaaaggttcaattcatcgttgccaagctcatcaaatactcgacgtagcagctccgacttctcagaaaccctccttggtgtcaaaatggggaataactagagaccgccatggatttcacttgacgatacgtttaactcccaacatatcggagtagaagatctaccatgcatgaagttaaactagataattaaatttcagtcattaattttgcggtacacttaatgctacattattttacatgttagtgtactcttat

SEQ ID NO: 19351 - DNA, 1162 bp, Oryza sativa
gagctggtactcgagtagatagtccggatcaatataccccggagtgcctttgggcacagcctgattttcctcatcaattgttgagcacccaaagtcagacacctttgcgatcaatccctcggcaagtaggatattagctggcttcacatcgccatgtagtataggatgcggtaggcaatggagatgcgcaagtgcttcagcggattccgcggcaatcctcaaccgagttcctagtgtgacatggaacctcctgcttctctggaggtcaagcagctcttgcaatgttttgttttgcacaaactcatatacgatcatgggccccttgaactgcaggcaacagccaagcaactttactatgttgggatggttgacacgacaaagtataaccaactcctggacaaagtccctcttcatgctctcgtcaatttccttgcattgttttatcgcaacagcaactccgtctaaatctgccttgtaaactgttccctgtcctccttcccctatgatgtgtgtcttgctgaaattacccgtggcagtctcaatttgcactctgtcgaagagagtgaacccgacattgccctctactttcatcatttctaacaggagctggcctccatgctgctgaaaatactcatcagtttgtctttgtaaattttgccttctgatacttcttttatgctggatcacttctcttatgaggaagctagctagggcaaggaaaacaaaagcagagattcctgtcgatgtgaagattaattagttgttagtatgtacgagaatttaaataagcagtcactttgacattgatgaatcgaacagtccctgttgactagatcaaaatgacccagacccttttccctaacgtattgggacgacaaacaagaggattatatgctcttattagaaaaggagaagatggcagacgaaattaagtcagtattaacacacacactctctactatatggcacgacaaggtgctacgtactaaatggtactgatacagcccccagccccaccctcacacactccccaccctgcccccactaaatccatagcatgctgttaaaatttaactcaccgacgaccaatctcaatcccacccctgcgcccctcccccactcccataatccgggtaatttttttacttgatgttatccaatg

SEQ ID NO: 19352 - DNA, 243 bp, Oryza sativa
cggcggatccggccgccgctttgcaccccatgcgcgcggacccggccaagatggggcggatccggcgtgactacgggtgtggcgatgacgggcgactacagcgggaggcgcggaggcgcagcggcaacgagcacatcggcggatccagccgccactccgcgtcccacgcgcgtggttccggctacagcagtgcagatccagcgcagttgtgggcgtggatcctgcacaggtgacgacggcggg

SEQ ID NO: 19353 - DNA, 2096 bp, Oryza sativa
  unsure (1)..(2096): unsure at all n locations
ggtttagggatgtatcaagggaaactcaaggagaagtcatggaaaagattcaaaaggaatacttgggtatttgttctcgggaacatagggtggagtcaaggaaaggattccaggcgggatttgaataattctggattcgtagaagtatttggccgaggattcaaaggaaggatttgaatttcggaatttgattttggagacttaaattggaaagaggaaatttcgatgaggatgattttgatggcgacgagagggatcaaggacggatttaaactgagatccacggcacgacttagactcgcacacaaagaacgaaaattttcgcaattaggattttgccgaattagtttttaacgcctcacgaaaagtggagcgttacagatccaccccccttacaagaatctcgaccccgagattcgacggtggaccacacacacgaaaccaaaaagggatcttcagacttcttcacagcttcagactctgctagtctttcttcaacttattgttgcatacttgccacaaaacggtctggtaacttgattcacttagcattcttcatcttactgtggctttgctcttgcctgtggaacctgttcttctcctgctccttcaacttgctcgagattcacaactttttcatttggttctactttgcacatggctcagacgaccttgtccaacgggcggtgaggtcaacgaggcagaaccactatttggtggctttgaactttttggtccagatacgttaggaaggcttgttgctggttggactcgttttgacttgactttctgagggcaggaccatgaatagtgtcccatctcatggcagatgaaacattcgactcctgccttataaccacgtctttttgaaggtgtacggcatggtaccgagttccttcctttatggctattattgataatcattgtggcttgctgaccacgttctcacatagtccaacgagacatagaaccggaaccatttgaatgctgaaatgctctctgataacattgcgctaacgagcttgtttttccacacaaaccttctttagcttgaatctctacagacattactctgcatctcttgaattcttgcatctcttgttctgcatcttctaagaacaaggacttatcgaccatttgccgaaacgtcagaaagtcgggagccaaaagtttcactcccagtttcgcatccattctgttagaaattcttctgatcttctttttatcagtgtctacacttgtgaccgcccagtcctagagggcagactatctcttagcttcgtatgttgtttctggcaacttgttttcctccgaaagaatgttcttcactagtttcaataactcgccanatgccttgtcactgacaccatttttggcattccattgcaagaattcaagagttgtacctaactttttgtgcccctgttcgcaacctgggtacaacggcgtcttgtgatcagctaacatacactctaatttctgagcccccttttcacttttgcagtcctccttgacgtcctgcaacatttgaccaagatcatctgcagcatcgttatcttcaacagcaccttctacctcgcccgttgtatttccttcaaatccactgtactgagccagtccggaatgttctcgtcttctacttcatcatcttcatttgaaccccttgctccccgtgcgaggtccaaacattatatctcggcatgaaacccgtccgagacaagtgaatctgaatagttcttactacataatactccctctggtttttgtacttagtgcatggacaacggataaaaccattattctgctttttagcctcggccactcttagaaaataatgcacgccgtcaataaactctttcgaccgtcagtccgcgcgcatccattgccgatccacgaaagtcaaaccaattaaacatcatacaatagttacatataattaatcgtacaatcattataaaataataacaaaaaatattcatgttttcataccacattaaagttttaaacaaatattgaatgtgtcagggttacggataaggtataccctctatccttggatatacgttgtatactgatacggtatacccgcgcgtata

SEQ ID NO: 19354 - DNA, 1592 bp, Oryza sativa
ctccacaccatcagcatcattgtagaactcttcctctgatgaatgattgcaaggtgagtatatgacatactcagcaagccacgcagcaaatatgcaagtgcacaggataacaaagaatggcataatagggtttcatttgcaaaagcagcatttagcaaacatttgagaatttaataaaacagttaagtattaattaaacaatattaatccaacgctatacaacataccctgttgtataggcccaaccattctgaacaaccaacccggctgcacagttctatctctaaaccaggaatataccattccaaaccaggagctaatcaaattattaccaattatagcaccatttaatatggtgaaaagtgtgagactaatcacgaaagacattgttagacccgcctataaccgcgggcacctattcgaatagttttactctgatcagaggtgtaccactgtacccacaagacacagccccacatcatgtcaccatgtgcctcaataccaccacggtacctcggaaaggagttgtgacaataccccttgcataacacaatccattacagcgcacctttcctggatcataatcacccccttataaacaaggcatggactccccagcgacccccgtggacttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcacaacccacaattatcaggttttagttggcacattaattaattaaccaatcacgattgaccatcgtgaactatcattaagccatcattaaataatagtgagtcataagttatcccaatagtgtgctaatgtttctaagcttgggtaagcaattatgtctaatatctagttgaaccagtaaatataaagctcaactagtcaagttttaataacccaaggtatcaaggaataaagtaatcaagaacaaaagggctatagcaaacaatagattaattccacccaatgacattcgaaaataaatgcattagttgaatagaaacaatagctttaaacgggatcaacatgctcaaagggttgtttgggatctgtgtgacttgccttgctggccttggaactcttcaaattcttcttctgcaaaaacggactctccggaaacgacggaatctaaacagaaagaagcaaaatcaccaaaacagcacataaacaagcatgaacagtacatgtggatatttttaacatgtagatctcaattttagaaaaacttagatacttgaaccaactaaatccgagctaagatgaattagttatgaatttttgaagattaaatcggattaaaacacttatattgattttaattgaattatgacgcaataatgaattatttttgaaaaggaaaaaaggatttattgcgtcagcggctagggtttcggtggaccgggcgcacggcggcggttcacacgaacggacggcagagatcgactcatccaaaacggacggccgagatcgatcggtcta

SEQ ID NO: 19355 - DNA, 1250 bp, Oryza sativa
cgctctccccacgccggacccacgcgctggcacactccggcgagctccggtcgccgtttcccgccgccacagccgtcgccgcgccgagccaccgccaccgccagcttcgccaccgcaaggggaagtccggccgcctcttatttccccctctccacccctcgagcaccactcccaccgcacacccgaggccgccgcccctttcaccgcctccagccgcgtcgcgccgccgcttcggtcgacgtcgactcgcgccgttgcctccctcagctccgcaaggacgaggaggacctcggccgccgcccctcttcgccggaaatccgccggagctcctccttcctcggtcgccggtgagctctacctcttgtcatcgccatcgggcttcgtttccagtcaccccgcatcggtcctcccctccctaactccctcttctcctcctgaaggtcaagggcgaccccgtccgccctccgtcctcgcaagccgccattgggcaatcgtcgtcgccgtcctcttcctccacgtcggccgccgcttccggtgaggatctctcctcccttccttttttcccgtcccctttcttgccgaccgccgcctcttggggtgcgtcgccgtccccgtgcgcgccgttgtcctccggccgcccgccgccgttccacgtcgccggctgctgcagccggttgccgcctcccccttgccgcctcccccttgccgccgccgcccgtcatgtatcgtccgagccggcttcatgccgtgcccgtgccccagccacgctgcctcgtggccgtccaatcggctttgggccgatccgggccgtcggttcccgtggaccggcggtggaccgcctcggtggtcccggtccacggtggaccggcgcccttgtgccgctgaccggtggggcccgcttgccggcgccgcccctcccctttgttgacgtcagcacttgtcatttcctttgagaaaataaataataattgcgcaataattcgtgaataattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaggtccgcggtcgcaaggaaaagagttcggaagatcaaagtgaagaagcaaggcaagtc

SEQ ID NO: 19356 - DNA, 720 bp, Oryza sativa
gatattacgttatagatgtttattgcatgaaagagtaatatgatctagttaattcgttgacagatatgtcgaacaaaccaatattccaagtttaccatggaccaggaaacgtccgttacgggccaactggggtagatctgtcagattttattgtatcagaaaggggaattgagagaccggctgagaggagtgtaccttctgtaaaaggatggttaatgaggggcttgaaagttgatccacagacaagtgacataacaatcaatgttatagtaagtcgggcaactgagggtttttattgggaactaatgccagttcaaaactctcaagtgtggagatggtatgtggaaaatgcaatgcaacgtgggtggcctctagctttggtttcgtttgtgcacccgaaggatccaggtgtgcagatgaacatggatgatggcgaggaaccaagcgctgaagtaaatgagacttctgtggaggaggtcaacacaggagtggacgggggcgtagtagctccagtgggcattcaaccaggtggagtggccgacgagggggagactgtcgcagccattgtggatgaaatggagagggaggattttgacaacgagcgtgtagaggaaggtgattcgtcagatgaggagacggatattaatccagcagaatgggctagtcaggatttttctgggctgatcgtctctgaagaggatagtgtgagatgggagtaca

SEQ ID NO: 19357 - DNA, 679 bp, Oryza sativa
ccttggcatttgcttttgttgagagtgagaataccgacagctggtactggttcctgaaattggttaaaacaaaagttgttggtatgaggccaaatgtgtgcctgatacatgataggcacgctggcattctgcgagcgatagaagagtttctgtttgggagcatggaacgaggataccctggtgtttgggacgatgtacagagtaggtggtgcatgcgtatatgggagctaatttcttcaagcaattcaagaacaaggagctcatgaacatgttcaagaggctgtgcaatcagaaccaggagaaaaaattcaatgagctttggaagagattagatgagttgacagccaaatgcagtaatcagcgtgcagcggctccatcgactgccgttgatgaccctcctcaagctcttggacctctcccaacagatagtccaactttggttagaagaactggattggagattcggaaattttctcagtggattctgcatgaaccaaaagagaaatgggccaaggtgtatgacaccggtggtgctagatatgtaataatgacaacaaatttggcaaaagtttacaactgggtgatgcgcgggtgtccgtggactgccactaattggcatagtggagttcattttacatgggacatgcacgtattttagggatcggttctaggcagttct

SEQ ID NO: 19358 - DNA, 2235 bp, Oryza sativa
tcatgcagaaaaagctagaggagttgcgtaaaaaggccatgaaacatcgagctctagtgcaaggtacccaacaacataggttcgagatactatgtcaagataaggcaggcaggggtatctaccgcaagagagtgaagcaggagtgtgttctcaaagccgacggcacatgtcattgctcttgttcaaagccgaagctgctccacaggccatgcacccatgtcattgctgccgcagcggagtgtggcataccagatgcagtatatgtgtcgcagtacttcagtaagcaagcaatatatcatacatggagcggcgagatttacgggttcggcatagctggggagttcacagagactaacgatgaagtactcaatattcctgacccatcgaagctccgaggcaaggctggaaggaggaggactcgtcgcatccgcaacaatatggacgagtcggaggctggcagggtgaagcgttgcagcaaatgcgattaacgtgggcacacctataagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacatggtgtagttcttatgttctatgttggcatgtgggtttgcttgtaatttgtttcgaacttatcgatgtgtttatgtttcgtcgtgtaatttcagacttcggcttgtcatgtctttagttctcgtgatgtaacgtcagactaaggcacatagtgtctttaggtatgctgatgtatgtcggacttcgacacgtaatgttatgttatgttatgttatattatcgaactctacatatatgttaaattgcacgtcatcgttatgtaccattactaacgtttgctttatttaaataagctgtactcttgttgtacgtaattattctcatgattttttgagtatttcattaatttgcgagtcatcttttgttttacattactactttttgaattgttctaacacgaaacactattttttcagagaaggcacgccaggatccaccccagctgttgaacccggcgatagatctccgacaccggtcttcaccttactgcggtgcaaggggcttcagcttggaacgttccgggcacgaacgtgcggtgagctactccgggttcacgactcctttgtcgagaggtacgaacaagtgttttactataagttaagtggccctgaaatattttttataatcacatataaatttgttattgcaggctacgtgaggccggcctcctaccaatgtgtcggctggtggagactgcggccggcgacgcggacccgcccagacgatggactgtggacaggtccctcctagcagctttggtcgatcgatggaggccagagacgcacacttttcacttgccgtgcggtgagatagcccctaccctacaggacgtatcgtacttgttggggctaccgctcgcgggagacgctgttgggccagtgaccatggctgtggactgacaggacgatctgacggcacgtttcgcactattacagcgcgcaccgcacctcccgctcgagccgttggcacaccaccgcaacaccggacctacgaagaggtggctgcttcaattcaccgtgagtgtttttgtaccgaaatgacaatcgtattacatatttagtccgcagttaaggtgcctaacattttatcgacggcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcatgaagacggatcccagcgcgacctttggtgggtgccctctctttctttctatctgggcagctgagaggattgcgatcggcccccctgaggtggaccagccacgcgtacgaggagtcactgtacgaggagcgaccagaggtcgactaccctacgatgggtactctgtggtgccgtcgtcaggtacgttgcatcgatcatatcgtattgttaagttaattgctaagttcattgtacatcacatcgatcgtctcg

SEQ ID NO: 19359 - DNA, 985 bp, Oryza sativa
accaccgtcccagctgctgttcaccggtaagatcttgcactacgctttccgttgttgcattaaaatccgcctgttcacaataatttgtaacatctgtcgtttcacactaatattacacattaattcgcaggtactcgcgcaagggtcagcagtcagctggcgactggccccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctatgccaggcaccgcgaccaggacttcgctcgtgctatgagtaccctgcatcgcaccattcctttatgttttcatgtctttctcttcgtcaaattttacgaatatttacgaacaaattaaccatgcaggtcgacgacatcaaccgggtcgtcgttgatggttcaacgacgatccaacatttagatgcagggattccggtacccgtagaggagcacctgacgacgtacacgtggatggtggagtcgatgcgctcgattcttcgagtgctcacctgtcgtgcagacgacgttgctcgggcagacgcagctgtacagcggccacccgaaccgactggtccccatccagctgcgcacgttcctaggccgagaccccctccgcacggaggtaagtatttttattactatttctgtacatgcctcgcacatataagtgagtcgtttcacttgccgattgcttcagggtttcgtgcaccgttcagcaccccgccttcctcggctaggccttctgttgtgccccccacaggtacttaaaaaaagaatattacttcgacaatcaatttacatgcattttatgtcttagcttacaagggtcccgttgtcgatgtgtaagtttcgccccgatcgctatg

SEQ ID NO: 19360 - DNA, 979 bp, Oryza sativa
ttttttaatgttctaggcccttctgttgggatggtcttatcacaagaagaagaaacttgatgccttgataggtaattccagtgcattagtaatcgtgttgtttaccggaaattgttatgtaatgaggcttttactgttcgatagctctgtttgtgctccaggcttttacctgacatataattactattggcatcaattagctgctactgaaatgcacctgtataactgactctggatgagagtgaaaaaaatctgatattctagttattaagacagaaatgatccatgaaaactgcattcagatattctatctagtaccctgtacatcatttctagttatgctgatgtgtagaactgtttttttccattgttctagtttgtttgtaaaagattcaaacctcatttgtctgttacttaggactgttttatgttgattttgtatctcatccaaacaagttgaacaacattatattgtactctcagctgttctgaatatcacttgcattctcatccacttggtaaattcttgatgcaaactagtacctttgacatactcactgttttgttttgtaggttgtggaaaatttcagtgcttcctggtgtggaccatgtcgtgtcattgcacctatttatgctgagatgtcaaagacttatcctcaactcatgttcttgacaatagatatgttgatgacctaatgataattgtaaccatttgtttggtcaaatctgctattgaaaaatgattagtttcagttttttatgaaccaagaaaccccttatgcatctgatggcgatgattttatcaatagtatcatttacctgtataactgactctgcatcctcagctctacaatttgcttgtatttgttcgatttcagctgatgtcaaatgattaatcatctacgaatttttggtttgtatgatgcctgcgcgctgctgtgctgcgtgctgctgtgctgctgtcattttgcttgtatga

SEQ ID NO: 19361 - DNA, 4408 bp, Oryza sativa
atatccttcgagctgttgaacactgtcgagtagttctggaactcgacctggtaggcgttaaccccttcgttatcgttgtctgccagcagcctgccccggagcaggcgccgtcggcgaggcgatcgccgcgtcgcccgcagttggtcgccacgcacccgctcaggaaacgcacgatgttatcggcggaatctccgaccccgacgacggccaccgcctgacacccgacgacggcgaacgtgttgccggcctgagagagcctgtacggatcagcgaagctcaccacatccatgatggtttgggaggtgtcgttgcagtaggaggagatgttgttccacacgcgggcctgaccatcggacagggacacgccggccagctcgaagtgtccgccgtgccccaagaatggcttcttgccgccattgttggtgtcgcggcaggtgagctcgaagccgggcaacgcgcagcctgcagggccgatgccgaacgggtaggggatatcgacgccgccgcacgccgtcgagcagttgctgctgccaggaggcggcggcggcgctccaacggcggcgagcagtgccgaatggcctatactaattagcaacaatattgctgctaatttctggagctgcatggctcaataactcgtcaattgtcggatgatccggcgtcttcctgaccgtttatatgcactggcgtttatacgcactggcgtggaaatgaccaaacggcttgatgatagtgtatgtgtgaaacaaactagcatgcgtgacttgaattttcaagtcttgccagggggtataagccttcaacgtagctttcagtggattttagtatctgcaggagccttcacagtttcgtactagtactcaattttcataggagaaagtccaaataaccccctaaattttggttgaaaatccatctagcaccttgaccaggttttatagatagctttctatctgatttacgtatacgttggatgagagttttattacgtgatatatgaattggacatatgcgttaaaatatccacctaaatctttagttttgactttttaacccttatttttttgttctcatttaatgtagacagatgttaatataatagtaaggtgacatcactatagaatatatattggcgacctattattgacgatgatgtgtaaacctgctatattcaaaaccactcatttagtttccaagatacccaaaactaccatccaaaacaatgctagagagtaatttgaacggtattacaaagttagtttagaggaggttagatgtctcatttcaatgtttaagatgctagatagacttatatcaagagtttagggggtacatggactattatgcatctttttcttgcctagaaaattagggtgtatacgcaacatttttatgatttcgtacgtttttctgacggtaattttctgtcatatgtaaaaactttgtgccaataattaatacaagcagattttcattcccttgtgaaaacttgaatacccctttttttaattgtcgtcagtgctttagatgggaacccaatttttttactgctactgctactttgaataaatgggagtaaacacaccgggaaaaaacatgtggcctggcgagacgcctggtcgatcggcacggccagctggctgttgccggaactagtcgtggagctgtgacagggagttgggagctgagctgtgtgatgaatggacgggtggtcgagtggaatggctcatggaaatcacttgggagagttcttgattcgcttcctcctcttgttgcttaggaaaagacattgaattgatcataatccttcgatctccagtactcttgcgccaagtggtttctaattaatttgtcgcttgatcgatcgcaatactgcagagcgatatatattttcatgaagtaaaaatcgattttcatgaatcgaggcctttgaccagttcgatatccgagaaaatatatatagtgcaaaccatatatgttgtggaaacaactatcgttggatcgaataataaacgtctaagattcatccacgtcatgagtaaatctatgagtaaaattttttactcgttatgacgtggacgaatctcagacgttcaatttttaattcaacggtagttttcaggttattactatagatacgttgtttccaccctatatcttccgtcgatatccgatccaatcttgataactacactagaaaggacaggcaagtgagctatagagtgggttgctgaaagttgcaagcaagcattccaacaagaggccagcccattccagtcgaaaaagctaaggggcggctagttgcgcgcgccctcctccgcgcgactggacatgtgtcgcgcgcggagaggtcggcggacggcgcgccgcgactgaggagcgatttttccctttttttggtttttttcgtttctcttccgttttttttggttttttcatttctcttccctttttttttgtttttttcgtttctcttccgtttttggttcccctttttttaagatgtacatattacaaagtttgtattcgtgttataccaagtttgtattcatacgtatacaaactttgtattcgtatttttttctctcgggttttaatatgtacatatacaaggtttgtatacatatatgcaaagtttatataagtttatatatacgtatgtaaagtttgtatacgcgtatgcaaagtttgtacacgtgtatataaagtttggatatgtgtatattttggatacatcgatttttggtacacataaaaattatatatacacgtatgtatatattttggatacatatatagaaactttatattattaatacaaaatttatacatatgtatacaataatacaaatttatatgtatgtatacaaagtatatacatgtacatatatatatatatatacatgtagtagtagcagtagtaaggcctgtttggcacagctccagctccagctccacccctcctagagctggagctcacccaaatagtttcagctccaccaaaattggaagtggagttaggtgaagctctctcacaaaatgtgctagagttgtggagctgggtttaggcagctccacaactccactccagactcaactccctggagttatatttaggagttggagctgtaccaaaacccgtagtgtatgagttatagtagtagtgtacgagtagtagtagtggatctgatggtcgcgtgcccgcgtgaccgcgcgactgatcgcgcattaggggcgccccattccagtattccactgcttggaccactccaggcactcccgtccactgggccagctcgaagtggactcaattgggacaggagaaagaaaaaagtctattttgtagtgcccgagttggaatttttctcagccggcctatacaatcggcatgtgggctgcaacactgtgctctgggcctctggaccgccgacgtgtcctcggtcctccgctcgagcggtacgaatgtacgattgggcttcaaaagccttcaagcaactcggtgtacggtaaaatttcaatgtgtaaaaaaaatatatgcattattatgtgcgtatataaaatttgtatacgtacgtattaaaaaaccaaaagaacgctacttatacaaagtttgtatatgtgctatatatataaatattagaaaacaaaaaaaggaaaaaagaaaaacctagaaaaaaaagaaaagcgagaaaaaaccgccacatgtcaccttaccacgcgccctcccgccgccagggtctcctcgcgcgccacatggctgtgccgcgcgtagggtggatagcgagtcagctcaactcgatctaaatcgttaagataattaacgagttggcttagctcgactcgttaagtagttattatcacgagctaaatacccagctcggctcgactcgttgcaaagctcgagcttgatcatttagctcgtgagccaatgcatcaaatactgacctaacaagaggaaaatagcttgcaaataaaaaactcaaatagtgtacattaagaaagaaggaaaaaaaagcagcaaatcacataaaattcgtgcagagccaaaccggctcaagctccgctacattgcttcataccacgccagaaaataggagtgctttacacaaatccagtctatgacaccctgcattaattccatttcattacatattacaacttttgtacccaagaaggagatgtgcccaagaaggagatgcacgggcgcgtggcggcaaagcggtggagatgtgggggcgcgcagtggtcgcgctctgcaatgcagctacggcgctacgctagggcggcagagggatgaagagagtggagacagaggcacgatcggatggggtgactagggttttgatctgaatgatgctctattgggctcggtcttccaaaaatatagccctacgtgctatgtgactgt

SEQ ID NO: 19362 - DNA, 11340 bp, Oryza sativa
cctacgtgctatgtgactgtgggcctgtgacctgctaaggtagggttagtctagcttgttaaggctagtagctcgcgagctagctcgagttggctcattatatataacaagttaaaatgtcagctcggttcgtcagaaaaatgaaacgagtcgatccaagctaagtccatcttgtcgcgagtcgaacgagctaacgagcgacgagtttcctgtccacgcggaagaaggacgcgcagccaactgctaattagcggtttcggcgtcacagtgtcggtgggcactaatcttcaattgtcaaaacatttcccatattgcctatccaacaagggactgttgtgctagaattcttttcaatcatttcgagtcccttaattgtactctcaagcatgtactatgcttctaagtttaataaattcctggttctcaaaaaaaaaaaaaaaaaacggtttcggcgtcacagtgttggtgggcactattgcgcgtcaacctggcccggcgcgcgtggacggtcattcccgtgtcaagtcaagtcgtcgcccgctagaggcttttcttgagacgcagacagagtacgcggcaggcacctctcgaagccatcaattatttctcggcaaagcaaatcagaacgtgggtggaacaacgagctgtgaaggccaccccatcaagctacctacctcgggttattttaagcagaaaggtaagaaagccaatcacacctaaacaagaagcgtatgttagctcgtcgaaacttgtatagcctcgatcagattgcatccacgactggtgcggcaacttgtttggctccacacgatatacaagactgatgagtgatgaacatggagataaagaattctctttcaactatataacttttttttaaaaaaaatcaatgtcaataagtacatcgactggtattaaaaataataattagccaaaaaatgagcagacacggaaaggcatgtcccatcataaataacactagtacataaacaatttttccagacggcctaaacaaattttcgcgtgcgggccctgacccatctgcacccaggtatgtgcaaaaatcgtcatttttccatgtgggtgcgggcgcttaagtcacccgtctgtgaaaaaacaaaaaaaaaaccaaaccctaccctgaaaccctagatttgccaccatctagtgcgcaaccgccactcgaaaccctagaaaccgctgcctccacctaggccgtctcgtcattgtcgtatcgaggtcatcgtcgtcgcgggggagggcagccgcctctggatccgcgcatggggggactgccgtcctcagatccacgtggcgggagggccgccgatgggtgcctcctccactgttctccccgtggggaactgccgccgcctccgttgcacacctcctatgccctcccccaccgccgttgctagagctcgcgcctgtcgcacgagccatccacccccgttgggatggagtgggggagaagaggaggaggccaggagggccgagagaggagtggaggagaagagagtgggaagaggaggacttagtaggagagagcaaggaggggagaataaaagaaaacgagtgggtcttttttcacatgcagattacttaagagaaccacatgtgaaaataggcttatttttgcatgcggtcctcttaagaagcgtatgcgaaaatgggggggtcgatttttgcagatgcgggcatttatggtatgcctgcaacctattgggatgctcgtcctagaaaacatttgtgtagtagtgtaaccaaaccaattaaattgtgctcactttggaactgtataaataccatcactagttattttattacaactatgtttatctttaattctaaagcgcacctaaatgctactatgctattttacagattcagttcatcactaggaagaaaactcaatctaacacacacctacaaaccacgcgcgggaatcaatacaacaaactgtctatagatcatcttgcaaattctatgctcaacacagctttcttctcaaggctataaactccactggttgtgcttcccatctccacaaagctcaaatcctcaagtacaagcggcggttgtgggcattgttgcacttcatcagctagtgctaggcgccggagctccgctgccaccagcaccattgtcggccttgtcatacctggaacaaccaagcattgacttgctagaacagctgcctgatgcatcactctcatactagcttcatcaaccatgtcactatcaaggagctcaaagagtgtgccctctgccattgcctcctgaaacatcaaggtgaggctcttcctatcttttgacagcggcttcttactagttagaagctcaagaagaataactccgaaactatatacatcattcttagatgtgagttggtactctagtaggtagtctggatcaatataccctggtgttcctttgggtacagcttgagtattctcatcgattgtcgagcagccaaagtcagacacctttgcgatcaatccctcagcaagtaggatattggatggtttcacatcgccgtggattatagggtgtggcaacgagtgaagatgcgcaagtgcctcggcagattctgcagcgatcctcatgcgggttccaagagttacatggaacctcttgctcctatggagatctagtaactcttgtagtgttttgttctgcacgaactcgtacacaagcatgggcgcctcaaactggaggcaacatccaagtagcttgacaatgttgggatgcctgacacggcaaagtatgaccaactcctgcacaaattccatctttctgctctcgtcgatctccttgcacttttttattgcaacattaactccgttcaaggccgccctataaacagttccctggccaccttcaccgatgatgtgttccttgttgaagttacttgtggcagtctcaatctcccctctctcatagagggtgaatccaacattaccctctactttcatcatttccagaagtagctggccaccatgctgtagaaaaaattcatgagtctgtcttaatagtgcttgtttttttatgctccttttgtggcgtatcacttcccatccaaggaaactaaagaggccaactaatacgcagataaccgctcctggataaacaaatatctgacattagtggaaatatttgagcatgtgtaggttttaacatggatgtcgaccagatatgcagcagtaaaacatagtcttaaaaaaaagagattgtaaaacatgtgcctaccaattgccagtcgtgcttttagcggcaagcggaagtcttttcggcatccatctggaatggtagcatttcctttgctgcccgctggacagttacaatcaaaaccgccaggtttattacggcattctccatagcaatgatgagtcttggaatcttgacattcatcaatatctacaaaataaaaatgacgaatttgtaagatgtggggaaaagaatttggtaatctggaaaatggaaacgtgggagaatttcaaatatgaaatgggattaatggaaaaaagtcagaatcataaacagactatgtattggaaattttataaatggaccaactaaacttatttcttaaaaatatagccggatggagtaagaaaacaaaatcatgaaagctacacgctgaaagctatttcatatgaactgtcacaattttagaattctagatgtagtattgatgggattataggaaaattcacctcgacagccgttgggtccttcgaggtaaggattgccttcgtaccctttggagcagttgcaggtgtagccaggtccgttggttgagttgaagcactcgctgttggtacttttgcacgcgtaagagtccatcttcttccatgcctcctcacaactgttggcgctccggatggcccaatcgagcaccataggcgcccggccatcataggtgttgttgaattccgatgtagtcaagtaggtggtcgagaaggtgaagttggaggagtccattagcaccgcgtagctgcagggggtgcggttgtagatccccgacgtgttcatgctgctgtcgtcgaagaaggcctggtagtaatccaggccctttgggatggccgtctggcagcagcctatcccggagcaggtgccgtttgtcgccttccacacatcacctcgccggcacacggacacgcacccgctcatgtacttccccacgtaatcctggtcggcgatgtaggcttgtgtccggcagccgacgaccgtgaacttgttggagtcggagagcatgaacggcgtgccagtcatgttgagctgccacgtgtcggagtccatctccttagaagataagttgtagcaggaagaggagatgtgattcatcacccggacctggccaagctggagggagacgctgagcacctccacatttccgtagaagggcttgtagacgccgttgccggtgtcgttgcagtcgaattcgaaggcggacgcggcgcacttgtccaagctggtgctgaatgggtaagggatctcaacgtcgccacacttggtgttctggcattgcccctctgctctcccagcgaggagctctgcagcaatcgctatggcgaggcacagcgttgttgttgttagtcctctgtggctagtcatggtggatggatgaactagctagtcctagctatctgtttgtgtcttaaacctctgtttcttgataggtgattatggacttgtgcttgtatatgaagatgagtagagccagcgttgagaatttgagatgaatccaacatggacactagacaaactttcttttaaatataagaaaaagacccaacgacttgaacaagtcttcgcttactgtatctttagtgttaattttagagtaaattttagtctggaccactttctttgccctagcttagcttgctttctggcacatgttccaaattggttaattatctactagtttatgcgggagtgtttgaagaaaactaatttgaggtagagctgctaagattttacaacgacgatcaaattatctaaaaatccaccagcacatactccttgtaattaagttatccatataaatttagaacaggtaatatagatgcacttttaactggcaaaagctaacacatggatcacagatcatcgatgcctgaatgcacactgaccatttccaacaaagacgatgatccaaagactttgccggtcaaagtcaccgttgcatctcatcttcgatcgtgactacgacgtgagacctctccacgaccacgaggctggaagtgaatatttctttcgatgtcatcacacatggctgcccatcagatcagattccatgtccacgtcgcttgcccggttaccacacaaatattgacttttgtaatgccaactttttatgtaagtacgtatgtagcgaactaactaaatacaacaaccacctccgtttctaaatatttaataccgttgactttttaaaatatatttgaccattcgtcttattaaaaagttaattattaattctttttgtatcatttagttcatcgttaaatatacttatatgcatacatatagttttacatatttcataaaagtttttgaataagacgaacgatcaaacatgtactaaaaattgacgatgtcaaatatttaaatatttagaaacggagagagtacttcacaatcatttattttaactgggagtccaccgtgcttaggtgatcttgaatacgcttcatcagctcatgtgtggccgagggactaggccccggagcaggcctagctcacgggcggcgagccggccggcaacgtcctaggctctcgcggttgtggtagttgccgccactatacactctagtccctcgccatgtctgacctcgcggcggcattgctggaacttggaaagcgctagcttgctgttgtggaattgccggtgaagggtgtggtgcaccgcggcagtggacaggtaaacaggtttgccatatcaacgccaaggtcgtgtcaactgtcaaatgcaaacatcagggggctcaattgtcttagatgcatttcctgttgagatcgatgccattaatagttttcgtctgtaattttgtacggtgtgtccaaacggacaaaattgtgggcaaatttcggttttctttatgcttggggcttggctcaatcctttgcagtctttttatgtggacggcaaattggagtgactatggctctgttcgtttcttctacaagcggaggataaaattttagatactcatgatacattttttaaacggctaaacggtacttttcgtatataaactttctatatgaaagttgctctaaaatatcatattaatctatttcttaagtttgtagtaattaaaactcaattaatcacacatcacatcgttttacgtgatccacttaatatttacctttattttcatcttcacgaaatttaaacaccacctatattcactctacatagtattctttaagccattgacacatcaaacagagatccgctgcaatagcattcaaaagtctggcagcactgagcgtgtatttttcagaatgtttcccgacaccagcagattctaaataattcgatttggtacgattcactttctgaaaaatggctggattgtttccgtagctcgaccgttttttttccttgtaccagtgaaaccccacgtgatgctgtatgagaatttattatgataataataaataaaaagatatgtaagatagctagacaatataatttgatgtggtttatgatcatttaaatttatcaaagttaaattatgagagaagaaatggggaagataatttagatcatatattagggagcgtatcctatacacacaggcccttgcgtgtacacaccgtgtagatcaactaaaaattatcacaaaaaattctagaaaaaatcatacatttacttccaatagtatttcatctacgtgcaaagtcgcatcttcaatttcattctacatagagagtaagaaaaaagacaaaattctaacagaattataaccttaaaattatcagatttttttttgttacggctaaaaattataatgaatttgaggttaagattttatgcctgggtgtaatactattgaaataacatgtatgactttttctagattttttggtgatatttgttagttggtgtgcacgtgtgtacacgtgagagcttgtgtgcataggatatgtttcccatatattaatcattaagggctaaaaacaattgaggtgaagaaaatgagggagataatttgtaccataaattagtcatctagggactgaaaaaattatgtgatatggcttagagagaggagagaaatagtagtattaactgagtgatgatgaactaaataggtatatcggatattataaaaaataatagagagttatattgaaatattatgtgaattatatgccatgatgatttaacatgcaagcattttaaagctctaaaatttaataaattataaaattatagataatataacattacttgtatgatgtttaattgtagtaattgttaatgaatgatgatgttatatctttacattttgaggttttgaatttggtgagttgtacctgctagattatgtgtcgaatatactagtcctgtttggttacagttagacttggagttgtaataggtggcgcgggggtgaaattagagtcgaactctgtaacctggcaactctcttaaatagagagcaaggcactacaatataagcatggcaactaaaatatagcatagtcacgcaggaagaggatggcggtgagaccatttactcgtaacggctaagtactatattggttgggacgagcgtacataataagagctcgggagatgtaggattcgactgaacttcgttaacaaataatatcgtgtgttcctgtatcattatctggcatgtcttagatggtcaataattggaaggttagtcgtcgttccgctatatcgtgatgtattgtagtcgcctcttgtatagtgtgtaggtgactgtatcaaggtcatcgtcaggtatggtttgagtgttctgttgtgctttacctcccgtggcattatacgctgcccttgtaccactttgttccctcttagtgatccatctagaaattttttagagcccaggaaattctaatggtaacacacatgttcatactactttatgagtcatttgtcattatgcaacaaatttttttaaacataatgcaacaaaagttaacactattgaattgtgatttgtgagaaaaaaaacatttcaagatataacttagttgggcagtaagcactcatacattccttactgatttgccatgtaacctagctagggtaatcactggtttgtctcataatttagctggggcaatcactcgttcgtttggcagagcccgagcactggcccatgatgtccaggccttggctcggccactgcaatccccctatctctaacttgggaagcacgtgtatgttccactgaaaggaaaaagtacaccgaaggtccctcaacttatcatcgagtcataaaattgtcccccaaccacaaaaccagatatctgacgtctcttaacaatcaaaaccggtcacaatagatccttcggtgattttgactcgggttttgttctacgtgacggctgagtcagcgtgagacccgtatgtcagcctcttattccttcctctctcctgccctttccacgagcgacaggcgtgcacgggaggaggctgggcaggcagctgggtggcgtccccagggggggggggggggggccgccactggcgagcaaggggaagtggctagcttgggtgccttgctgcccgatgatgggttgtgatgctcttcacgaggaggctgaagaactcctgcaagagctgctgcgtcgggaggaggcaccttgagccgcggagatgccacgcgccctgctgcagctgccacgtcgacgccgcgcccgccggtgccgacggctggtggtgaaggtggtggtggttgtgctgctgctactgctgcatcagcagcgacgtcgccgcctccggcctgtggagcgagagggacagccgccgtcgccgagcgcgcccacacccttactctgctcgtgcgcgttctccgccgtcgtcggcatgagccccctaccatctttggccgccgcggagctccgccgtgcttctcaaaggagcgtgtcgctccgccatcttggcagcttcctcttcctcaccatggcagcagcaactgctactgccgcttcgacgtcactgccgccacctccggttgctcggatgacgacgacaccggcgaggaataaatagcaggacagggtcttggattatggagaaattttcggtttttttccacccacaccacaagcactgccacaaaggtccaagagcccaaattcgacttcctgctatttggtaagctaccagttattgcaaaatgttgctctccattgatttgtgccctcgctttcatcccctttttctcactaaatgtgaaaggtccctgatcctgttcttgcgtggggaaccctgcagaccgatgacaccctgtacccactgagctcggggtctcgcgtctcatgtcaagaagaataatggaggtaagatttcgcacgccgcctctccataacatcttcttgtcttcgatctgtccaggtggatcgtgtgtaaagaaaacaattttgtttgaccttcgtccatagacatattgaaggatctgctcatcttcacgcgcgaccgccgacggccacccttgggtctgtctagtcacagacgttgccctccgggcctgcgctgctgctggaaagcccgctgaagtgtaccgtcgacagcaacacgtctacatcatcgacgccgacgccgccacgcccacacccttactcccctggtgcgcgtgcgccgccgtcgctggcatgagcccccctcacccatctttggctgccgcagagctccgccgtgcttccccactgcggccgcagtcccggcgtcgcccttctctcccgcctcgcccaggcgggctcctccctagccaccggctgagagaagagaagagtgagagagaggaggaagggagagagatgacgtggcatcctgacatgtggggctcacgtgggtctcacgctgactcggccaccgcgtaggataaaactggggtcaaaaccaccaaaggatcattgcgatcggttttgattaattaagagacactagatatctggttttatagttgggggacgacgttgttactcgatgacaagttgagggaccttgcgtgcactttttccccactgaaggtaccggagaaaattcttgtattccaaggcctaaaccgtgttagaatcacaggccttttaacaaccggaggatagcccattccgctgttttggtcacctcccgcacagatcatggtggattcaactttcacttcttcactaagtagccggctacgctactgtggcattgctcgcaggctgtgtagggttgttcagtttggtaccactttccaccttagcagtttttcgtattacgaaaacattgtaagctaacaaactaaatattttattgccattgataccttaccaaaatttggtatttctagaaactcatacaaacaatccaagaattggtttgacaacaaattaaacacatccaatgctaccaaaaatttgttaacgtcaaaatatgccaactttttgacgaagctaaattttagtaaggttgattttgacaccaaactaaacaagcccatatagcccgtggggccgcttcgcatgtgggcagctataccatctagctagtcgtgcactcatactgcttccagtcagttagcgtaagggtagcaggcgacgacatcctcgaattgccactactacaaaataggtatcacctctgttggttcatttaaaacctatacttattagctattaacatttaattctcaccttatcaagataaaaaaaataaaactgacatgtttgagcaacaaggtgccggttagataaaaattggcacggttcttataaatcgaacagctacaaaaagaaaagaaaaatctgaggagccgagccgagcaaaaaccttatcgaagaggtggagggtggccttgggctgtgtccacggatagcaatggtggcctgtcccgagtgaccccgaccccggcgacggccagaagatctcctcgacaactggctcaggggggcagcctgatccggcctccacctgctcgtggaggcgtatagacgccaatggcatggacgaaggagtccgcgcagccgaagaagccgacgatgctgccgttgccgcgcatcgggatctggaaaggacttcctccgcctcgtccgaatggaccgcgcctacgggcgttggtgatcagcgtgaggggc

SEQ ID NO: 19363 - DNA, 5990 bp, Oryza sativa
agttcccaaacatatatatttcgggtattatagtactgcttgcggcaacatcttctccaaaaatgagtaataagtgattttctttatcttcccattaatcaggtctctttcccttatttgccgattttttaattaataataaataatattctttacattaaattattagtaattagaggataacatttaccaaagtaaggtggacgttactagaaacaagcgtcaagatgtgtgcgctattacaattaacgtacaaatgtggacaccaattggatcgacgtccaggttggtgcggtcataacctggtgctgttcgttgtgattcggaaaaaagaaaaaagaaaaatcccccaacactaggtcatcttcggacaaatccttggaagcaggctgaagttctctcttaccgttaaaaatattcttctttcttctaaatgcgtgacgtagcgggagccacctccgatgacccatgtataccatctttcgtgatttcttcagccaccggcttcgtgtatgttccttgcagtcgaagatgccttttttccttttatagtttgttcggaaagattaccgagtgcagggtaatcattaatggtgcagaacaatagaactcttagcttgaagttctcctgaccatatgcatcccaagttttcacaccttctttctaaagaatctcaagatcattgataacaggctccgggaatacatcgatatctttgccgggttgccttggaccttggattaacaagcacaacataatatatttccgtttaaagcacaaccatggcgggaggttatacttcgcaataagaactagccaagtgctgtgagtactactcatgtaaccgaaatgattcatgccatccgtacacagacatatccaaatgtttctagggtcggcagctaagtccttgtgttttccatcgatattcctccattcaatcgaatccgctaggtgtctaagcataccgtcattccttctctccgtggcgtgccaacgtactaacttcgcttcgttggggttggcagagattctcttgaaatgatcaatgatagttagataccgcacaacctttgccggaccaccactctttgacttctttgcttcgtcagcactttctcttcgcttgtatcgagaagccttgcagataggacaagcatctaagtccgcatattgcttgtggtacaatatgcagtcgtttggacaagcgttaattctacggacctctaaccccagtggacatagaatctgctttacttcgtatgtcgtcttgggcaatgtgttctcaacaagaagcatagtcttcaaaattcctaaaagatctatgaaactcttgtctgtccatccactacttgccttcaacttcattaggttcaaggtcgctgacaactttgtgtgttttgctttgcatccggcgtacagaagcgtctcggaatcactgaccaacctgctaaacttcatgaaatctctctcattctgggctgggtcttcaacgtcacgtaacatgtcttgtagcagatcgtgatccacatttcaccgcccaatggagaaggtataaacatgtcatgctcatcttcatcttcctgattatgcgcaccacttctgtctgttgctgcaccacttcctgattcttgctctccatgcttcacccaacatgtatagtccttcatgaatcctcgttgtatcagatgatcgtgtacaacctcttcgctatcaaacatattctcattcttgcaatctgcacatggacaacgcatgtaatcattgtttcttcttttcctatcctcctctgcggcgttcataaattttattacgccatttctgtactccggaaaatgacgtttcacagttgtcgcatacatccaacttcgatccattgctacaaaataaaaaaataaattagagggccatattataatatcagtattgctaaagtaagttatgatgaaattgctgaattcatcattagtattactcacttgagtgctccattttgatcacttttggtaatgttctgttttccttggaaaaaagacaaaaaatcgccctctatagcctcccaccaaaatagtgaacagtagtatacaattacactaggtggtggggggtatttatactgtgcaacaaatatttgtaagggccctaaaacaattaaccgtgacgggcatagaagtaatctctatctggccttaataaaagcccgtcaaataagagagtcatctgtgacgggcattaaacttatctcaatcggccctctagttgaagcccgtcacagatgacggtcatctgtgatgggcttcctttagggcccgattaagatattgaaccatcatctcaatcgggcctcaactatggcccgtcacacataagtgtcattcgtgacgggctctagttttatgccgatctagctgtctgtgtgcccgattgagattacttctttgtgacggcccacaaatttcaggcatgttaggggccgtcacagatgaaagaatctgtactagtataaaaatgttaatgaacaataatcattttatttcctggctgtgtcttccaaacgaactcaccaattaacaaaggcaggttatatgtctactagttgaataataatctatacatatatatatatatatatattcaataaaacactcatgtcatatatcaagtaggtatgaacaatgtattacatatcaattaatgctaattagatgagtgtgagcagagacatgctataagtgaaaagacatgcatgcgtgatataaattgcagggcaaacctgttgcctcacgacgagagatgccaatgcacacggtgccgtggccggattgcaggattggtggcgccgtaaaacacagacaaatcgaaggcaccggcgtcgacggcgagagtggcttggacgtacgacgaagcggatggatcaaagtcgtagagagggcaaactcgtatacgatttacgacggtgtgtggccggctgccggcatgcgcgatcagcgctcatcgcgacagttaggttttcttttcattgtcagggttttcttttgattgttctcgctctattcgtggcttggctgcaccagggaggtggacgctgtttccaacaccgtccaagtatggacgttgtttaaaacggcatccagtagttctagacgttttctgtagtgacgtccatcctactcctgtaaatcccccctacgatttactaattgtttaatttaagggtaattatttattataaataaaaaattcagccttatttgccccgataaaattcacttttgcacttatattatgcatcatcaaattttatgttttattgaccttttccagtaggcttatttaacacatataccgttagtagatgggtgaaaagtcatttttgtccttgagtatcatttttgcacgtgatttgctgtctatttctcccaatcacatagcgagcacgccgtgtggctttccatgccctggtcagctgcaagtatcgtgcaagtatcctgctttggcgcgatccgtcgcaacaccgctttggcccggtgcgcactgtcagtgtgtcaccttcatgcgtcagaacttgctgtgcaggacttttttcttttttaatgattgtcgtgattaatattttgtaacgaataattggttttgtaaatgatttatttgatgaaattggtttgagaatatgcgtggatgttggtgtgagtgcgtataacttgttgacgtcaccaccacaccgaggcaactcaccagaactccagattcaaccgatggtgccacctccacagccaccatttgaaccgcggtgatgggagaaagaagaacccgtcaccaccgtccttgcgcccatgggaacttcggcgacattctcgggtgaaagaaacataaagcaggagccaagaagtcaaagagttgatgcggcaattaccactactagttgtttcattacatttctgccaaaccatcagtagttctacagtacactaaatgatttattgtgtttacaggttcttatattctcattcctcacaacaaatacatccaaaatagagaacaacactcaatataagaaccctacaaaaaattgacacaacgaagacaatcaagatagatctactgatcatctagcgaatgttgtgcttaacacggccttattatcaaggctgtagatcccactggtgcttcccgtatccagaaagctcaactcctcaagcaccagtggtggctgcgggtatcgctgcaattcatctgctagcgcaagccgccagagctcctccaccactaaagccattgacggtctcgttgtacctggaacaaccaaacactgacttgccagcactgcaactcgatggattactctcatgctagcttcatcgactatgtcactgtcaaggaggtcctggagtgtgccatttaccatagcctcctgaaacatcaaggtcaagctcttcctttcttttgagaatggcttcttaccagttaaaagctcaagaagaataacaccgaagctatatacgtcattcttggctgtgagttgatactcgagtaggtagtctggatcaatataccctggcgtgccttttggcacagccggagtactctcatcaattgttgagcagccaaagtccgacacctttgcgaccaatccctcagccagtaggatgttggccggcttcacatcaccatggagtatagggtgcgacaatgagtgcagatgcgcaaatgccccggcagattccgcagcaattcttaggcgggttcctagtgtgacatggaacctcgtgctcctttggagatccaacaactctttcagtgttttgttttgcacaaactcgtacacaagcatgggtgcctcaaactgcaggcaacaaccgagcaacttgacaatgttgggatggttgacacggcaaagtatgaccagttcctgcacaaattccatcttcctgttctcgtcaatctccttgcacattttaattgcgacggcgattccacccaataccgccctataaacagttccctgccctccttccccaatgatgttcgctttgttgaagttatttgtggcagtctcaatctcttgtctaccgtagagtgtaaaccctgcattgccctctactttcatcatttctagcaatagctgtcctccgtgctgttgaaaaaactcatcgttttgtcttaataaagcttgtctttttatgctccttttgtgccgtatcacttcccatccaaggaaaccgaagaggatagataatatgcaggcaacaacaccttgagagataatgttttttcattagtgaaaaggtttatcaaggtactatttcaacatctgtgtgtctatacctgatcgagcatatcataatatgaggcaacacggtattggagtaagtacgtaccaattgcaactcgtgcctttcgcgttaagaagtttttttggcaccctcctgaatagtggcatttcctcgtgtaccatcacgacagaaacaatcaaatccgccgtctttattgtggcattctccatagcacgggtaactctcaggatgttcacattcattaatatctgcaatcaaatataaaccttttatagaaatatttataacgtgatgatatgcaccccgcaaaaaaaaaagtgatgatatgcacacaaattaaaggacaaagctacatggaaaaaaaagttggtttataaaaggcatgctaactataggaaattatacttggcgactatgcatgccgagacgacatgactttcatggagttcattttaatttttttatggtattaacagcactctgtactttaaaaataacaagaagcagcagcaacgcgcattcacatagttgagaggctaaagtacatagaaacacattggatccgaggtagagatggcaacagggaattcaccgtcggggaatgcatcgccatccctgcgataaaacaacggggaaactttgttcccatccccacccggcacaggaaataaatccccgcagaatattcgtccccg

SEQ ID NO: 19364 - DNA, 252 bp, Oryza sativa
taacttaccaatcgtgggtcctgtgtctttgaactaatcccatcgctcaatgcctgattgcgaggagcgagggaagagggcgcggcggcagggcaacaccgattttcgctcaccgcgacctccagcactgccgccgggagcatcgcctcagcttctcgctcgccgtcggccgcctccaacgctgatttccgccaccgggacctccaacaccgatttacgccgccgtgagatccgcccgtggccatgccgagg

SEQ ID NO: 19365 - DNA, 810 bp, Oryza sativa
  unsure (1)..(810): unsure at all n locations
nnnnnnnnnnnnnnnnnnnnnnnnnnnnnnnnnnnnnnnnnnnnnnnnnnnnnnnnnnnnnnnnnnnattaccacctctaggatgatgccacgacataaatcttactccctctgtttttatctataagcatttgtacgtcatttaggagaattaaggttcacgaaaaaattatagatttatagcgtgtcattaagtgtgagttgatcgaaaatgggagaattaatgcttggtgtaagataaggaacaatttgaatactcatatagtatttgggacaagagggagagagagtagaccggaagggatagagattcgaatggaacacggactcccaatggaacacgcagtaacctatctcaaaagaggcaaaataatctcattacagccgtacgtgtacaggtgagttgtacgagtcgccagtaccagcttgcgaactgatggattaattcatgggaaacaaaagggccgcggggcgatgcatgcacgacgtacaaaacgcatcgctagcatggtacaaactccacttgttgctatggcgctatggcttgcatgcagtaatattctgttgccacttggagaatagattcgagcacacacggccttatccggtatgtcgttgaaactcgaaagcaacgtaacctggcccgtgattactggctctcgtgtcgtccaggtcaaatgacggtggtcgatcgggcgtccatagtctatgcagctatgctgactacctacttataattagctggtacgtatctactccctccgtcccataatataagagattttgatttttggttatactggttgacca

SEQ ID NO: 19366 - DNA, 880 bp, Oryza sativa
  unsure (1)..(880): unsure at all n locations
nnnnnnnnnnnnnnnnnnnnnnnnnnnnnnnnnnnnnnnnnnnnnnnnnnnnnnnnntctcttatattatgggacggagggagtaactgtattatatatggcttttacctatactttcgaaatgtgcacgtcgatcggttggtaatctttatgttattggatctcgtcttctgaatgaggtcactctgcgttcgcaaaaatgaatgaggtcactctgtcgtcgatgaattcaagtaatcttccgtgtatggattcacggatccggcgaatccgggccatccgagcatctctcgatgtgatttgggatcgatgggaatcaccactggcggcagtaggggcccgtgcctccctctctcactcgtgttcttgatcttttcctaggacaaactttgcctgaacgaacggaccagaaaaaacggaactgatgaatgagagcctgacttcgattgatcgggtaggtcgggacttgtgccattagctagcatactactgtagttgctaataaagcttatttggtttgaagcccaatttatatcatatcaaaatgtcggtagtgttaaaaaagctagagaagtattgatactatcaaatttattagagtacaatttataaatttgatatcaaatcaaacatccataaaatatattagtaatgaagttatcaaagaattggttaggcatagattggcctcaatcaaacaagcccatagatctctctgtaccttgtctcatgagagacagggaagactagttaaatggagtactccctatgtgctataatataagaaaatttgagttattacttgcatcatttgaccactcgtcttattaaaaaaaagtggaagtattactttattttttatgacttactttattatcca

SEQ ID NO: 19367 - DNA, 753 bp, Oryza sativa
  unsure (1)..(753): unsure at all n locations
nnnnnnnnnnnnnnnnnnnnnnnnnnnnnnnnnnnnnnnnnnnnnnnnnnnnnnnnnnnnnnagccctatttagattggactaaaactttcaagttactatcatatcggatatttggacactaactataaatattaaacgtagactattaataaaacccatccataatcttggactaattcgagcgacgaatctattgagtctaattaatccataattagcctatatgatgctacagtaaacattctctaattatagattaattaggcttaaaaaatttgtctcacgaattagctttcatttatgtaattagttttgtaggtagtctatatctaatactctaaattagtgtctaaatatatggactaaagctaagttcatggatccaaacaccacctgagcaacgcctttttggctgggttccatctggctggctgcagatgttcgggatggagtccgtagcttcaagaacatcgcacacagatcatgtgttctgcagattaaaaatggggcatatggtttttctggtggtgtgacttgtgaggataggaacattttgggggggctaagtcggagtgtgcgacaatgtggatactgttgtctgctactgctcacgaggtcagattaatattgtgctttctggtgtcaataatggagttctctatgtcgaatatggcggcgtggccttacctgaccaaagacaccttgctctcatgactcatgttaacgtatagagccttgctctgactttgcc

SEQ ID NO: 19368 - DNA, 894 bp, Oryza sativa
  unsure (1)..(894): unsure at all n locations
nnnnnnnnnnnnnnnnnnnnnnnnnnnnnnnnnnnnnnnnnnnnnnnnnnnnnnnnnnnnnnnnnnntagtgcagtgcatgcacacgtcgtccagagaggcgcgtcccgtgacagcgcccttccccccgcgcgcgccgcgcgcacagcgcgtcgtacgcgcatcatctctccctcccgtacgttacgtggcgaaacacctcgaaacacatgcactcctcgaacccatcgaacgcgcgaggcacagcacgtcgcgcgcgcacgctactctcttccctctcttccccgcggccgtgatcgccttggtcccccacgcgtggcgtacgtacgtacgtcggcggcgcgcaggtcgatcggcatggccaccaccccaccgatcgagtcgcgcactcgtgtactccgtactacgcatggtcgcctatcatttccgtctcaaaagtttcacatgcgtgtgcaataatccgtgaacaaaaagatgcactgaatgggggtgaaaatggccacggaaattcctgatcgatcgagcactgtttctatataaggagtatcgtttccgaccatactatttttgactatttttaaatgttgttttttcacaattctttctacatcgtattaatgtggtcaattactgaccgatcgaagatcgttttcgaagaaatgctaccgattcgatcgtttccgaccggttttcaccccctttctgaatctgatgggaggcactatcgatggagcgagcaaacacgcacgtgtactgtagttacatgcactcagatcgagctctctttggatggggaaataaggagcaggggtaggtccggttggtggtgtgtccatcgcaccagtagcgcccgatgtgatcactccgcgaagagaggagtcgtagagatcggata

SEQ ID NO: 19369 - DNA, 4692 bp, Oryza sativa
  unsure (1)..(4692): unsure at all n locations
ataaggcacaactacttcttaaagttgtttcataatataagagcaggtacaatagcagactattagccagctgcaaatatattttaatgagataaaacatgagagagaagagcagcgggctacagatctgtagccagctgcagcacggactctaagacgcaatgtgtgtatgccatatgggaccatatattaatagtatagtaagcaactattgtatgaattggcttttagattggctatatatggattggagccagtagtgggctatactattaaacttgctctaaggcatgcatgtcattagctagcacctcttttttactaaaatattattatttaaatcctacaccataagatctctaattttattgggtgcatgctttctatttattaaggtaacccaatctatgagatgataataattatttcttggtctttgggttaagagtggttgtgccttatattttagaatggagggagtaggtcttagacttttggaacaagggagtattatattagggattacatcgagatgctgatcaaagccaagagtgttttgatttttgaagcgtaaaaatgttatttactctgttcttcttctctttttttcttctttttttgcatcaatgaagggcaaatgtatagctcgaagtgatactcaggacgataacactgacccgagcaatagcgatagccatggcctgaacgacctgcctgccaaggttcgccgctaatctcttcatcccaagcaaaagcttactaaatcgattctagaagtaatcctgtcacgacctttttttttttttttttttttttttttgcatagcagctgcccttgcaggatttgggacgtcatcttgccgaacgatgcgcgcagctgttggatgaggctatgagagaaatcaaaattttaactcaggaaacgcaagaagtcatgcaggcattggcctcgaaacacagtgaggaattcaccctcgttatttcagatgtaatggaagccatccaggcagagcacgctcaagtgaatgctcgattacatcgtggaatcaaagatgcggatgctgccgatgtgcaggcagcagcaaagcgaaaagctgcatgactacacggtaagctcacacattaacagtatgtttactagcagtaccatttttcgttgggcctatcagtgaccatttggttccattagtaaaggttataatatattttcaaagtgaaaaacacttacaattcctgtccacccgcatgtcgaagaaggtgccaagactactcgtaaacgaagcaagttgtcacgcgtggcttctgcagccaatagatcccaagcccccgttgatttgagaggtatttcgtttcacatggtgctgcacttttccgtaaaatttgatgatttcacactattcgctaccactttgatggtactaacacttgtgataatgacttatgggaccgactgagtctatggcaataagccaagatgtcaaataagcgaagcccaatttgtaaactgtaaaagaaaatcaaatctcttgcatttttccactgcatatatactcatgacacaaacatttgaatcacattcacaggtgacttgttagggccaagcaactcggaaaatgaagcaagcgagcatatagaccaacaaagctatcaagctgttgaccatgcaaatccgatattgggcatggcccctactgcgcatcaccgtccattgaactcatcagcccaagtgacggcagcagtccaccatgagctggatcaaggttagcttgccaaaaaaagagtaaaaacactgaatacttgaatacttgtgcagtaatgggactatttttttccccacaatgcaggattccaaatgcaagacaaatgtggccttgaatggttggtatcagcagcagctgtgggagaagccaccatgagtacgcatacatgcctcatatccttcaacccaccccacgcatactttagagaatgaaatgcatctgtcgtgttttatgttgcaggagccagtgccacattggatcaaagcaacgatgacaacctcgcggttgtcacgtgccaacgacaaccagaacattgcgagacacagatgacgaaagaggtggcatgtccaaggccagcttgcatgtcaccgttttcaatgcccatacttcacgaatggccaaatgctaaattagctcggaggttgtaccgttggctggagttgaagtcacgtgatgaagatataaccgggtctgtgaaaaacaatctttaaaaatgtgtgaattttcattacaaataaactttgtgttgcttattaattgtttatcctatatgaagggtttggttcaagcacgacaagcctacaccaattgagataagtgccatgaagctcaaaatgcaggtcacccacggtggcaatctatgtatggacctttgttcggcatttatcagactctaccaacagttagatgccaagatgaatacaaacccatctggacagcgttggcgccacttcttcccaccccaatttgcggtacaccaacatccccaacatttgtaaaaacataaatcgtggttaaacaatgatcaaagcttgatgtcttttccccttgattttggttttataaagctttgatgattgagccaaacttcagttccatgaaagaagtcagtgacatgtttgatcaacgtgttaatggctacaaaatacagaactgtcaactggtacagattttcaagacaaaacaagcctttttgtttttattatcaattctccttggatcatcacatatattggctagtgaaacattttatgtggaaactacagctcattgccccagttgaactagctggcggtacatggtcatgctacatttgggacatggagaagaggcaaatgcacattttggaccctgtcttgcagcagcgggagacttacaatgtgagtgctaagcagtaagcaccatcgaacagccacaatgatccacgcaggcctgttaacatgtataaacaaattctatggcggctgggatattaacccaaacgaatggatgttttcgtactacacagggattagcccaaggagccaaaggtgagtggcttctgccaatgccacagaaaaaagagagagattcatcccattacaaatttaaatcattttgctgctgcagtaggaactctggtttttacacattatactactcgcgtgagttccatgatggcaagctgcagagaagtctagattcggtgagcacacggcgttgatacatttccttatgtttttttctccaatttgtgtaacctgaaaataatgattcctcaattctccatcggcagggtagtattactgccttgcgcaaggatcttttgtaccagctcctgactatggaagggaactacgccgagctgccaagtcacattgcgagatacttggaatagttgtaccaagtgtcatgctggtcatttaaccttttgctagtatgtttatggtgcaagtatctaacgagaatttcccaagaaatctcctttatctaaaaaaaaactaggcgtctagataagccagtgttttctgttgataatagtgttgcactgaataaatgtatagcagctaagttgttttagtggttagtaccatttagcagaaacctttttgtatggctcccagcatgttactctttggaggagtatcactgaaagaatgggttttctgagtacctctttaattcagtagttttttttttttgcaaggaattcagtagttaaatttgacagtagaatcatctgcttctctctctctctctctctctttcatttgcagagtatcgactcatccctcacaagtgaaaaaagggaacagtaatgaaagcaagcataagagcaacatttgtgcaagacctgctgatatactactctatcaggagattaataaatcaggatgagcctaagaaatgaatagattcatgggtaaaccctaggatgagcctggtgcatagttgcaaaggtaagtgccctaccaaagaagctgaatgtaatatccatggcagataggcatgcttctggggcaccaagatgtcgtttgctccagtaaggtgcagcagagttgataaggccatggggctttttatgttactgtaactggtacgtatcttcagttacatgacagttgacattttaagttagggacaattgcttctttgaccctattctgaactataactactaatttgaccctacttttttaggtttgctcatttgatcctacttttcaaaattggagttgccgtttggccctggtttcatcacaccgttagggtttcatttaaaaaatagaaaaaaaatgtttttttatgccacaatggaccaaaatacccttgtacacatcaatattctcttatcctctccctctcatctctctcaccggagcttgtctccctctcctctttctcgccggaaatgggagggatggcggcggcggctcgacaaggcggaggacggcggcggcggcggcatgggagggatggcggtggctcgatgaagaggagggtcgggcggcnnnngnncngcnaggcngaggaacggcggntcgncgacgaggaggggcgacggncgaggcnnctaggcgacgganccggcggangggggggcccgcggggaggtagggagcgccgtcagcggcgacgcacggaggaagggagcaccggcgcacggagctgc

SEQ ID NO: 19370 - DNA, 596 bp, Oryza sativa
ccttaaaaaaattaactaagaaaaaaattaagatttataatatgaaacggagggagtagcatcttaaacggatcgagcaatcgatcatgggtgaatcatcagctttgcacagcaaaaaacgatcatagttgcttgcattttattacattttttctcttaacagagggctagtcctgcccagccacgtcccagcacaccactcactaagattttatggctttttcggcccagtaaaaccaacagtattggagaaaaaaactgggcctgtaagctgggccgcggggtggaagcgctagtcgctgcgggccgagctgtacttgagcccgaactcccggaagccgatctccatgtcggcggcggcgacgagcagctcggccgcctgcgccggctcgaggatctccaccgcgcgcttcacggtgcgcagccggagcgcgtcggcgcggccgagcacgccccgcacccggcccactatcccgtcgacgtcgatcccgccgccgacggcgaccgcgccgtggccctcctgcaccagcgccatctcccgcgacagcccgtcctcctcggcgacggtccggcgctggaggtcgtcgatctgcgcc

SEQ ID NO: 19371 - DNA, 683 bp, Oryza sativa
ttaactttttcatcgtatcacacaagggtcggcctgtaccactccaccataaataaagtaactggagtagtggagtagtactgtagactacccttttccagtcttcttcacttgttctttgggctacaatatggagtattactccagctccagtactggttccccttcccatcctcccactcccaccgatgaagggtcggaccgtcgggatcgccatcgccaccgtcttccccgccgcttcctcaccacccaaccttttctgctcgcggccaacgcggcccgccggcgtcgacgagccttaggaaggtggcaatatcccttttctcatcgctccgccgcttcctgcattttttgtactcctactgagtttcttttatttccgcctagatgaactatatgtgttgctttcaagcaaaatatggttcattacggcatgcatcattcacaaaaaaaaaagccctccttctaagagcaagtttaatagtatagcccactactagcttcaattcatctatagccaatctaatagctaattcatacaatagttgcttactatactattaatatatggtcttacatgtcatacacatattgcgtcttagattccgcgctacagttggctacagatttgtagcccgctgctcttctctctcatctttcatctcattaaaatatgtttacag

SEQ ID NO: 19372 - DNA, 1564 bp, Oryza sativa
  unsure (1)..(1564): unsure at all n locations
gaaacatttgtaacaagtttgtggagcaagtaccacatttaaggcacgtttcaaccggaatgattggataaatacaagcaagagaaacacgcttatatatttttttaagatataaaaattttaggtgtttacttcgatagaagatatacaaaatgcacttatcatctcaaaataataaaaagggttaaaaaacaacaaaatccagatgaaaaaacattatttagaaagcaattgtttgtttaaatctccatccataaatagtggaaattttatgaccatcttctttagattttgacatccaagttgtatgtttccttatcatcctcatacttgtgtagctggactcggaattaaatctatattatctatatagttgatgcccactaacttctaaagctcaatatgcaagtgtaccatattatcacctactagcaattattatataaaatattttaaatcacatgtaagcgtgtattttaaatataatgcaaacatgacatattatttacaattttgttgtatttttagaatacaatatgcaaaaaatgtcaagtcattattttcatattatctaaacatatacatctatcatttttataatgtataacatgcattcgttcacatatatgtaccgcagcaaagcggggagtatcaactagttcaataaataagcaagagcaatatcatgtcatggtttattttcatattatctaaacatatacatctatcatttttataatgtataacatgcattcattcacatatatataccgcagcaaagcggggagtatcaactagttcaataaataagcaagagcaatatcctgtcatggtttagaggaaccatttcttgaggcagtaacaccatcggacacattctaatcttttagagaatggtattttgtacccggcctctacatccaactggatgtatacggctattaaaatagggaacttagccccgtaaacaacccaatctaaaattcgcttatatggagatttgaactcaagaccttgtgatacaactcaggtcactgcaccactaggagcattctaattggatgattaaatagattatggacagataaactcatgtaaatgaattaaatatcataaatgctctgaaaaaaaatcatctaattaaagttgatataaaaagcttctgaagagattgtacttaagagaagcatggcgtaaataatcgatatctccattaacagtttagaacatgctcaccagtcaccataggagaggaccgggacaacaagaggaaacaggaaacggactgattaggaggcaacgacgtgtaatgaaaactgttttattggatttaaatgagaataatgttgccagtgaaggtaataatgattcagagaaaaaaagatcaattaacctttgctaaatagtgattcgactatgtaaagtatagtgactgatatagcagctgtcgttatatatacacactcctgaatagcagcgagaggcaagaatggtcattccacatcatgcannnnnnnnnnnnnnnnnnnnnnnnnnnnnnnnnnnnnnnnnnnnnnnnnnnnnn

SEQ ID NO: 19373 - DNA, 1266 bp, Oryza sativa
  unsure (1)..(1266): unsure at all n locations
cagcgacacttgaatttgcttacatggcctgaaatattgcgccagtttggtttatctgctggtcttggaccacagttaaggaaaaggaatgctgaaaatgtcaataatcatgatgataatgaggtatttgtctgttgaaagtgtccaatgcatatgcatttaaattagtttattcctgatagctgcatcataatcatgtgcaatctgtgtagttctgttggaggcaataacttgcacgattgtagattgtattgttgtatcaatatctctggtattttggttcctgagcaattttcgattcagagaaaacgcctactgtttagtcttatagttggctccatagaatcctgaggtacaatggtatttatgcttttgatggaaaattcaaacatagaagctatcagtaccgcgatcctatgatcttgctaggctattttgatcttggtccttccaggattgtagttaggaattacaatataaaataacagcataatcctaaatatttggaatcatagttctcgaggcattggtaggatcatggtcctacgaacaagggattatcctatcttaaatactgaatgtggtccttgaatgaaagtataattggagaaacttttgtaatctgaagcaaaaaagcagattagccacttcacagttttattctctttatggcaagaaataaaattctctcaaccctaacagccctgaacaactcaaaatttgcaaacagggtcgtaatggtgaggatgttatttccatactgagaagtggctcagcagctgtaaatgctgctgctaaaatgaaagaaagaggctacggtaatcgccgcaggtctcgacaccgtctgacacctggaactgtaaagtttgctgcgttccatgtgttgtcacttgaagggagccaaggtctcacgatattggaagttgcagaaaaaatacaggtatgccgaccacatccaaaaaagttcaattgtaacctgttgctatcttattgattttgtttattgatctcttcagaaatctggactgagagaccttacaacaagcaagacacctgaggcatctatatctgctgcactgtcaagggattcaaagcttttcgaaaggactgcaccttcaacatactgtgttaaaactccaaaccaaaaaggtcctggtgattcaaaggctgtgttggcaacagcaagctaaaccattaaggttgtttaagggggttctttannnnnnnnnnnnnnnnnnnnnnnnnnnnnnnnnnnnnnnnnnnnnn

SEQ ID NO: 19374 - DNA, 4286 bp, Oryza sativa
agagggggacagcaacggctcgccatacatcccaccagtacccattgttagctcgctgtgtggcagtggtggtggcagaacaggaggcggcgccataaccggcacaggaacctcctcctccagctgctgccgcttcggcggtggcttacggtccttcaaccgccggtggcagaaccacatctgcagctgcctgtccgtcagccctaacttcacagacaactccgctctcatcgtctcatttggatacggatcctctgcagcaacacagacaaaaccaagtaagcacagaaatcacagggctgtttcgatcgaaaaatcgacaaatcaaacacgaaatagccctaaaaatttccagaatccccagtcccccataggccatcatccacgaacctgtgtatgtcctctcgagaacctccaactgatagggcgtcttcatcacgcgcttcaccttcccgctggatccagaggcgcctgctccaccaccaacggcggcgggaacgggagcggaagcggaagccggagccggagccggagccgacgccggggcagggctctcctcctccaccccagccggcgcagctcccgctccctcgtcccctccatcgccggacgaatccatccccccacccgatcaatcaaatcgagaatcccaaaccctagattcgccgattccgcccgccgccaacacgatcgattcaacacacaaactccaaaatccagcaaacctaaatcccctcgatatatagcccacgggccaacgacgacccgaaccgaatccggcgacgacctcgatccgcagcagcagcagcaacaacaacaacaaaacgaggggaggagcaagatgatgaggagaaggagggtgcgtgcgagaggggaaagagaccgcggggaagaagaggaatcgaaagaaaagaggaggaggatgaggaggagcaacacgggaggccactccaaacctgttctttcaccgctcgatccggactggtcaggatttggatcgctcgttccatcgtggtgttactactactactctcctaataaaaacccccctttattattcgctgctcctggctggctgcctgactcttctgccgcctctgcttacttccgctgtgtatgttggtgttggtggtgctatcctttttttttctcttcgcgatggggagaggagaggagaggagtccgggagtgtgcgaaggaaagcgaggaaaggtgcggaataatgatgggatgtggctgcgtgggcgctcggattcgctggggttcgctcgatcttgcggcgttggcgagcgaatgagatttgatcatgtatgtgcgcggcgtgtgtgcgcgcgtgttcataggtggcgtagaactgggcgtggatcttctgtggcaacggcggcgtgcgggtgggaggagtttgggagtgtggggccctggttggtggtggggtacttggtgtgcctggcgtgccagttgggttgggtcggattgggaatccagtgaagtatccgcggcctgtggtgtgggtggggggatgtgggccgtgggatttggggcccgtgtggcagtgggattcggggtcaggttgatgagtttggatccgtcgatgtttgtgttctgtaccttcgatgtgatggttaaactgttcttgtgattggacgtgttttgaattgaagactaccactaaaaattttagatccaacgtaaaaaaaacttttacaccccgtcacatcgaacgtttgaacccctgcattaagtattaaatataggctaaaaaataactaattgcacatattgcgattaatttgcaagataaatattttgagcctaattacgccatgatttgacaatgtggtgccacggtaaatatttactaatgatggattaattagacttaataaattcgtctcatggtttactgatggattctgtaattagtttttttattagtgcccgaacaccccttgcgacatcctatataaaatccgatgtgaaacgtcaaaattttacccctggatctaaacacccccctaagagcaaggtcaatagtatagccagctgatggctccactcgtatccatgtcattttatagttgatgttaaagctaatttgtacaacatagtggctattgtgttgactgcatctcatccatcaaaaatttattttatacgcatatattgatatacatgatcgaaagtgaactcaatccctgtggtcgttgttgtgcaatactcaggagtgctatatacataaaaggaaaatacaagtcacagacagcaaatagacgagaagaacaaaagaattaggaagagattagatgacaataactcaaattagaaagctattcgctgctccatcaacgatgagatccgtttgttctgctcgtagatgcatctgccccttcttgacgcgatggccagcagcagcgccagcccgcagttgtcgtcggcgcccgccgctgccgccacgttcacgatctgctgcgccgcgagcgctgcgttcgtcgatgccagcggccgagtcgccaagaagaacgcccttgtcatcgccgccaccacgggcgccgacgacatcaacagacccttcttggtcaggcttttgagcgagattgggctaggcgtccgggtggaagataatcgcaagcggcggccggcgaagacacgccgggaagattgggcggggaatcgacgcggaagacaactgcgaggcgatggctggcaaagatcgatctgcgacactcccgtgaggagagaaacaagatgggctgcggagggggagggaatagcgctgcatgtcacacgggatcggatggctcgccgtgggacccacaaagcgcatgcgaacccgtgctatcgcccagctatagattagtcgctcgctttgttctctcctctctcttccacgtaggaatttgatgagctggatatttttggagcctgctcagtcagcttattgtacctgctctaactctctttctacgaaagcagattgttggatacacgcacatccgtataagtgtatactctacctctaaaaatatttttaaagaataaaccggtatactatatatcttaaacgtgctgggttcgccgccatgccacgttttcaacttttacagaaaacccctcgtcgttttggtatatcggattaggttcagctgatcagagccgttctttcccacgcgtgtatgaaatccagtactccctccgttttttaatatatgacgccgttaactttttctcacatgtttgatcattcgtcttattcaaaaaatttacgtaattataatttattttgttatgagttgttttatcactcatagtactttaagtgtgatttatatcttatacatttgcataaattttttgaataagacgaatggtcaaacagatgagaaaaagtcaacggcgtcatctgttaaaaaacggaggtagcgaaataagtgccttgttatttaccaatgaaaaaatagtagtggtggactgattgagacggggatagtacatgtttcctcggtggaagtcaatacaagaagtcacaatcaaagtcaacagcagtagtatagtacacgatgtcatcataatgcatatgggccatgagaaccgcggtccgaaccccgtcctgctctccccgggccaattctctcgacaatatcatcaataggcccaaccaaaagtatcatcgtccacggcgtgcaaccccgctgcacagcctccgatcgagcgcgacgcgacgagaaaacaccacacacttcccactccacagtccacacacccgctgccctcgcttcacgccttcacggtgccggcgcgagaggacgacgggttggagttggagatcgcgtcactccccggtttgacctgtgacttgtgagcttggtattcctcacaagtttgtcatcatccaagcttgcacgcatttctagtacgaggtaatgctagctaatttcccgcccgtttgcacccacaagttcatcatatcgtcatgccgtactcaaacaaagcgtagattaagttaaacttgtaagcatcgactccttgcgagcccattggggccgtgatcagctttacagtgtgttcgttcgtgtcacaatttaattacatgcaattaatggtccaaagaactaagacgaggatatgcacatataggcgtacgtgcaggcagaattctactaaatattagcgcggcgagagtgggaacccgatgccatggcgtgtggtcgggaagctcacgaacagcatgctcccgacgacgccgatggcgatcggcagcgccgtgagcacctgcctcgtgccctcgg

SEQ ID NO: 19375 - DNA, 1230 bp, Oryza sativa
ccattgacgccgatgatgatgatgatgccctggcacttgctcgcattctcttcctcgtctctgccaatgttgctactgcgaaaacggaagggaattgatgaggatttaaagcgtgcaaacgcatgcacgcacgaggcgtggtggcggtcgagcgaagccggcctgcgcgtttgcggatggttggcacttggcttgcaaggaaaaacaaccaaaaatcgaagcaaatcgggcagtttttccgttgttgcttgcaagtgatcgctggagcctggagacgaggtgtggtttctggcgcttcggcgttgagttaactttcggggttgccgcacacggttgagtaacggaatggcattgcaaatttgcagtgccggccttcgtccagctacgttttttttggtcgtgagcgtttttggtgcaaggattgatggatcaaaactaaaaaggcagctttggcacggagcggattaggtgagtttgttggtgatacctctactgtggcttgggccggtagtggatttgccttgtggagatggctaaagtacgtgtcatgtagtcgactaagcattattgggcaagtgtggtatctcgcttttgtgtgtgtgtttttttaaagataaacgtatgcgatcataacacgtgcatactcattctacaaatacaccgctttacctctataagcatattcgaaaagattgtgctgtcatttgttgagattcatgaaatcatcgtagatatcttgctggtatttttaaaatcttttgtgttcttttctttttggtgatggctgataagtgatcacgaattgttgtgttgccgttgcttgagctgataggctgataggctgcctgttgcttgtgctggctgctagagatgttcggttggaggctggggatttagcctatgaaaaaagcccatagagatggacaggtccagtagcctgcaaaattacaggtagcccaatctaatcccaagctgatacaagaaaggcccagatgcccaatgcaaacttacatgagtcaggctctgatatgttcgccgtcattctgaagcagctataccagcctagctatcacagagacacagacgcaatgcaatcaaaagtagcataacatgaacaggatagcttgggcaagataagaataagcttttgggtgccaagacaaaaacctcctgatgcagtggtccaaatacatgcatgctcctttaacctctgccagtactccatggcct

SEQ ID NO: 19376 - DNA, 3554 bp, Oryza sativa
  unsure (1)..(3554): unsure at all n locations
caaacttacatgagtcaggctctgatatgttcgccgtcattctgaagcagctataccagcctagctatcacagagacacagacgcaatgcaatcaaaagtagcataacatgaacaggatagcttgggcaagataagaataagcttttgggtgccaagacaaaaacctcctgatgcagtggtccaaatacatgcatgctcctttaacctctgccagtactccatggcctttctttctggcaaaacagattcctacacattgcatgttgtaacagtgtagaatgcatgctccacctgaggtcttggagaacaaacattgcaaagctataagacagcacaaggctttaatcatgtgattatcctttttcggccatcaatcattaacatgctcgattcggatgtctgtaagctttagcctagtattgccctaccttcatgcagctgcatcaaagtatcctaagcagtacgtgtaaattaattatgacccacagatcatacaatgtacttatcctatatacttatacaatttatccccacaaactttaattttctcctttcacaacgtgccacatcaccttaaattaattcggccattagatctacaatcgatgtctgatatatcaatggaaaactattgtgatccctctatgtatatcatttgatgcagattttgttttatttgttttagttcgttcttcaagaacgacaacaagctaatacatgaagacattaattggaaaaagagaacctgttcattcttcctgatatgtacttctctgtagtggcatatgagtacctaatgatttgatatttacatctagataggatacagctaacaaacttctatgttgtgaaattaaacgatatcgatatccattacccagtgtttttttcttgatggtatttattttgccgtggtacaaaagaataaaacaatttagtatttgcctctttatgcttcatgcatgcatttagggagttgaatagaacaattgtacatgcaaatttgagagtcgatcatatccaactgctctatcaaatttgttctaaaacctccgcagcaacgcgtgaggtactatcatctagttcatcttaattagtactccatctatttttctttttaattgtgttggttagctcgaaattgaactaatcaacgttacacattttaggaaacgaagtggtataacatagccttgacatcatgtagacgaaccatatatgcaagaattgaagcgaacgagtgcgatttcatccacgttaagtacccttctcactaaaagttgaacaatcatgcgttgacagatgaacatcaacgcacaaaacatccaatcaatgccaatataatttccaatcaaaagtacttactcgccaatctatggagaaaacttgagcttcacccagaagccacttaaacagttggtttagatcaattgtactcctcgattagtaatagattagctcgtataaacgccattgttagcagcttaattaacatatagctagctaggtagtctaccaactgctaataaacagaagaacttccatatcaagtaaaatagtaggagtgaattgaacgatcgactgcaattaagcctgtattgtacgtagatgagacagtcagtcgacacttggcaagaaattattctctttgtactatcagcaatctaatgcaaagttttacatacatctgcgtcaaatgctacatctcaacggcaacgtatagtactccagatatgacctagtgcgatatcttaattaatttgtagtactttgtaggtccatctagtacgcagagaaaagttgatttttcttatataaaaaaaaaacttctgctgatttagacatgtcatcattcaccgagagagcttatagcacactagtactccctcctccttcccattttaaagcagttgagggtttcgtgttcaacatttgcacgttcattttatttaaaaattttataatattttttaaaaataagtcgcgtataaagtattgttcatattttaccgtctaataacaacaaaaataataatcataaaaaaatatccaataagatgggcgatcaaatgttgaacacggaaacacacaactgtatttaaagtgggacggagggagtacatagtagcaaagaaattagaaataatatatattgattttttggctccttcgacgctgccatacaattggggtaccaaatcattttctgatagaggcgtgctagctttctcccgattgatcctaattaacaagctagatgtttttattgcctctgcaaattaattgaccactctcttaatcatgtattctgatcgttggtttcagaaatcgccacgattagaggatcttaataagccctactgatcaagaccatctgtagcagtagtagactcgtagtgtagtagcagttcacctcacctaaaagctacagtatgggcagctctgtctgtggctgcaaactgaagaatgcaacagattgatcgagttggtgcaatccacttcctgccacacacacgcgcgccaacaccaccacctaccaaacttctataagctctcttgcatgattaatccttttctgacatgatgcacacctaagctcgaaaaggctatcggctatgtgaccaaaactggaacacataactgttggtttaacttaagcttcaagccggatcaattgacaatttagttttttttttgaaaaacttgttttaagaatgtgctgtgcaaaaaacatatttctaaaataaaccgtgatcttaacaccaaatctaataatgcagaggtccaatatcattttaacatgaaatatgattgggcattgaaaccccaaccgtagactagttggaggcacgacatagcagcatgtggaggacaaggattttatacacctaggtgtgacggcacctatcatttgcatacgacttaaatagttataaaaaaattagtaaaatcgattgtgatgatataagtctatacacaaacatacaggactaaatttaatctacaattagagaaacaaaaataataaaatcagacattgaatagtactcatacaacgcagataaaatttgttatttttgtttcttcatatatcgatcgaatttagacttgcatttttgtatagtgtcttaattatcatgcctatcttattaaattatataaactttttatataattgtttaaattgcatgcatatacctaagtgccatagcacctaggtgtagaaaatactttctcagcatgtggatgctaacctctcaacctaagcgccaatgggcctagtgctaaggtataggacttgattagaagctccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19377 - DNA, 3019 bp, Oryza sativa
tttttaggttgattttttttatcggagtactaccatgacaaaccaactggatttgatgtaagcataacaagaaaacaaaaaacgttttgaccctacttaggcccacacctcagcctccgtgccatgcatactctgtcgaaagcaaccaatacgaagtgaggctttcactgcgtttcactaattaatcgcattgatttgtccctagtagtggggggaggttttcatttcaggtggaacgaaatgcatcaatcgatcgagtggatcgggtccagtagtccagcactccagctgagctgcattccccaaatcctcctgctggactgccggcaggcagctgagaggctgaggtggtgtctagaaatgagggactaaactttagtcactctcacaaaaatataattccctagggtaaggacttactctctccgttttgaaatgtttgacaccgttaactttttagcgtatgtttgaccgttcgtcttattcaaaaacttttgtgaaatatgtaaaattatatgcctacataaaaatatatttaacaataaattaaatgataggaaaagaattaataattacttaatttttttgaataagacgaatgggtcaaatatgtgctaaaaagtcaacggtgtcaaacattttaaaacggagagagtatgtttttgtgagagggagtaaagtttagcccctcccacccaaaaccccctgagacgagcgagaggaaagcccgtgcagcggcagccatgatgactgcctcttctctccattttcccttttccaacgcccactgcatctgcttgaccagccacggtgcctgccgaatgggacgccccagataagccggattgttcgtttgggccacgacacgcacgcggggcctgcttcggccgtgctgtttacggtcaaactcatgactgaccacccacgggccacggatcgatattaccatcatctatctcttcgtgactttgccacttcagaccttgttttgggagcttcttgaagtagtagcaattcttcccaaaatcttcggctctctccaaacaatcagattatcactctgattatgaaaatctgtatcaatataatctagaagatgaataaggtgctgtttgaatctactgaagatgaagataaagattaaatatttcacgtaaaacgaggtggtaataatgtgtgattaattgagttttaattattacaaacttgaaaaatggattaatctgatattttagagcaactttcatatataaaattttcacataaaacacaccgtttagtagtttgaaaagcgtgccataaatatctaaaatttcatccaaatgttgttagagaaatgaacgcagcctaacaagacagaaactgaaagacctatatttgttctaattcatattctagcaaatgcttctcaaaattttaaggcttgtttggaaagcttctagcaactgcaatttctttcataatcaaaagttctactaaaagtacatctttttatccagtttataagaaactgttattgaaaatctaaaaaataaaatagcaactagaagttgtatttcttagattcttcgtattctcataagttagatagtaaccttaaaatgtagagtaccctgttccaccatacgtcgttaatataattagaaacatagtacaaacgtaaatgcttataatatgcgtacactcatatttgtgaacgcacaaacgtccattcaactagtcaacaatgaggggtatgttagaagaagaagaagaagaagaagaagaagaagaagaagaagaagaagaagaagaagaaggaaagaaagaaagggtggaggaactggagtgaaatgctgttgtttgtgggcctaaatatgtatgggccaactggcctggatcgaagaagcagggaacgaacaaagtggaatccgaacaaagttgacaaggcctgaagccctgaattcagcggtgcaacgcttgcccagcgtggacatgcactcatctagtcatcaggctggtgatcaaactgacaattattctcgacctgccttattaggttgctggtggtactgaactgaactactgaagtactctcacgcagtcacatccccatgttcatcggtgtgcttttgctgttctgcccttctccatgtgcagtgcaagatgtgattatgttaggtcgccaactagatggaggaccatccaacatcgatccatctatgttgcagacatagttttaatgtttaattaataccaaacacagcttgattggaatgagaaacacatgaaatttcaagagtcaggagatcgagtgaaaatactacgcataggtaattgatctgggacaccaaagaaatactaaaatcagtctaaaagtttcctcttttttttcgaggtaaaaggcctactaaaagtttgtctagaatctctcttttttcataacgaagtggttggtagaagtcacatcagctaatgggattagttagaacactaactttaactcggtgtttgttgaaaccaacgtcaacacctaatcatatactcctacttgtggcccctaagagcaggtacagtagcatgctataagccagttataaacatattttaagaagataaatgatgagagagaagagcagcgggctacatatttgtagccagctgtagcacagactccaagacacagtgtgtgtatgacaggtgggactagatattaatagtgtagtatgtaactattgtatgaatgagctattagattgactatagatgaattggagctagtagttggctatactattaaacttgctctaatggaagtcgattgatcatcattaacacacacggagaataagaatttctagcattgcccacattcatatatatgttaatgattcattaacatctatataaatataagcaatgctataaagtcttaaaatctgaaacggaggtattacttattactcctacttgtggcccctaatgaaagtcgattgatcatcattaacacacacggcagttgcatgctccaacaactggg

SEQ ID NO: 19378 - DNA, 566 bp, Oryza sativa
  unsure (1)..(566): unsure at all n locations
gccacccctgcgcctgcgacgagagcgccgaccaggagaggttccacggcttcgtcaccaccatgctcctcaggcgccgcccgttcgcccccatcaaggcgctccggctgtgctggagccacgacggcgacgccaacaactggatcgctcatgctgtcaggcgtggggccgaagaaatcgatttctccgcgaggcatcaccaagatgatccgaaaccggagctagagtacacgagcttcatttctcacaagatcaagatcttgaagctgacgcgtgtccggatgggcatcaagtttatcacgcagatctgctataggtgcacttttttggaagaattagagctcaagaatgttaattcacttgaagggcagattcaatcgacctcgctgaagcgcttgtctatcatcaactgccttatctctgatggatttttggttgatgctccgaaccttatctcgctctgcttcttcagacctctcagcgggtagaggcacccaggcgcccatcccttggttggnnnnnnnnnnnnnnnnnnnnnnnnnnnnnnnnnnnnnnnnnnnnnnnnn

SEQ ID NO: 19379 - DNA, 1686 bp, Oryza sativa
  unsure (1)..(1686): unsure at all n locations
nnnnnnnnnnnnnnnnnnnnnnnnnnnnnnnnnnnnnnnnnnnnnnnnnnnnnnnnnnagtgctttacactacatccatcctcccacccctcatttcatataaaaatcttcaaaccaacatgtgtgatctccatctccatggacctaaccatttgcccaactttggtgctcatttaaaaacccgtgtataaatggaagaattagcaaatatgctttagtttagagaaaatcaaatccacatgtaaattatgcactttacaatacacctttttcaccattaactaaatatcctaaaaggagctggaaatcctaggaggaaaaatacaaaagttatgtaactagaggtttgtgctatagtcatcctcttacattcccattggcttatgtattcatcattagtatagaataataatttgcccaacatttttgtaagtccaaatggaatagacaatagtttagctaagcatagttaaggtgctgctattagagcacaaaaattcagtccacaccactttgctactcaattctcagttactgcttatcaaaatgtcaatgtaaagcacaacatacctctttcacatgcttttcgaggcaacggaagttaatatttgcttcaccatggtaatccatcacatcacttcgtaattctccaattgacctttccagcttatagcaatacagctccaactgtgatagcctcccactgatgacatccagtgtattcaccaagttgtctgcttgtttcttcatgcagctctctatagcttccgttattatttctctggaataagtttcttgttcatggatattaacaagtgacctcagcagccggttgtcctggaaatcctgctttattgaagaaaggaaaatatgctaaggaccagatgttttgagcctatagaatcatggcaaggaaaagaaaaactatatagattttgccaaaagcctagcaaacgtgatttaagctaagaaatataatacgttcatatgtgttgataaagggtgaacatcaccaagttgactccagatcttcatctggttacaacttacaagttacaagaaatgtatattgatagctaacacacccaacgaatgattacttcccggcgtgtttaaatctaaacagcagaagaagcaaattcggaagatgtaacagtagaacgaccaaaaaaatcttaagataacagaagtgatatgtcacgacaacacctaagattgattataaacacgatgagaagtaaatcaaaagtagcatatccgcagcaagcacacaggacaaatccctcaaaaatttgcagctaccgttttgcacaaggaacagtgaaaccctagtcgtaacgaaacacccgcaaatcccacaaatcggccaaaattaagacgaaatctccacatgaaaacgaaaagtgggctgtctcgttcatttctgaaattcaaatcggtcagaacaaatcacatagaacagtgtgcaacctcgcacatcatcgaaatggttgacgagctcgcagatccaccggtacgcacaaacaacagacgagaactcccaacctttccccgcatctccacgaaatcagaagcagacagcaaaaagctgcacccccccccccccccaaggcgagagtcgagccaccggtctcaccaacacacacccagaacgaagcaaaacatcaccgaacacaaagagatctc

SEQ ID NO: 19380 - DNA, 15851 bp, Oryza sativa
ggaagaggagaaaaggaggagtaaaacgtaaagaaaagtggagagtagagacgagttgggtttgttccaagcggggacggaataaatacggagagaaaggaaaagggaaaaagaaaagaaaaagaaaaaggaaaaataggcgggggggtgaaaggctcaaggcgggtggcgggtcagaatccggggcgggtttggcgtgtggtggtggggctcgtgatccgcgcgcagggtcaaatggccgccggccgtgttcgctgcatcccccgtacgcgaggactgtggacgaggaaggacgaggacgcggcgcggccgcttccaccaagtcgccggcgttttccacgatcatggattggaaggtatggatttttttttatttaaaggaaaagaagtcatcagccaaaacgcgggtcagtttgaaatatttgaacgaactgttagtactataatttttctatttattatatagataaataaacttaacaaatgatttgtaataaatggtccaaacaatacagtagagaaaagtatctttttaaaaaaaatgtgtttttttcgaagcgttaaataactaatccatttcaacgaatctagagataatactgccttcgtattttaaataggtgacattgttgacttgaataacgtttgatcatttatcttaaaagttgtacttaaaagttttccaatgataaaacatgttccagcaaaataaattatatgtacatattttttttaataaaacgagctggcaaatgtcacgaaaagtatattaaattttaaaaacaatgagtgtaacaggaccgacgtataggtttgagtggttttctttcttataacgcttaaaagccaaaaaaaaaagtcaatttaaaagcctaaaccaaccagattaagatctcgttcttttctctaacaagagttggatgaatatgaagataaagattttcgtgtcatgtttttcaaactgctaaacggtgtgtctcttacgaaaactttttatatgaaattgctctaaaatatcatattaatctatttttcaactttgtaataattaaaacttaattaataatacgttaataccacctcgttttgcgtaaaaaacttaatcttcgtcttcttaatcttcaggggaaaagaacaccacctaagccaaaacaagatgcagcttagttaccctctgacactatcttccgttttgattcgatgttagtcgtcagtgttgttatctctatctttaacgttgtattataagtagtttttttaattaagccgtaattttacaatttacagtagctataataactggttatagtttatttttgtcagggttatagataccacatacctaatagtagttgactaaatctcgacaggacccaccacataccatgtcctatacgaaaacaacctgcggatataggaagagttccacataaggaaagacaaccagagttctacatggaaacgacaagtactactcggattatatccatattggttttcctagttctacttggacaatgggacacctatgagtataaatacaaggccccctaggaggagaggagacgaccacctcaatcaacacacccaccacagtctacggaacaacagaagatcaacatacaagccaacatacaccaagacaagatgccggatatcgaattcagggataagtacggctagtcccctacggtgtctccggatactgtcaagagagacaaaagcgctgtctctgatctcgccgggtacggattcgaggaggaagactacctgttgtcgactacgagtcagatcttcagaccgccatgttgacaaaagttagataggctaccccaaatattgtactggtgtgattatggtgaataagagcaataccggcttcggccaacaggatgtagggttattacataacaattcagaggcccgaacctgtataaaaattaatgtctccatctcttttacctcaatctcgtatatatcctagtactaacgattccaatactatgcaaataccggaatcgcgatatcaaacgtcgacaatttgaagcatgaatgaaaatgaattttattataaaaatagacactttattgtttgctgattgatttgtaagccgtatccaacattttaaattattatatgtattttttatcatattttattttttggttgtgtattttttattaacccttaagagtagaaacatacaagtaatgttctaaaaatcttttggctcgtttatttcttttaggaggttttaaccggagacccgaagtcaaccaatatgccaaaaaacatcagccgaaaattctaaaaagtttaattaagatctgtagcacccagaaggaaatagaaacaaatgctgtggaacactctagacaagttttgacttgttcctaacattagttacagtactagtacttgcatttttacaattggaaaggctagttggcgaagccaagtcagtagacaaacgtgctttgatctctgcatcgacttgtatacttacgtcattagtactcctattaaacaagtaaaacgtactactcctacttatacatgcgttttaaaaatgaacgccaggcaaatcgcatcggcaagttggaattaatgaaaaccccaatttggcgagtcaaatacgcattacagcttatcaaaagttccaagttgcgtacaatcatagactaagatatcgtaagtacgtgcttaattattccaggattttttttcttcttccgcattctcccctaactaacctagaaacttcgatttcctactactgctggtaagcagtgcagcatccacacatcacaaaaaccacaataataaaaaaaacgatttgaattctcattctaccaccaatccggtggttaataattctggtgtgattgcgaaccgaacgaatcgaacgggaggccacggtggcgtttgtggatagacacgagggaaaaagattccgaccccattgtttatcctactataggacagaggcggaactagggtattgagcgggtgaaacctggtcaagaaaatattatagctataacttattttttaaaattacacagtacaacatatacattcacaacacacgcgcactcatctttataaacgcacgcaggcaaacccatctattttcaccatgtatgcatcactcttaatataaatttagacactcgtatcatcttaaacttgatataaagtagagtaaattaaacaagtggcacctcactttatttcgttctagctccgctagagaaaaaggcaaaacggtatatttacaaatgaaaaataaacacttgtggatataacttttacatacgtgttctcaatgatctaatagtggagactaaaaaataaactatgatgaaaaatttctaaaatcaactttaaaattaaagttaaaaacttaaattttaactgataagtataagtataaatgaaaagatgatgcggttcagtttcatggggacgataccgacgtcacgatgaattggattcttggagctaagagaaaaatgaaaatgatatggccggatcgaagcttaggtttggtgaattgctgacgggtcacgcgccgtccctgccacacgaaatctgtggccgtgcttaattaaatcgggacaaaaaaaatagtactaacaaattaagtggctggtaatgtcccccttgatcgatccctttctgtcaccattggccgcacccgtccaaaacgccggaaaatgacacggaattgaaatgacaggattcgaatccagctcgatcaattcgttttcagaaactctcagaagcaactgattcgtaatatcattcattcattcccttgtgcatttgcattcagttcgtaggaattgagtaatgctttgtgtgtgcgtttgtgattgcgtcggtcggtttcagttcaggtgcccttcgttgaaggtagctcgagtttttttcgtagaagtggccgagggaaatggtcgaggagttgtgcaattagcacgtaatcctcgtacacacggcgtgtgtttaattaggcgtgtggataattagcggtagcttttgtccattcatgtcttggaatagacagcaagagctatgaaatgcacacgtgaagcatacgaagagttagttcgtcccgcatggaccagatggtgtatttatgtacactgcgtgctacgagccaatgacgtgtagcctaggaagtatatgtttcacgcgtacgatctcatcatgccccatctgcaataagtcaattccgtgcttaatcaagcgctactttgttgacaataattgttgacattgtcgatgagacgagagatcacttgatatgcatttccctgcaagttaagtaatgcaaagaaaatgctgacgtcgtcaactctgtttcaagtctcacgttttctttagaaatgcacaaatttaacgagattttgagtttcaacagtggttcacttcagtctcggtgtgaatcaagaacaagaaaatcgggtgaactgagctactattttttttcctcagttttgattcctcatttggaggagcaattttgcaccggctttggaagttacggtcgagggatgcaattcgatcgagggtaagacatagggagaaaatatagacttgctacttcctcgttgcatccgtggcatttgggctaggcccagggaagtagacgggccaggctaggttgggcctggctgcttcggcggcgcatcaaactcgccgctcaccagcatcgcgtcggtggcacgtggcggtcgcagtcgcagtcgcagtggggatcagcggcgccgccgtgcgaagaagccggcggagatgccgatctgcccgccgtcgtcggaatcctcgccggcgccggggttgggggggcgcgcgttgatcttccacgggttggccctcggcgcggcggcggcggctgcggcggccgcggcctacttgtacaggcggccgggcgggttccgcggccgcgcggtgggcatcataccggcgcgcttcgcctcctcccgcttcgaggggaagccgctcgcccccatcctcggcaagcccatgatacaggtaggtcccgactcccgtcctaccgcctacgccacccgcttgatttgcgcttttgcttcgcgtgttgagactggatctgagagtgcgagtggaaagcttgtgctgaggaattcaagcgaggaaatggaatcggtgatgaaaacccgcgagatgagttccattcgtgttttctcgttgcgatttgctgctgctgctgctgtgcctgtggcgtcctcttcatcaggatgcaatttcactacagtagtaggcagtagcagcagcagcagtgacttgctgagctttcagttggattccattattgggaattgctcgtttcgttacgtgcgacatggtcgtacgcgtcaagaccttcgatattcttctacatgttagatgttgttataccatgtcgcagtttcttggttgtttcgagctgtggaatgagggttctcattttgcgtttcgtccagaattcacattgtaacatctctttacttcataactacggcaaattaggtggggatgcctaatttaccctaaggactttaaggagtcctttaaagtgaatgcaattttgttgtattattaatattactttgagcaccgaggttagtgccacagaccagagctgtctgatgagggattatgctacttcaagttatcttctatgtgattgacatatagaatgcactattgcctattggataacgttgatatgatatcttgcaagttggtttgttgaataatctgtgtagttcctcatgttgggaattttttttgtcctaagcagatctagttagtcctgaaacttttaccttacacttttacagagaacatgggaaagagttatgttagcctcctctttggaccatgttggtaagtccaagctcataaatcttatatttaatcttttcctgtttctgctcaaaacattatgtttagtatcatcgtatattttgacttgtggcctatctctcttttgtgacaccatttgtacaagtaattgttgtttataacttttctttcatgatattagtcgtaggtgtttttgaatctgcattgcacatgctaatcgttttgatactgccagtccactcagccattctcaccattttctctgtgtcatagtcgtggcaacggacgatgaaagaatagctgaatgttgtagaggattcggagctgatgtaataatgacatcagaatcatgcagaaatggtacagcttatgttgttttgtcattatttgccctttccatgattacttgattaacccctacatgtttttcgttggcatatgcttcatttaggatctgagcgttgctgtgaggctcttcaaaagctaaacaagcattatgatattgttgtcaatattcaaggagacgagcctcttattgaaccagagataatagatggtgtagttatggcactacaggttgttacttatgtaaactatatcttgctagtttttgcagttcccatcaaataaacaaatttttattagatatttttttgaactagggcttttattttatcataagcaagcttagacttgaatacattgaaagttttaaattcttcattggagaatacagagtgcacttgatgttgcactcctttttatcttttaccttttgcatctccttttaattcacgtaatttacttgctctagtgatgtccttcaatttggcttgcagcgagctcctgatgcagtctttagcacagctgtcactgcactgaaacctgaagatgcatctgatacaaatcgagtgaagtgtgttttagataaccagggttatgcaatatacttctcaagagggctgattccatttaataagtgagatactacctccgttttttaatagatgatgctattaaatcgatcaaattgtcacttgcaattttgaacatttcagatcagggaaagtcaatcctcagtttccatatcttcttcatctgggcattgcggtatttatcaactcatacttcattctcagctttgtgttattttcttttggatactcctgtagcctgtagtgcctactcttcatagtgtgcctttttttcatgaagggctttgattccaagtttttgaagatctatccagagcttccaccaactccattacagctagaagaggatctcgagcaacttaaagttcttgaaaatggatacaggatgaaggtaagccagatagaaattgtatttgttattgctatgctgttttgctatgactcctggaaaaattaggtcatctgcgtgttattgttggaaattcctgttttagaacaagtaacatttatcaatcataccacaacccacatcttatgttcgttataatgccaagatggtgaacttgtatgggtcaaagacaaatttgtgatggtaggcatcagtgcatgctattcattgttcagtatcgtaagcctttatatggtgtatacaaatgtcgcgtttgctagcttatgccttatactgctgaattgaattttcattatcctcgttgataacaggtaatcaaagttgatcatgatgcccatggtgtggatgcgcctgaagatgttgagaaaatagaagcattgatgcgtgcaaggaacatccagtagcatgaaaatgatcgattttgtacgttgtgtggttacatgtttgattcgactgttcgtgttctagtatagcctttctgaagagcacatgaggttaatttgagtttgtaaattagaagctgtttgaaagttgaattactgttttgagtgtgcatagcgttgcacttctttcttacaacgttgaaggaacatagcgcatctccatttactgaaatggcagtgcacctacttgtatttactgtaattaccaggccatacagttcgtttcgagtttgttcttgttaattaagctgttaatgttagcgcttctccatcgttattgttatatttctcatcgattatttggctaagcttcaaagcttgcctttgtatcttcagttatcaattaacgtagggctaactcagttcacaaaaaaggacactaacaaacaccaaccgtttgcacttcagtttaaaagcactaacaagtaacgacatcacccaggaagtaaaataatgatcacaaagcacataggaaaccacaagggattacataaagattctccatgcattattcctgcagcatatgcatggattctccaaacattgccgatttattattcgttcattcactcatgcagtctgagtccgaccaaaccaaactaagtcgacgtcaccgtgagttacatcctctatcataatagcactattattataggaactgacgacgtgtcggtaacaataatgaaagttatattatgatagagaatcctcacccgaaaacgattatatcatcagattagtggtggtgctgcgggtcaggtccgccggggacttcccacttgccgccgccgccgacgatctccgccgtcacactcaccctgttccacgccccgccgccgcgagccgccggcgccggcgggtgaagccggcggccgtcgcgggccgccattgccggcgtcgccgcgaagacgacgatcatggcgagcacaatgaggcaccatacctggacaacacgaggcctcatcgtcgtcgatcttcttattctcgatcgtcgttagcttcagctactggggttcgatcagtgtttgatcgcttgctgatggcgttcacgtactccctgatcggctagcttatatagagagcgcgagtgaggcagctgatcacgcctcatcacaagttcacagtacgtacatgcaaaaacataacaggttcagatgtgggtgtatgaccacgtatatccacgtactatgtttcaaattttgctgtccagaaatatatactccatctattttttaatagataatactattaacttttaaacacatgtttgattatttatcttattcaaaattttcatgcagatgtataagatataaatcgtatttaaattattttaagtaataaaataactcacaacaaaataaattataattacgtaacctttttataataggacgaatcgtcaaacacgtgacaaaaagtcaatagcacgatttattaaaatacagaggtgtatatagttatatatgtgtattcttttttttttgaaacgaaccgcacaagatagtgcgagtttcatgtatttataaagcaggagaaaaatacaatctatagtcatggaagagcacataccagaaaaagaaaatacaaccacaccgcgatatacgtgtattcttagttagtgcagagaaaattatatttactttattaaaaagagagaaaatcagagtgtatatgagccaggactagagcccagggccgtacctaaattgttagggaccgctgctaacacaaaatgaggttccagcaacgacaaatgggtcctgatgcaatttattcgatttctttacttaaacagaaaataaactcattctagccaaatcagtagaacgagatacattgttttgaagtaaaacatggaaattttaaggctccaaatttttaggggttgtgctatcgcgcaccttcgttacatgtcaaatcgacccgggccttaatcttaaaaggtttttcatctctatctaaaatctatcttggcatacagccccagccacttagtcaactatattactcttaaccaatatatatcctgaattgcacggtggatttttgccgcttaggcactagctatcctcctagcttaattgatcgaccaccgtatctgcaattcgagcctcttgtcgactcctgaatcgtcaattacagggggtgattttacacagacgtcgagcgttttgctacgtacttttttactgccgatatatatgatctgtgtctgcaagagcgacaggcaacaacgtcacgtcgtcacggagcaaatggataaaaacagagctagacaacggcacgatcattctgctgaaatgggcttttagacctaagcttagcaatgggctatcagcacgcagacagccgtttaattgggttgggctcgatcggattggttcgatcgatcacacctctgcgtatatggataagcacgtacgttaattacttgtggatgctgagggcaaaaggcttttctggtcacatccaaggatcatcaactgatcaacatcaatacaagaattacatgtgttatatatcaaagaggtgaaaaagaatcacaactttttatctccctaacagttcactggatatcaagagagctagtgtgtatatattgtagtagcactagacactactagtagttcatcgaacaacttagtcagcatgcattgccgagagtgggaagaaataccatatccaatagctaggataatctgcatattgggataattaactaatccaaacttactttctctagccatcatacccatcacctttttcttcttcttctttttttttttttgccgacaaacagctagctactagcaaacattgctgccatttagaccaattaactaactcacttctttaaatgttattttgcttctgtcaacactagtcacatggccggccggttcaatgcactagatcatgctacttcattggataattatcgtagactattaatttgttccacgactctaatcttctgatgtattaatttacttcccttattctaagttaactactattaaatttgtttgtcaaaatatttaattgatatctataatcgtgtaaacaacctactataacaattcagtcaataatctatttgaaactagatataaattgagtttgattcagcaattcgggtgagcaacttcctcattatctatagtcacgtttcttaaacagttaaataggaggtttcataaaaactttatatataaaagtttcttaaaaatataaaataatagatttttaagtttataatagttaattagtcacctgctaatactctttttccataccgagcaaaatctcaccgagttgtttaaacggacggactattagaattagactgattttgttttccataccgagcaaaatctcaccgagttgttcaaacggacggaccattagagttagtccgatttcgttgtttgttgttggaaactcatacctcacgcactaaaacagaatgactcattagcacatgattaattaagtattatttttttaaaaatagattaatatggtttttttaaagcaactttactatatatttttttaaaaaaacacactatttaatagtttgaaaagtgtacacgtagaaaacgagagagttaagttagacctaacattcagatatgacatgctatgcacttgctttcccggtagcagttggacagttgataaacaaatgtgcataaactgattaagcgcaaaccacttggctaatggccaacgcgatctgatgcgcttatcaaacataaattttaataatgctttatttgcatacggtttctggtcgtggcgccgcacatgatcgaagataaagtggaaattaataactaatgatggcagacaatttttggtgtgtcacgtacgcacatattttctgtacacatcttggttgccgacgacgacggtcaaaagtgttttgttttggtgtatacgtccatcgttttcagttctagcagggcccggcgaaaatttttcctttcaacggttcataacttcatatttgctgatcagttgtgccattataccaccaatatatactcctgttattgattggtacaaatattatccatgtaatatttgttttccccaaaagaatccatgtaactttttttaacaaataaattatattatatctgttgtaaatataagcatttctacgcgatttccaaatgcatcttaacatccttatacttccggatgcattttaaaacacacacataattacatatatttcaaaactgagtgagtatacaactgttagtattttctataaacaacttttacttatttttgcagttggttattactagccactagatatgcctggtactgtaatagctataggtacggaacaataggtttacatgtatgtttctcgaccatctaaaaattttgtgagtttggtaaaaactatctaatatgatttttaaatactattttatatccattttttttagttttgtaatgcttaatttcatctgtgcccttaaataattctaacagattttcagctatttaaccattttacacaaagatcattgtatttgaaaagatgcacttgatagtgtaatggcaagttgtatgtggtttcaatcccgagttctgatgttcaatccacacacccacaacttcttcatacaaagtgtttggaggcacgtgtctcccaccaaatcttgttttttttttcgaaacgatagaggagactgatccagtcccttaagttttgcttgatgattagttttgctttagactggttcagccttaagactgcttttaaaacctgtcatgtggcataatatatattatagaaaccatattattactgctcaaccatagagaccaacatatagctgataaaggtaaatcagatatttcacatagattttgtatgggaagataatatggcatatccccacgatgatttggatatataggcccatggataatattagaccagatgataaattttaatgatttgttaatattagaccaaatgatataccaaattgtttgtagagagaaattttgtagaccgtattggccgctatttctcccactcgtataatgggtatgttcagttcagctagatggtggttgtacagctgcagcgcttttagtacaaatttgcttggtaggtcctcttggtgtggctacaacgttgccactcctagctcttccgaacacagccaatattaggctgaatatattaagaatattgtctgagttcttctcgtattatttttgaaaaataaaaaatggcaagatcagctatgccttattgacgtgtaaagttcgaaagaaaagatcagatctaccttttatttaagcggggtgcagaagtggcattgatcttttcagtttcgtgatttatcttgggttagaccctaggctgttgtacgaatttgtgggaatggtgactggacgctgaagtgataaataaatataaaatgcattttcttcggttttcaagtgagttgtttgccctcttttggctagtgggattagcgtcacttaaataattataagtatcctaactggaacttttctgaataaaatctagttagtacgatctctgatagacaaaattatagttacaaaatgacattttgtttaccaaaaattaaagcgtcttagctcggtgcttagtcatggaatgatgaccaccttaggcattaatttgttagagagaaggcattcatacaggagaacaatccggtgcatgtctactcgtcttgaaattaaggccaaacaaaaaaaattaagatagtagtgaaataatctctatcagtaaaatccaggtatgaaattataccttttttcatattaataaattttacactgtgggggccttcccatacagagattttggcaaaaaagaaaaagaagtcttccgttccattatatttgtcatcactgatggttacagttgcaactttgatcactaataatttttttaatggttaggttgtgatgaacaaaaatttaatactcatatctagtatgtaatatacttcaataatatgacatctatttaagtaatatagtataacatttgactattcgtcttattcaaatgtaaatattcaaaaaataaaagtcagcttaaagtttatttaatgataaaacaagtcataaaaaataaaaaaatactaatatatttttttaaataaaacaaatggtcaaatatgatatcacaagttaatgatatcatccactaaaaacagagcgagcaataccttataataacagtaaaaagagaaagaagattttagaacacaaatacacattcgcttagatgctatttagatttgtgctatattgaaaagaggaatatgaacgtctacataatattcgtgctatttagtacatgtccatgtccatgtgtatatgagcgattgtgtctatatcatgtttcgcaaaataaaagaggaatataatatttggccttattaaatttgtgccatatgtattaatctaaaagcaaatccgacaacaaggggtttaggtacacatggacttgtgttataaattgacttttctgtaaaagttacacaaatatatatgaaaaagaaaacagaactctcttttcatctcaacaaaaatgaaaaaaaaaaatcgaaccccattgttagccttcaagcgaaaatttgaattttcaaacttaattttgattttagagttgatgtatgagaaagtttttatcgtagtttattttccagcatatgatttcgtatataacaagttttatttatatttttttactaaataagttgttttgcttataataaatataagccaaatgatgaggtgggaatacagtcttattcagacaagcaaatgaacacacactctcaatcttcaggatctttgcaaatacgcgcgcgatggtgggcatatatatatatatatatatatatatatatatatatatatatatatatatatatatatatatatatatataactgtgcatacatgtacagtatacactacaagtaaaacatgcatgaaggaaaaaaaaacagctataggaattggtacagacatatttgttgatgtatcgtcagtagacactgcaggcaacacacagtcacacagatgatcgtcgatcatatccctgctcagtgatgctgagggtctggaccgccggggctccgcctcttagactcaccaatggcggcgccgccgtcgtccagcgtcgtctcctctcgcattatcttcctgaaacgccccctcgccgccaccgtaggctccctcccttcccattgccgtccggcctctgccgtcaccgcggagtacgagagaatcagcaggattatgcacatcagcgtcgtcacaccagcaaccagcacgctaaccttcgccttcgccatgcctaggaaaaaccaagagctcaatgcaactaaactgctccaacaatatcgatcgaacgtgccaatgaaatgctgtagatgcagtagtgtgcaatgctacgaagatggcaggtttatatatagagagaaagagagaggcgtgagaccagtggttggctgctgataactaagctaatgctctcaggtcaaatcagttgtaatctgttcctttaattttctctgttgttacatgcatcgaaccatcatccatccaatccaatccaccggcggcggccggcgataagatggccggcaactcgcccacacaaaagccggttggtcgctaggcaatctcagctctgttcggtttgtttataaagctgtacacgttgggcggcgcacggtgatgactgagatgagcagccaggttcagaaatggggttacacgtacgtacgttagatggggcatgggatgcatgggcgcgcactgccggccgcctcccctgctacgctcgtgctccggcggaaagcttttgctttgcgtcgtcacgcggaggtggaggtgggttcggtgagtgtcggctgggttggacgacgagtcgcggggctagcaggagctcttgatttacgttgggctgggcgactgaaaggccgggtaattaggccccgcgagaaaagggctggttttgaatgggctgagaaagaatgttaggcatcgcttagcccattgcgtagggatggtccaatactggtgtgacagcccgttgccgagaaaaatgtataaaaacactctggtatcgattttgctatatatttgtcgacaaa

SEQ ID NO: 19381 - DNA, 11550 bp, Oryza sativa
  unsure (1)..(11550): unsure at all n locations
actataattacatctgtcaaatttttggggaaaaatttgtcgacaaatgtataggtagtcccctctggcatagaagctggtaatggtaaggctgtaactaatcgagaattgagataagttattagtgtataattaatttagtattagttattgtaaatttaaaattatatttattgtattttgtaaaaaagtttatatacacattattttataaatgcatagtttatcagtttgagaaatatgctatcgagaaacaggaaaattattaaaaatttagcccaaaatgaaaaggccctaagctcattgtctcgtcaatccgtcggcgtcccctgaagaaacggggaacgtaatttcggtttgaactgcacactatcaagaaaacaaaggcttccagagtttgttgcttttttaaacgtactataaaatataaagatcattgcatcgacacctctgtacgtactaaaatatcggaacctaaatatctcatcgatgggcgatggcagcggtttctctgtctcaatcttaatttggtttcgattcagagcatatatcatccatcgctgatgatggaatgtaagggagaggatacgatcgatggatcagtggtaatccctccgtcccagtatagtggacgtcctaggataatagaagcaaattatgtttaggtaaaattgaccatattgcccccaaattattacatgcagttaatcatttcaatccaaagagtgcactgccactcctgacacacaacgaatatttcattttgcaattaattaatgaaaggtttgtcccaggcagcaaagcatacaagtactgtaatttgagtttactggcgccaaaacactcctattacatggtggcatagttatctaaacaagcccttgaattcaaaatactacaaacatatgctactttgccgccaaagggtgcccctccattccctacaaatcctcaaggagccagtcaaccagtcacttcccattccattgatcagcttgcaaagcaactccatgcccacaaatcacaatggctatagatttaaacatactagcagatgaagagggagatggaggggctttacctgacctcaatgaagcacaagtcaatctggaggaagaaggagaaggaaggcatgctattgaagcagaaggtggaggggttgtacatccttttgatctcaacttgagggcttttgatcttaacatggaagttgcaggagaacaagaacaagtgcatccaggtatttgacatcatgtaatctttctcaatgcataaatgaaatctttctcagtcaatgcttcaatgcattagtaaatatagttcaaattatactccctcatcagcacgcacccatagaatatgtgaacaaaacaaggactgctactgtacaaagattaccagttatagttgcattctttcaaatgatgccaaatgtgtaggatttcatattcaccaaaagaaaggcacatgtttacatgccaaatatttattgatggttagatggtcacttacttgtgaaattggatttgtgaaagcatatgcagcataactccacctcccaaccccagacaccatatttttgcacttgtttctgaaaataagcagtcactgaattaagtagctgaggaaaaataagaacttttaaaccactaaagatagagcaaaacaaggacacaaaatacattattgcataagcattccagacaccatatttttgcacttgttgtaaataagtaatcactgaattaagtagctgagaaaaaaaaagaacttttagagcactaaagctagagcaagtatgtaattaaacaaggacacaaaaatacattgttgtataagcattccagcaaatcatacctgccatactagcaagatgtatgaataagtcatggttcttgacatggaagagatagtactattgtgacctacagtcatgtatcatgactttgcaaatcctaaacttattcaatgttctttgtgtctacataaagggcactgaccaacaagtaattttttttttgtagataatgatcagcaaggcatgcagtatgacatggatgttaatgcaaatggaaatgaggaacaagaaattgaactaggtaaagttcatgactttatgatcagtgccgaacattttctatccttggttttaggattcaataaatctgcataatctgattagcacatattaacttaccaagtaaataattttgtagacgacgacgatgctttgcaacatgagctagaagccttggaggatgacattcaggattatagtgtgtacgctgatgctatcaatgttgtgctcgaagaaagaggagttgcccgactcagatgaagaagaaaatgatgcaaatgcaaatgagccaatcaatgccagagaattgacaaacccacaaaggcgaagcatttatgaattgttgcttacaaaaagtctggatggatacctagaaaaaggcagcacacgtgtagttgctgaagtgttcaatgtgagcattcgtacagtccaacgtatttggaagagagcacaactttgcattgcacagggagtacaagtcaatgttgactcaaggaagcgttataattgtgggcgcaagaaggttgaaatagatttgtcagttgtagcagcaattccattgcggcaaagaagcactataaggtcacttgctgaagcgctaggtgtgtcaaaaagcacattgcataggttgttcaaagaagggcatctacgacgtcactctaactcattgaagccttatttgaaggaagccaataaaaaagaaaggctgcggtggtgtgttggtatgttagaccatcgtacgttgccaaacaaccccaagtttattgaaatggaaaacattatccacatagatgaaaaatggttcaacgccaccaaaaaggacaagacttactacctacatcctcttgagccggagccgtataggactgtccaaaacaagaatgcaattgagaaggtaatgttcttgtcggcggttgcgagacctaggtttgatgatgaaggtaactgcacttttgatggaaagataggcatttggccttttgttagaaaggtaacacaaccttcttacaagtgctgtttgcttatatttatttctgtttttcatgtttgaacctaacttgtttgatgtactaataggaacccgcccaaaggagcagccgcaatagagaaagggggacacttgtaacaaagactattaaggttgatagagacactatgaaatcattcatgatctctaaagttctcccagctattagagcatgttggccccaagaagatgcaagaagaacaatatttattcagcaggataatgctagaacgcatgtcccaatcgatgatgaacaatttggtgttgcagtaggtcaaatgggtcttgatattcgcctcgtgaatcaacctccaaattcccccgatatgaattgtctagaccttggcttttttgcctcacttcagtccttaacatctactagggtctctagcaacatggaggaactaatagagaatgttcacaaggaatataatgactacaatccaaacactcttaatagagtgttcgtgacactacaaagctgctacattgaggtaatgaaagctagtggagggaataagtacaagatccctcacatgaacaaagagaggctagaggcacttggcattcttcctaaagcgctttgttgtgatcatcagctgtatgagagagccatacagcttctagttgactaattgtgcacttgtgtcatctatgtacatatgcgtctatgtaattgtggaaactagatatataagttgtgcgtctatgtaattgtggaaactaaatatataagttatttgcttgtattaatgttttatcctaggttatattaacaagttgattgttcatatgcacaatcacataaaaagaatagtatttcattatacaagttgattgtattgctatcgaatagagacatagcatttcattaagatgttttcataaccatatttccaaaagatgccaccaaaacagaaccacaacatatagcatcataggatgaactatgcagcccaatcattatgagttcatactttagactaataacaagttggaggtagatggcacactattcatgtcacataatcagaacactactttttttttggttggaaacactggatgtaacctgggatcagtagacgaagcatttccaacttggtgtcatcaatgggctcgtattcttcctcctgtgaataaccaaactgttccacgccaccaaacacatcaccaccattttctttgtcgttgggtatcttctcctcgccgtgtatctcctccttgttgggcatcagtgggttagacacgtcctgaacatatatgaaaacaaatcaaaactaaaagttacatcaattaaatagcagtgagcagtacactctatgttcagtgcttgcatatttgaatagtgggtgtgtgaatgtcatttctaattaaggctcatgaaagaataaaaggagatatgattatctatggaaatctattataagaacatcataaataaaacactttgtatagcacctgtatagtaccacagaaaatccctaaaaattgattcataaatatataatttcatttatttttttatgtacctagctagctgattttgggcatgttcgtgagttcgttgatgtgctcctagatactacaacaaatctgtacctagttagagagaagaaaaataaaaataaaaactcacatccatgggacgcaatagcactgagcctcttgatcttaaatctcgatatatttgtgggatgccctcgagccatgagaggcactaaaatctaaaattttaatagatgtggtggcactgccatggctgcttacaacatgtatataggagatagtacctcatctatgacagtgtgttgtgtgcccaaagaagaggaaacatcattttatttggatggacatgaatatgaacagttggagaaacgaaagaattcagaagttacgtagtagtattaacgaacaggtgggaccatgccatgggggggttaaaagaataaagaagatgagtcggtagtccagcagttagattaaatcccatggctctagattgaggtgacatttgagggatcatacaggtaagaacgtatctaaccaacagatcgaacggctcacaaattccagtgatgtggcttcatgattttgtagctttatagcaataagtaatctttagtggttaccaattatatagaaagaaatgattgctaactgaaagaaatacaacaaaaaggttgtcgggagcttacattcccttttaatcaatacataatgagccttacactattaaatacgatatacagtacgctgtcctatggtgatcaaatggaaaactgggcttaatatgttcaaaaactagcatttttttcaaccaatacaacccaattttcatgtctaaatttaacgattaaaagcacgcaccttgctctgcccgctaatattggaggcctccaccatgatgtgcttgctcggtccaccaccttggttggccattgtcccctgccgcaagtcacctccctgtgggtaaaaagcattcgacgaagtggacaccttcatcgaaccatcgaaccaatcaagtatcaagccaccaccttcatcatccaaatcaggccagaactcgtactcatccaaatcaggcccatcctggctatcaaagattatatttttgccttcttctaataagtagccggatttacgttcaaaccacttgcctcgaatatgccatccgcccctccgggcagcagtccgtgtccctccatcatgtgagtgccccatgctgctgccaccatagatctcaccacccttctcctccactttcttacagtcctgaatcacatcgacattctcctccgttaccccacaatcttgaatcccaccacccttctcctccactttactgcactcttcaatcctaccacccttctcctccgcttccccacaatcctggaattcagtctcgggcacaaactcctggtccaaggagaactgatggtcctcggcttcatcatcggaatcagggatgaactcgaactggtcatcgtcggacccatcttgtgtatccaaaacaaaattcttgccttcttccaataagtgtccgtatcttcgcgagtaccacatgcctcgacgccgtttcttactgcgcatcagggaggcactccgcagcccatctccgtcgtcaccgccacaacccaatctcttgcgtaagcctccgccaccgccagaaactccaaaacccaaccctccgccaccatcatcgctgccgctgccgccgccgccataacccaaccctaggtcgctgtcatcgccgcggccacaacctagccctccgtcgcccctcctaggcttgctactgccgctgcccctagggcctccgccaccaccgcccctggggcctccgcctccgccgctcctggggcctccgccgccgcagcccctggggcctccgccgccgccgcccctagggtttccgccgccgctgaacatgcgcacgctagatgtgttgcgcgtggtgatgagagggagaagccgcgtggagaggaagagagcgcgatggggtgcggcttggtgaggggagggaggatggggtgcggcttggtgaggggagggagaagcggatcgggtgcggcgtcgagagaggaagagcacgcgatggggaagaagaggaagtgcgattgagataaggtagagcgcttgcaagaaaaaaattcgtgtggaggaggacgcgatggggaagaaagagaaaatgtgattgagataaggtagcgcttgcaggaaaaaaaattcgggtggaggagaaaaatcccacgctactggcccacttcttttttttttttggagcactttcgctcttgggacttgggcgcgccaatctttctggaacagcatctacagggtagaacgaccgctatactgggacggagggagtatctgctgcggtacgcgtggcgtcgtgatcgggtcgtcagtggcgccctcgacatgtagcccgcgtggaggcgctccattgggacaccccagtccaagcagcgtgcggcgcacgtgaacagagctaataagagttcgagatagcgaaagcgacgtaccttcgctcagctgctgcatgctgctgctccattatcctacacttctcggtcgccgtgtatcggtgtatgtacatgtaattaactagggggcagacatagatgctcgcctgtatgcgactgtgagtgagtgcatgcaccacaaacgtacgatctccctgacgttgtaccggtggaagcttcttagattaatcgacttctggacgttggatcccccaatagcttcgtcgttttgctcttcagcttatctttttttttttcacaatcacgcaaaaaaaatgtacaccaatatcttagagagaagaattttttttatacacaatgcaattcagtcagaccggcttatgtcagagaaagaaaaaaaaagtaaaacaaaattattatcctggtttatttttagtattggtttttaaatcgtaaatatatttatacaagagttttacatataaaatatcttacggtttataatcatatcagacggtaggcgaaacgatggctggtgcagtggccgccgcgccgatggatggagacatatgtgcgtcgtggtgggatgtaattataccgagggcgatgttgtgtatagaagcggtggatggccgcatcagtggaagcactagtagctatggtagctagcgctagaggcagcaagcttagctgccggccgccggccaggcacgatggacatgcgtgacacaccgcccggggcgcctggtacattatccgatctctacgactcctctcctcgccgagtgatcaccatcggcgctactggtgcgatggaacacaccaccaaccggactacccctgctccctacttccccatccaaagagagctcgatctgagtgcatgtaactacagtacacgtgcgtgtttgctcgctccatcgattagtgccttcccatcagattcagaaagggggtgaaaaacggtcggaaacgatcgaatcggtagcatttcttcgaaaacgatcttcgatcggtcagtaattgaccacattaatacgatgtagaaagaattgtgaaaaaacaacatttaaaaatagtcaaaaatagtatggtcggaaacgatactccttatatagaaacagtgctcgatcgatcaggaatttccgtggccattttcacccccattcagtgcatctttttgttcacggattattgcacacgcatgtgaaacttttgagacggaaatgataggcgaccatgcgtagtacggagtacacgagtgcgcgactcgatcggtggggtggtggccatgccgatcgacctgcgcgccgccgacgtacgtacgtacgccacgcgtgggggaccaaggcgatcacggccgcggggaagagagggaagagagtagcgtgcgcgcgcgacgtgctgtgcctcgcgcgttcgatgggttcgaggagtgcatgtgtttcgaggtgtttcgccacgtaacgtacgggagggagagatgatgcgcgtacgacgcgctgtgcgcgcggcgcgcgcgggggggagggcgctgtcacgggacgcgcctctctggacgacgtgtgcatgcactgcactaccaactggttttggagacagaattacggccggcctcccaatcggctggttgatcgataccctcatcttgatccgtccctgtttggcgccgctactgacgccaactcaacggggctagctagctcaatgatactgatgattggaacaacttggagtctaagccgatatatgttctgttctgatctgtggggattatgctagtagtgtgcatcattcggcgaacgctgtttagtgtttacaactgcgcggctgctggtccctggcttatcccttgtgaacgtacgttacccgtattcgtccaagtgtgtccaatccacactatccgacttgacgaagaattcattctcgccaacagagacatacatttcttagggcgtacgttttttcagcttggtatttctgtttttagataatgttatcgatttctattagccgactttttttaattgttaaacggtgtgtttcattccaaatcaaataaattcatttttaagtttttaataaccaatactcaaataaacatatgttaatcatgtttctttttttatgcgcctaatcatccattttaaagcactttaaaacgcgccttagttgatggtgtatccacacaatcaatgcatgtatcctagcgtgtctaaaagttgggagatttacatataagtaagtgttatttgctcttttgagaggttcttccacttccatttctacgactcatctgtgttcaccagctgcccccggccaaactgacaaaggggaccgcacatttcccgctaaaggagttcatcctctgacacaatcaactttgcgtatcatgattttgtctgtacaaaattaagaacgttaacttctgtacatatacttgagttttctagctctagctaacttgatgtaactttggtctgtgctgagagtttcgtgcacggtacaccaagtttctcggtggcctgcaaaaaactaggcggatgcatcgccggaccaccggatcattgtgtgcatcccgcagaggcaggtgcgtttgtcatcgacgttcatagtatatggccattctgtgatgtgaagtgcaacatgtgctgccaaacgaatcgctactacaagtggttagtttcaatgttgcatggggacagtttgtaccgagcacggcagtagattgtagccagtggtgaactcagaaaaaaaattaccgtagatctaatacatactaattatctaattattaactaatatattaattaatataatgtaatttatataggatttgaataatctatccggtgtcctatgacaccgggtagtatagtgtaggcacgccctgattgtagctagcttgagcgaggacgcaatataggccacgtcgtgtcatgttcagaaaattaaaacgagcaacacacataagcacacgtcgtttttagctttctgcggttctcatttgctatttgtccgactactttggtttgagatatgatcaatttgatgaaaccacatggctgttcatctgatcactcttcgataaggcttgacaagataagcctcctctaccatatcggcatctatcccgggcccaaataaggcacattaatgggtgaggatagaagcacgtactccatccttcgatcatcatatatgtttatgcactaaaactaaggataatttaaatcacattaattaagacatcatgtatatattctctcacaatgtattcatcaattaaaacaccataacaattacaccttagtatatacacattttcttatgccgtattaattgtactctgataaaatccatgtccatacagttatattttgatcaatttaagaaattttgaattccattatatgttgatcaatttggaaaggagggagtaccattttagcaattaaagcaagctaggtcattactgagaaacatccagggtcttccggctagctccataaggtggtgagctagacaatctggtttttagcctcacatcttctaattatttgatattaaatcattcgctaatattcgcgtcttttttgcaaggtcaccaaagcgatctgtggaaacatttgtgaagaagtttgtggagacagtaacaccattttagggcacgttccaaccggatgattggataaattacaggcaaaggaaacacgcttatatatttttttaagatgataaaaaatttaggtctttacttcgatagaagatataacaaatgcactaatcatctcaaataataacaagggttaaaaaaacaacaaaatccagatgaaaagacattatttagaaagcaattgtttgtctaaatctccatccataaatagtggaaattttatgaccatcctctttagattttgacatccaagttgtatgtttccttatcatcctcatacttgtgtagctggactcggaattaaatctatattatctatatagttgatgcccactaacttctaaagctcaatatgcaagtgtaccatattatcacctactagcaattattatataaaatattttaaatcacatgtaagcgtgtattttaaatataatgcaaacatgacatattatttacaattttgttgtatttttagaatacaatatgcaaaaaatgtcaagtcattattttcatattatctaaacatatacatctatcatttttataatgtataacatgcattcgttcacatatatgtaccgcagcaaagcggggagtatcaactagttcaataaataagcaagagcaatatcatgtcatggtttattttcatattatctaaacatatacttctatcatttttatcaatgtataacatgcattcattagcatatatatcccgcagcaaannnnnnnnnnnnnnnnnnnnnnnnnnnnnnnnnnnnnnnnnnnnnnn

SEQ ID NO: 19382 - DNA, 2180 bp, Oryza sativa
aattcgagctcggtacccaaatagattatggacagataaactcatgtaaatgaattaaatatcataaatgctctgaaaaaaaatcatctaattaaagttgatataaaaagcttctgaagagattgtacttaagagaagcatggcgtaaataatcgatatctccattaacagtttagaacatgctcaccagtcaccataggagaggaccgggacaacaagaggaaacaggaaaacggactgattaggaggcaacgacgtgtaatgaaaactgttttattggatttaaatgagaataatgttgccagtgaaggtaataatgattcagagaaaaaaagatcaattaacctttgctaaatagtgattcgactatgtaaagtatagtgactgatatagcagctgtcgttatatatacacactcctgaatagcagcgagaggcaagaatggtcattccacatcatgcacgcaagataacaatgagttagtttcaaagttatttcctcaaatttcaggactccttcagaacctaggatttgatgaaaatctagtcaaaattcataatttaataaaaaaatagtaaaataatcgtgacacaattatttgcatgaatgatctaatatttgtgttaaacataaacatgctaatagtaaagaccacatctactaatatgttcaacacaaaagaaataagcactagattaggataatacctgaaacgactattggccggagcaatagatccgtttccagtgttttgctcagtcgtcatgggcagttgttggtgtagtcaaacgtgagcagactaggaagaacatgagaacaaattgatgcagccccttccatccagaacagcgggaagaaaaagagcagatagcagtcacgcagagaagcgctctcagaactcagaacttgatcgtccgtttacctgtgcagacccttaggaggatggagttcagaatgctcgtatagaaaacccatacgcacaggtcttccgaaatggtaatagcttacccatgcaattacttatgagaacggagttccggatgctcgtacagaaaacccgtgcccgtaggtattctgaactggtaatcactaatagcaacgggaaaacttgatcgtctatttacctgtgtatgtgctcagatgcgcgcagttctttcgaaccgggaggcttaactgtcctcaaacgttgccagtagtgaacagtcgctataagttcaccgccatactctgcttgtcaacatatatgcatataatttacaacccattttaattgagtactaatatttattctacttagcattaattacaagtttttggatttactagaattaaatggacaaagtccaattaattccaacaggatttcggtagaatgtgtagttctattctctgagaataattctaagaatgcctccgttcgaatggaggcataaacgcaataccgctgcatatgcccgcaaatcagcttgcggaggctgtagcacattggttttgttgcgatgaaacgtctgcgtttgtttggatctatcgtttaaattttataagatcacgtcagcaaggctaaccaagtctggaatcttgaaagtaaccttcggccattccaagatcgaaccttgttgtaggatgacttggaagcttttgtgctgtggattttagcccgtggtatttcaccatggattcggtaagggtcggtgctaaactaactactaattaaatatgttcgtatcctttggatcaagggtcgaggcgtcaaacattcttatcgaaagataagctgaattccaaaccatacgcataaactattatctaggtagcagaggagcatatataaacatatgcttagaaaaaaaacatgtgcgcccttgaatacaaaacgtgaggatatgttgcccggtgtctacatccctaaattgtatggtccagaaccagaagttagctgcataataatacccctttcctatcacaaattccagggccggaaaagaacgaaaaattaataaagggagaaacaaaatcattggtaaatacagggaacttctcaattgtactgtttgttagcctttctttatacatgtagaagacttaatttgatacaggaatatctacgaacaatagcactataatctgtactctcaaataacatgcaaacaaagtcacacattgttaattaggattccaaa

SEQ ID NO: 19383 - DNA, 1145 bp, Oryza sativa
ctgttttttttcttagtactccctccgtcctatattttaatattttgcttgcactatttaactattcatcttattttaaaaattttgaaattattatttttttacttactttattatccaaagtaatttaagcataactttttgttttttatatttacataatttttttaataagatgaatagtcaaaagtgtaagtaaaatgtcaaaatcccttatgttgtatacagagggagtaatagtcagtgttgactgctagtagtgttttaactttgatcattattatcaacatgtaattgatttacaatacttcctccgtttcacaatataagtgattctagcatttctcacattcatattaatgttaatctagattcattgacatcaatatgaatgtgagaaatgttataatgatttatattgtgaaacggagagagtagaatagatgaatatgatgtttgcatttttaccatacgacacattttaaaatacggcatatatttttataaacttattgctaaaaataaatagtcagcagaaaaaaaataaaacgtattgtctaataaagtattgtgaaacgaacagattaatagcatcttaatttacctttcactgcatctaatatgtcactttgaatgttgctactccgagctagctaggttcattatgctttgcactaaagcagcaaagcatgcaatgttagttctggctgcctatatatacgaggccatctgacgagcagaacacaagtgcaaacgtgcagcagcagaggcagcaacacctcccctgttcttgctctgtttcctcactctgttggtacacaacaaaaagaagaagcttaattaggtggtttttgatctgatcacgcgccatggtggcgatcacggcgccgagctccatcgagcacatcccgctggtgaggtgccccaagggcgccaatgccgggccgcaagctgtcatcccgtgcatcgacctgtcggcaccgggcgcggcggcggcggtggccgacgcgtgccgcaccctgggttcttcaaggcgaccaaccacggcgtccccgcggggctcgccgacgcgttggagtcgagcgccatggcgttcttcgcgctcccgcaccaggagaagctcgacatgtccggccccgcccggg

SEQ ID NO: 19384 - DNA, 8741 bp, Oryza sativa
aggtgcgtgctgcggcggatggtggtggggtgcgagggcagcgacgagatgctgcgggtgaaccactacccgccgtgcctcctcccgccgggccgcgaccgggacgagtgcggcgtgacgggcttcggggagcacacggacccacagatcatctccgtgctcaggtccaactgcaccgcgggcctccagatcctcctccgcggagactactcctcccctgcccgctgggtccccgtgccccccgaccccgattccttcttcgtcaacgtcggcgactccctccaagtacgtactacgctacccgagaatagagttcttaaaatctacaatagatctggtttaaataagaatcgaggctaaaaaaattttcggtttaaaaagcccaagatacttttcgatatttagttccatatttctttaccagtttacaacccgaaactataggggttacgaactgggagaagaggtatttttcagtagtattagggcttattcactttgctactatttttaaccttaccaagttttggtattaccaaattttgataagtttaccaaaattttgggaaggttaccaaattttagcaaaatttcatatgtacttattaaaatttggtaacaagctaaatgtagctatttttttataactttgtaaaaaaaagtaaggttgaaaatagtagcaaagtgaacaaacccttagttgaaattattattgctctatgccttgtttttactatcatttttattattaacgtatgtgtgtacgtgtaggtgttgacgaatgggaggttcaggagcgtgaagcacagggtgttggcgccggagggggaggagtcgaggctgtcggtgatctacttcggcgggccagcggcgtcgcagcggatcgcgccgctggagcaggtgatgcgggagggggagcagagcctgtacagggagttcacctggggggagtacaagaaggccgcctacaagacgcgcctcggcgacaaccgcctcggcccctacgagctgcagcacgccgctgccaacgatgaggccgcgacgaagaaataaatcgatcaacccgacgactgtgaacaactgtgaagtgttactgtactagtgtagttagctccgtggtactggtagctgtgaatatgatcgagatcgatcgatcgatcgatctatccttgtgttgtgttacttttaacccatttctggtaactaaaggccgccgttgccttggcttgcttggccagcccaaaactggcactggcgagctgcctcctcctgcatgcctctgctgtgcagtagtgcagcagtactcctctgtcctggggttttctgcagcagagcagtggagtgcagttcagtgcagcgttgtgcatgttgtgtaaaatagcttgccgcatgcatatgtgattatgtgctgctcctgtcgacgctgccgccccttttgtagcatggtttttaccggctgggcggtcggcaggtgcagtagtagctaatgatgcttactgcgccatacgagtgtacctatatgtgtgctatatgtgtgctacctccgttccaaaataagtgcagtcgtggatatctgtgcccaacgtttgaccgttcgtcttatttaaaaaatttataaaaaatttaaaaatatttagtcacacatataggtactatttatattttatcatctaatagcaataaaaatactaatcataaaaaaaattcaaataagacgaacggtcaaacgttgaacgtgaatagtgcaaaactgtacttattttgggacggagggagtataaacaacttaaacaagaatgtgtagtactccctccgtcccacaatataagggattttgaatttttgcttataacgtttgaccactcgttttatttaatttttttttgcaaatataaaaaacaaaaagttgtgattaaagtactgtagataataaagcaagtctcaaataaaataaataataattttaaaattttttgaataagacgagtggtcaaacctcgtaagaaaaacttaaaatctcttatattatgggacggagggagtaactgtattatatatggcttttacctatactttcgaaatgtgcacgtcgatcggttggtaatctttatgttattggatctcgtcttctgaatgaggtcactctgcgttcgcaaaaatgaatgaggtcactctgtcgtcgatgaattcaagtaatcttccgtgtatggattcacggatccggcgaatccgggccatccgagcatctctcgatgtgatttgggatcgatgggaatcaccactggcggcaggtaggggcccgtgcctccctctctcactcgtgttcttgatcttttcctaggacaaactttgcctgaacgaacggaccagaaaaaacggaactgatgaatgagagcctgacttcgattgatcgggtaggtcgggacttgtgccattagctagcatactactgtagttgctaataaggcttatttggtttgaagcccaatttatatcatatcaaaatgtcggtagtgttaaaaaagctagagaagtattgatactatcaaatttattagagtacaatttataaatttgatatcaaatcaaacatccataaaatatattagtaatgaagttatcaaagatttggttaggcatagattggcctcaatcaaacaagcccatagatctctctgtagcttgtatcatgagagacagggaagactagttaattggagtactccctatgtcctataatataagaaattttgagtttttacttgcatcatttgaccactcgtcttattaaaaaaaattgaaattattacttatttttttatgacttactttattatccaaagtattttaagcacaactttttattttttatatttgcacaaatttttttaataagacgagtggtcaaacagtataagcaaaaaatcaaaatctcttatattatgggacggagggagtagatacgtaccagctaattataagtaggtagtcagcatagctgcatagactatggacgaccgatcgaccaccgtcatttgacctggacgacacgagagccagtaatcacgggccaggttacgttgctttcgagtttcaacgacataccggataaggccgtgtgtgctcgaatctattctccaagtggcaacagaatattactgcatgcaagccatagcgccatagcaacaagtggagtttgtaccatgctagcgatgcgttttgtacgtcgtgcatgcatcgccccgcggcccttttgtttcccatgaattaatccatcagttcgcaagctggtactggcgactcgtacaactcacctgtacacgtacggctgtaatgagattattttgcctcttttgagataggttactgcgtgttccattgggagtccgtgttccattcgaatctctatcccttccggtctactctctctccctcttgtcccaaatactatatgagtattcaaattgttccttatcttacaccaagcattaattctcccattttcgatcaactcacacttaatgacacgctataaatctataattttttcgtgaaccttaattctcctaaatgacgtacaaatgcttatagataaaaacagagggagtaagatttatgtcgtggcatcatcctagaggtggtaattaccaagcgagcatcgatcctaaggtctgattttagataggtgtggacggcggtcaagcatagcgtgttgtgctggatggcttcgcgacactaggccgcgtcggccaacgggaagttcgacggtttgcggaagacggttgtagtgcggcatagcagcatcacgacgcattagaggcatgcagaatgcgacggccgacggcgacgcaaggggattcgaaaagttacagcgaacaacatacacgaaagtttagcaccagatggtggttgcgatccgcagaggtgaagatggtgcagcggcggatagcacatactagttccgattatccccttccgcgctctcgtgctgtgacgaaaagataagtcactaatgaagttggaagctactcccttccctccgtcccaaaaaaaacttaattcataggtttccgtgtctaacgtttgaccgttcgtcttatttaaaaaattatgaaaaaaaattaaaaagataagacggacggtcaaacaataatgttttatcatctaacaataataaaaatactaataataaaaaaatttcatataagacggacggtcaaacgttggacacgaaaaccgaagaattcggtctttttgggacagagggagcaagtcactaatgtaggaggtttagagtttaaaaactgtgcattgtgtttttttataccctgtgtagatatagagattaataaaaattccaaagaaaaacatggcgtggccatccagttgcatgcgccgtggcaaaatcggtctcatcacatggtagagtacagcctcccgcacgcggtaccgggacacgcctccgtcgcggcccgggcttgccctggtgcacacgggacgcccggcgcccgcgcgtaagtgggtcgggggtgagaattgtattcgcccacagagtgcgatctgcggatctcctgtcaccgcgcggcccggagtgcgcacgggaaagatagcctgcaggctgcaggttagtgtgtacgccgcaccgcgcgcgcgcggggccttcgcgcgtcgcgtcgcgtcggtcgctgcgggggcacgggggttaggcgcgcgtacgcccataccagatatagcatctcgtcttgtcccgcccgtggatgggcaatcctattgccggttgatttttttactcctctttttcttccgctcttggttaatttgctgcaatttcggaggcgattttgggagctcgatcgatcgatcggatcgacgtgcacatgcatgcatgcgttggtataagctaggtagatcgaggaggacatgtatggcttgaatttgaatgcactgtcacgtcgtatcgtatcccgggaggggagggcagggcaggcaatgctatgcatcagagtatcaagctgcgccagaaacaagctcaagcaatgcaagtggggtgtactctggagtctggactgcgacaagagccagatcgaacttttcggtgatcacgaccaacgccagaacttgcggcctctacaatcatttcgaccccgtttagtcgtcgtcggtagagatttctttccggacctcctgccctaatttctcccactgatcgaccagatctcgtatactcccagtgatcaatgagcttagggcctgtttgttttccagggacttattccaagttcatgtcacatcggatgtttggatattaatttggagtattaaacatacactaattacaaaacacattccatatccttggactaattcacgagacgaattttttgagtctaattatgtcatgattttgacaatgtgatgctacagtaaactttttataattatagattaattaggcttaaaaaattcgtctcgcggattagctctcatttatgaaattagtttttttattagtctatgtttaatactccaaattaacgtccaaacatccaatgtgacatgggctaaaaagttttagccccatctaaacacccccttagtgcatggcgcaacttgtggattgctagtcaaatgcacccagcatgcatgggagcgtaaaaggtgcatggttactagaggtggagtactaggtagtagtggcagcgagtcacatgggaataataccgtttccttggattagggacgtcattactgaagatggagcaggcagtcccccacctgaagattcactttgtccagcaaaaggcacgaatcaggggggccgctatccaaaccgtacaggattccaaacagtccaggccatgcatgcacctcctttttcctagtagaaacataggagtaattctcaatttccctgccaatttcttacttaaaaaaatctatagttggacagtgtttcagaaatggagcagaaaactggaatcggcatagattctaccgacggaacaacatccgtaattatttcgttggattttttttgttacataacgtgagttatatttagtttctactacacatgttcgatgaccacaaaacggctcaatttggatgaattttcagatcaatgacctttccatccaacattattactcccgtcattctataatataagagattttgaagagatgtgatactttctaggactgtcaatctggatagtctcatgtccagattgatagtcacagatgtcacgtccctctaaaataacaaaagcgagcaggcgagcacgcacatgcatgcgctggggttgtatataccgtttacaccagcttagcaggatatagagtgtacagatcactgagcagcgagcatcagtgaccacagaagagaagatggcagtggcacacagagcgtatcgctttctaacacatttctccgacagaaaaacagttgtaactgaaagacgagcactgttcactgttcagtattattcacctcaccaattaaaaaccatacgaaatcaatcatgcatgcattcgcatcgttcagctcgtccgtgataaagctctagagatttgccgtgcagacaatgaccgctggcgccgacgcgtaccatggttagtttattgtcaaaaactgccgcgaaaccatggttaatttgctcaagaaaactgccgtgaaaaatggctcagaaccaatagacgtactaggcggagagaatctcaggtgcttattagtgccgtgctaccgtgttgtactaaacttaaaaggtgcataaaaacgtaatgaaaaatattaaaagatttttttcacatttcttttgactttgtttttacactttttaagtctagcaacactatagcacaacactattcggtagctcctaaaattctctcgtaatataagtaattagtactacatcgagtataggttggagagacgtctatgctatgtatggtgtggtgtgagcagggttttacgaggaggagcttatcgcacctcggtgtaagtcccataaccgtccaattatatcgacgaacagtaaaagccgaaagaataatataaacatttatatttttgttaaattccttttgaattaggtgggtttatcatgataaaaccggttaccgcattaagggaaacccttgggtgcgagagggcgaggctggcaccacctcgtcttgtctgcctttggggagctgccatgaaccaatgcgagcaagccgctgtgtacctgctcctgctgcagctgcagctagcgcgcgattcgatcgatccccggccggatcggatgctctccggttttgtccccaggggaacaatgccagagaatctctgccgttcgtgccaggtgtaagtggcagctagctgggatctcatctcgtctcctctcctctcctctcctctcctctcccgctctagctagctttcgcgaatccgattggacttgtcaatgaaggaggcacatctagcaagacttttcttgccccccgatttcaattcgattcatttcatctcgtgctagcaggtgttggcgtacgttggtttcagatgagagatcgatgcagcttgctagctagcgtttcttttccctcgtggggtgtatgcatgacatatcagcatctcccatcgatcccattcagtcagctacatatcttagcgccagccggggcctccgagagtgaaggtgcgggtgcatctctcttctatatatctctctgtaacacatggattttgtttacacctaaatttaacacctatgaacgaaatataagaaaattatcaaagtttagaaagtgttgggtttccttcacagagctgcgattgtatttgttgacttatatcacaaaaagttaccaacagttttatacacggtcccgagcgagcgatagctagctagtagctatactggttgaggtcctagcttgctgcatgaggtgcaggaccgatatatgccagagacaacgaagggtgaccaacgtctactacaacattctacaggacacatgttaatcgtgaggaaggatgtgtgcgtgtatgtgttgtcagaataaagcagtgctagctatatactactagcacatatgcagttgtccaaaattcgttggaaaaagaatataaacagtacagccctatgatctggagagttagctagctagccagccagctctctggaacatcatccttagccggaccacaacaaaaaatttctcaagtgatggagctgattgggcaggatcgcatgaaacccgtgtaacacgtacacacagcgcagcagtactgcaacataacttgcagcaaaaagcagagatcgatcctggtagggtacaagcagttgtttgcaatttttttcgaacgcgcaaaataattacacgtcaatatattagaataaaaaaaatatctttttttctatgccaaagaaaaggaagaaaagaaacaaaaactgcagctagacaaaaaggaaagagaaactactgaggataaaagggttgaggcccagttgtttggttgacgcagcccgccagaaactggaatggccttgtagcccgcgggcccacgcggcctggctggccgagccggcctctgtccaaacgcacggtctcgtgtgcatctctcgcgcgattcgccggcccgcgcgtatagcaaccttccacccaccaaccaggccaccgttttcttcggcccctcccggctcccgtgtcgtgccgggcgcggacggcagcaacacggcacattaccatcac

SEQ ID NO: 19385 - DNA, 3670 bp, Oryza sativa
gtcggtggctgatcttaaaccatagtgctgacacgctggtgtcgcgatgtatggtgctgatatttttcctggccacagtgtcatctttttcctggatgctagcctgctacgctgctcttggtttctttcctcctggctctgagcacgtatcggagctcctgccgctctcaactctgagcacactttcaacaataccaaaacttaataaagatataaactacatacatttcaaccattgttgcctactcttaaaactcttatcaaaatttgataaagacaacaaatcatatgaagacaatgctaccaaattttaaaatgttgattcagacaacaaagtgaataagccccatatcttcttgttataaaatccattgaagatttcaccaacgtaacgatgaaacaagaactgagaatgaaacaaatgcaaatattataactgccggctggggtatgaaacagacttaaaaagagcccagctatcgtttgaacagaaacaagacgagttaactgggagcagcggagcacatgcacagggcgactagcaacgaagcaaattcagatcagtaacagtttttggctaagcccttgtttagttccaaactttttcttcaaacttccaacttttccatcatatcaaaaacttttctatacacacaaacttccaactttccgtctcatcgttccaatttcaaccaaactttaaattttgatgtgaactaaactcaccctaaaggtgagtggcaattgagggagccagaacatccacaaactactactcctccctccgtcctataatataagggattttggttggatatgacatattaggatgtgtttcattcacctaaaatcctttatattatgcaacggagagtatatattataaccaataacttcaactgttatcgtttggtcgctttatatccacagcaaaacgcttcaaaattactcttgcaaagaaaatgccaaattatatccaatagctgttttgatgttgtgtcaacgcaacatcaggggcttatacacgattactgttgcagaatgctcccagaacttccgcagaaagttgctactcctacacgattcaaggcgatcaacaacgacagggaaagattgcaacaccttttgtcgatacacttttttttaagaaagaaaaataaaacaggaggtcagagttacatgcctaaaatgtcaataaaacaataggtaaacagattaacaacccacaggcaccaatgtcaacattgctttacactaggaacttctagtcttcaatttccatatactaccaggctacgaactacaatgaatcgctgccaagtgccaaaccagtcttcccatggtcagcaaggccatctaatgaacttcacactgataatctgcaccaaaaaaaaaaggggaaacattaagcaatcaatcgtgctagtaaatagtaatgaccaaatgggtgccttcatcacgtgcaacaagaagaacatgatccatttcaatagattaagcattttcaacagtttcaacagacaagtcaaacagacccctagagtctggaagtctattttatctttacctgcaagattcaatttatggtatcactcttgcatttatcacttgttactatattggtttaaattttatccagcatcttcaagttgtagtgacactttacaggaatagtagaacacaatggagttcaaccaatgatcaacaaagctcctcacggaatcataagatagccgagaaatatggatgctcaaaaagaacagacataaaaacatatgtaatagaacctgtccattccgatatgtctaacagaaaacacacaatacatactaacaaaggtctcagcaccaatttaacagagatagactagcaataacatatccaatgtggcttgtatctactattccagggccaagggtatgaattatgaaatattccatcatgaacaggccaggttgtcggtaaaagtctctagcgttcatgtgataattttgtctgttggaaaaaataacttcaaatctacaaaccaacacaccaatctctgcacaactgtcaaatcaaacttttccaaattgtgttgtaacaggaaaataggttttactatgcaatctaatctaccacaccagtacagacattgaaaagtaacaggcgtagcacatacttgagctcaaatgtttgttgtcaaaccatgcatatggaaaatgcaccattcaaagccactaacacactagcataaatgcatatatgttcatgagttattaagcccaatcaagttgcacttgaccttgcttcaaccttagcgaacctaggcaatcttgttcaagtttgtttactcattactaaggatgatagataatatatcatcaggacatttgtatttaccaagatagatgaaaatgccaaaagaccaaatatgtgtcatgctatcattcatgattggattaatgatacaaaatctaacaattagagcagctcactaccaggaacaaatgcaatgttaaacttctaactattgaaattcaattgcatacggggattatatggggggattaaaaatcctggcccagacacataatattcacaaaaacaacctttcctgaagcataccaatcttatcatcaatcaataaaaacatcatttcacagcatccccatcccacaggactatatgccagcaaatccaaagcacatatatataactacagctttataatattataactgaacaattatctattatccacaacaacattaattgaaaacaaaaatgctaggtcggtttttacctcaacatctcctcagcatcatatgtaggtggaggtggagaggaaaggcagcgcagcgacagaggaaaccaattccgctgcgccaataccatcgggtgcagtccctgcatgcttcttgatgcgctttgccctggcaagcttgacatgtgcatccacaaagttctccatgcgcttgacctccaactgcttcaggaagtctattcgctgccgctcaatctccagtgcctgcttttgcttcgcactctccacacgctcatacatctccgcaaatgcctcgatcgcccttgccagctccctgaaaccaccatcaacttcctgacggctgcgcttgttgctattgccggagcgcgatgacacagattgcgacggtgaccgctgcgcgttgtgattgttgttatcgccagggccttcagagtcctccgaatcagacaccgcggcagcggctgcagccgcggcctcctgctggataagagcggcggcggggagcggagacccgcgacggtagctgggcagcggcaacgccataggaggcggcggagagggcgacggcgaaggcgaggggggcttcctcaccgcggaaggatggatgggcatggcgaagtaagggggcggcggcaccggcgacggcgacggcgagggcctcttggaggcggaggcggagagggtgggcccgacgaggcggtcgagctcggggaagaaggaccaggtggatggcatgacgcgggcgcgctccgccttgtacttcttcttgagggtgtcgacgcggttcttgcactgcacgtcggtgcgcggcgggcggcggcgcgcggccgccccgcgccgcgagttgacggcgtccgccacctcctgccactgcttctgccgcaggttcccccgggtgagctc

SEQ ID NO: 19386 - DNA, 5333 bp, Oryza sativa
  unsure (1)..(5333): unsure at all n locations
nnnnnnnnnnnnnnnnnnnnnnnnnnnnnnnnnnnnnnnnnnnntttaaagatacttctatgctcagagcataatagtgatttacactgatcttaaagcggttcggcaattctggaaccttttgtattgtgtgcgtaggttgttcggttttttgctttcatacgagtaacgtgagccctgaaggggcggaggacgcattgccaccgcgcgcgcgcgagaggccgggcagaggcagagacctcacgcgctacgcgttgcatctcattctcgcgcgcagggggcttcgcttcgctttgccccggaagagccgcaggatttcctgcgtaatccaagggaggaccggccgctggctgctaccgtgctcgctatgacctactccagctactcccaggctacaggccatgccatggacgagtgcccggaccggacgacagcgagcggcagctagctacacactagtacgtagttactgtagtcccgcgtcgcacggcatccggccggcctctcctaactccgccggttggcgggcgggtcggtggacgacgcatcaaccgcgcacgtccttgcgttggcccgacgagtgcctgccctgcaaagcttgcaaagggttcaccgatcctcgtaccaaattaaaatccgctcactagcagcataatcagatttcgtggagcctatcgataaaccaataaaaaccgataaaatctaaaaaaagatttagataatggaaatggattacatctccggtctctccatgtgaaaaatccaaataaatttgattaaaaagatataattcagttttattttttgaacttgactgaaaaactaagtggtttgtgtttctcacccgctctgaaaagtcctgattttgcgaaatccaaaccggatttcactaaaattgtggatctgcctgcaactagtaggctggaaatgaagcatgatcagtagggaaaactgatgcaccttcagtaaccgttcgggcagtgggccgcgcgaaacccagcactcagcactcagatcatctgcattttacagtggtcttagcactgagtacaatcaagggagctcctgccaatgcatatgcaggttttacggtacggcatccatgtgtgcaaatcatcatccgcatgcaagggtcagatcgctctcccaagtcagtgaaggtcacagtgaaccttttccggttcataattgcccggctagccgccgggagtccggtctaagtcgccgggtctgactctgaccaagatgttcgacctcgacatctgactgcaggacaatcaatatatctttggaccaacccaatgaatgaattgaacttgataacatatccaagctaggattaggagtatataaaacagcatcaatgtgagacttctcacaagtcacaaccccgcctgaactgaatctagtgtagtgaagacaggagtggctaaactgcatcccggaaatgcttgggaggaagaaaggatcgtcgtccaggttgagtgatcccatcaacacgactgtcactactgataacggccaggaaatggctgcttcgcatttcatctcgcagcaggcttcacagctcggtaggttcaaacccccgcttcaaactttcaatggacgtttacattgttcccggcgtaagttgagcgataagagagactcatagttcttctctcctctttgtcagatgaggctgcgaggaagagactgcaaagaatgaacgagaggctgaagttgctggagatgcagatggaaacactggaggctggcgtcgcgaaggcgagcaatgactcctacgagtagagatgtttagcaatctttgttatagacaccaggtttggtgacatgcaagcaaaattagatgatagcttgagtagttttacctgaacttgcagcaaatcaccgtcacctcgttgtagaattccggatctgtttcaggtttcagcgcttcagttttgttctttcactacgagccaataagctttagtgcagatgtcattcaagttttctgccagaaggaatttacagaatttgaaccataacagccgccatgatgatatataactctggttattgttcactttacaacagtataaaaaatgatggactttctcggacaacaatagatggacaagggcatatttacattagtccctctttgattgatttcaaaacacaggctgagcctgatttttttttcttcgcctcgactaatggtacgtttctagtaaataaatacagatgcagtaccatgatgcaaaccaaaataaaagatggccatggtagcagcccaatagaagagcttcagcagaattgaccaatgaagtatgcaaccacgctgtgacatgattgtttactcacaagctagtttagtaccgaagctgctaaggcagatggcgaaagcctgaaacgccgagagaggttggcggtaatccatagtgaagatattgctgtcaactttcccaaactgcaggataactgtttcctcgtctccaacgctatctggatggctggggtcagctgtggccacaagctggaaattcttcacggatgcaactgtcactcgcccatgaaagtttaagcaccagcactgcaagtgctcatgccagcggggagctttgttccttaagacaagtggttcctgtgcacctcaaagattttgtcttgagggaattctcccaggtttcttgagttgaagggcattccattgtgcaaaacatcctcctaggtcccctagatttaagaaggttgtatttgtatgagatctgcccaacattgaagttgcctgccgatatttgggggcagatccgtctacttccaaaacggtgggtacttccaaaacgctggctagatcgagtgcttgatgtttttgcatcatcgtatggcggctggttgtcatatatcttgaaatttgtcccccaaaaatcagacctaaaaatggtgcagcagaaacacaatcaggtcaaagaggaaataataaatgcaatggaagtgcgtcaaactgaacataagaagcacttctccaaactgttatcgccaagaaatagaaagagaagacagtaatatgacaatgcatgatcattttaaactacttaatgtaaattccaagcaagtagcaactgttggtttaagtaccaatccagattccacaacaccaataaggacatgtaagagagataacatgaaagacttgcatatgctattcctgagaaagacttgcacatacagatacagcgcttccatgcataagcctgccgtgctgtaagttgtaaacttcggaagcgttgtacaggagctttaagctcctgtagcggaagcgttgtaaaggagctttaagctccgaaagctttgtaacagatgctccttttcccccttcttaataaacttcggccagctttgccagccaggtgaaaagtttcccttttcaagtcttcaccccaagagctaaggtgaaatataggtacttttcccacaatcatgtacagaacgtacaatagtcccagcacagtaataccaataaatttctagatcatgtattaatgaattggtaccacctattaattacacttactaaatagtatttagaagaatgtttatgtgcctgtttcttggtagaaaaagacaacagaagaaaacacatggagcaagtgagcaagagcaatggaaggtaaatgataactacaggatgcgcgaaagctacctcagtttccccacatatgcattgcttccttgtgacaggtcatcagcatcaagggaaataacatactctgtgtggggccccctcctaaaccttctagcggccatgagaaacttccctttatccatggtacctgttgaacatgaaataaatagataatcagcaaagcatgtctcatgaaaaatcccatttatcatggaaatcaggaaagaatatccaaaattatccaatatatgtctgcttatccagcttgtgcacatgatgtcgtattgaattataaatatcacaaatgcactgcaaacaaagcatagaaacttggcagaaatagaactagcaacataacatttgatataagaggaatcaaacaggcaagcaggtacacatgtgactgccaataactagtgagtagtgacatcagcagcagacaggagccatacaaacgtattatgtgtaagctctcaagtcattgaagaatgtacaaagcaattcaaatacaagatgattcagtggcaataaactttgtatacaggcattaaaaaacctggctaaagctgatgcagggacaagggaaaactattccaaccacatgtgaacctaacaaaccagattgagtcataatacatggtgtttcaaattgaagtagcagtaagtgaaaaacgataatgcttcaggtcattaaggaagcacttgcatgtttggattatgccttagaaacataccattcaacaagcctaggtaaagatagaacatagatttcttcttgtttcgcttgacgaagcactggattgggaagtccttagggcctggctgctcaaacaacatggaatggagcaaaatggtgtcagcactggatatataactgaccaaaagtgcaaatgcagatacctcaaacccactcttcaagttgtaagaactgtacaaatatccacatagcttatagctaatgagctaaatatgtgctacgctattcaaccccccccccccccaaaaaaaaaaaagagagagagagactagataatccttcagcgtgccacataacgaagattataggcacaaacctgtaactactgtcctaataggcactaaatctggtcagaactgaactttctgcataatcattagtcacctaatattagtgaccacattggaacttaaaaacagagatataaagcatacatttcccaattgcaagtttcttccctactcctacatactagcaaatttattaaaacttaaaactaatattctatttctcattcccaaatcctattcgaaccccagaccaaataccggatcggtggagtactagtgtacacacagattatagaccatatcgatcccaatctgatctgccaaaaatcctacttcacaaaactggtatttctgcaaccctgcaatgaatgagccctagcaccaaatagtactaagctaattaaatcaacgcctaagcaaggggccacacctgcttgagcgatgacgggaaggtgattctgccggactcggggagcggccgcacgacggccgccgcggcctcgcgccaccggcggcagacgcacgcgcacgacacgaggtccttccgcgcgggccaccgctcgccccccgacgcctccacgcgccgcaccacctcctccacgagctccggcagcag

SEQ ID NO: 19387 - DNA, 2101 bp, Oryza sativa
  unsure (1)..(2101): unsure at all n locations
ccccctccccctcccccaccgccgcctcttccttgggctcccgaaccgccgccatctcctctctcctctccctcgcgcgccgtgtgctcggaagaagcactcctcctccgcttgtctcggagaagcgaagcggatctgcgagtggtgtttggcttggctgcgggctgcggtacgcgcggtttttgtagcgcaattttgacggtttcgtcttgcgcttctagaaatcctggactggtacgggcgcactctctggtttgtgtttttgctcgttggcccggaccgagacatgtcgacggccgttggattcgaggaatggacgttgctaaagatatggtaattaaaaattaaaaaaagttaaaagttgctgattaatttttttttacttttaagatatggtaattaaaaatttgctactcaaagtctataatgtgtgtccttatgtgtccatgggtctagttgtaaattcttaattattatttcatccgtttcacaatgtaagactttctagcattgtccatatttatatagatattaatgaatatatatatataataatgtctagattcattagcatctatatgaatgtggacaatgctagaaagtgttacactgtgaaacgggggagtatatgtataagagtagcaaaagttaaatatcttgtagtgaccacctcggatgctcccgatgagagttttcaagaaattcaaaatttactagtagtagtatgtgaaatgtacaagtccgttttagatgtttgaaacggctaattaaccgcacgtaaaacaatatataatcaattaagtattaatatataaaagtttgataaattttctaaataacttatatataaaagttttctcaccgtttaaccgtttgaaaaatgtgccaacgaaaaataaggagtaactaagctacaatagcggaaaagaacatagccttaaatgtatggatttcatttgaattttattagctaaattttctactactttcgttatagaatataagaatctatatagaatatgacaattcctattactataaatctgggtatgaaacatggtttgagctcttttcaagatccactgtgctaggaggctggatggcaacacgatggaattgtgcagtgaaagagagaggggtcaacctcatactccacttacatcttcgctccgtgcagctggcggccagctgctggcccctgacaccatttgattcgcccaccttattttccttgggctcctccgtttgattccgcttctggaagaatcagatttgcctctgaatacatttgtgatgttgctggaacgtgtccactgactcagtggagattatctgtaatactgcagaggatctctgtcccgttaatttggtgttactttctacttcctccgtcccagtaaaattgacgtttcaacgccccaggcttgtctcaaaaaatgtgtcgctatacagagaagaggcactcctggacgccaaagcaagtttaattgttgattcaaatttttgaatatattaatgatggctttgcccctttatcaaacgtgtggccaaggcgccaatttatgtactccccgtaacacgtggtagtgagttgtggttacttcattactgctggaaatatcctctagaatattcggagtgcatgtataaatgctggaaatgacagctgaatcaaatcatggatacaatttggtaattttgcacaacagctaatcttagctactaaccttaaaacgtcaattttactgggacggaggaagtactactagtagcacagtatcttgtgctagtgccactgcttcagaaaaaaaatgctggatattgcgctgctgttgatcacctacacatggcttgtgtacatcaacgggagagtcagagtgatgaccaaccagtttgctaccactagttcttagcaaatcttcggtgatcggtgcacggtaatagcattgattaggctatgatagtggcctatttgattatggtactaacttcttcgatcttctgattccaattcagacttctgaaagtctaaacagttgnnnnnnnnnnnnnnnnnnnnnnnnnnnnnnnnnnnnnnnnnnnnnnnnnnnnnnnnnnnnnn

SEQ ID NO: 19388 - DNA, 4175 bp, Oryza sativa
tggaaatatcctttaaaatatccggagggcaaggtataaatgctggaaatgacagctgagtcaaatcatggatacaatttggtaattttgcacaacagctaatcttagctactaaccttaaaacgtcaattttactgggacggaggaagtactactagtagcacagtatcttgtgctagtgccactgcttcagaaaaaaaatgctggatattgcgctgctgttgatcacctacacatggcttgtgtacatcaacgggagagtcagagtgatgaccaaccagtttgctaccactagttcttagcaaatcttcggtgatcggtgcacggtaatagcattgattaggctatgatagtggcctatttgattatggtactaacttcttcgatcttctgattccaattcagacttctgaaagtctaaacagttggtccatggggtaggttaggttaggctccccatcagctaaattatcaggaaaaaaccctgtactagtggtacaacttattagaatttagaagtcaacaatatggatgcatctgcttaatttgctttgtccctgtcaattgctgcgtaatttcgattgcctcatagcactaattttttgaatggaacacgcagcattatttttttgaatggaacacgtagcactaattaatcttagtgtctgtctcgaggacaacgatgagtactccctccataattgtttaggacaatatttaaattaaacattaggaatataaatcataaataactatcaaattattaagtttaaaaatataaaaaatatatgaataaatttgtcttgaaaaatactttcataaaagtatacatatatcactttttaataaatatttttatagaaacatgaaatcaaagttgtgttttggagaccgtgtcgctgtccaaaacgactttctttacgaggacgaatggagtatttatccagtgcagcggggcctgagttcttcgtcccagcctcccagggaggtagcagcccagtcatttccttggttttttttggaaaattccaagagtctctatccgacgaagtagcattgcaatggcaatgtactcgctctgttttttaacatatgatgacttacttttatcattgaaaacaatttgagcatgatttatattctacatattttaaagttttgaatagcgtgagcaattgaacgtatgtctacaagttaacaaggtcgtgtatttgagagagcgttacatgagccatacgtaaacatatgattatggtatttaattattcgtattattaaaaaataatcattatttatttttgttttattacgacttactttactttagacatgacgtatacttttatatacttaagaaaattgaatgagataaatgatataacgtatgtctaaaagataatgatgtcatatgttaaaacaaacggaaggagaattatgcgagtcataaaaggtctcaattacatatgatgaggacaaattcaggggtagcgtcattgcccgtgaccatcagtgcagccgttggcaaaaagaactgcaaccagcaatccagcatgcagattgcagagtggttgcttcttggctatgattacgtggccgatttttcaaacgtgagattagcgtgtactaagtggagttgcccatggagataacgatgggttagtagtctccgtcttcgtcctcttccttcttgtttaataatccctgcattaactgatcaacacaaccgagatgtttgacaaagagagaagaatacaagggaatgcagtgaaccaagagttttacccattcctcctgtatccagtttagtcgttgcagaaaaatctcccccttttttttttctttatctgaagatttgctcctggttcttcaactactaccaagaatcgagctcctgttgcttcctctagcctctgtctagtctgaagcctgaacccttgcatgctccagtttctgcactgtgtgagcagaattatttctgaagtctgaacagcagccaagcaaaaggtatgcgctttcaattgctttcgaggtgatgaagtatcttcagttccctatctgtttctgaaactgaggttgttctttgcctgatcttggcagaaggcatctgacagtaagatatgaacacctgtgtttcaggtgaatttggctgatgattctgcccctgtgttctgatttattcaagacactagcaactgaatcatcaggtgttggtcgcgaatatcccagtgatggattcatcgagttctttcgtgctcgtggtgctgattctccaagctgtcgtgatcggttgctcctcactggacgagctacccgttcagcttagcaaccggaggctacttcatgacagaaatcacgctgctctactctacaaagatcatttcccaacagttggaaacatgacgtttccaacatctcatcaactgcaaaatgatccaaattacaagcctctagatagttcatcccaccctgccgaggcttctgcaaataaaggatcaagcaaaggattcaagaagtggctgtatatagttgtgattccagtggctggtttgattatgcttgctggcatggcatggatgttcttgccatgccgcaagaaatccgttgcgactattggcccttggaggactggactcagtggccagctgcagaaggcatttgtgtcaggtaatactgcaatatttgccattttgatttgtaatattttcttatattgttctgttacatcctattcttataacggtaagttcttgactgtgttcaagtctggttttcagatcaaatattcatgttgtgtttctggttttcactgtgttctgatctgaatgtgcttcaggagtgccccaattacagcgtccagaactggagcgtgcttgtgaggacttcagtaatattgtggcaagtcatccatactacactgtctacaagggaaccttatcatccggtgttgagatcgccgttgtatcgacaacgattaaatccagcaaagattggtcaaagcactgtgaagattgtttcaggaaaaaggtagtcataatatgtgtactagatcctcaactaatccttttgcagaattgcattagcatgaaaaaatttaccttttttttcccttgtgaacaagcagatagagtcgctctcacgaataaatcataagaatttcatcaatctgctggggttttgtgaggaggaagaacctttcacgagggtgatggtgttcgaatacgcaccaaatgggacgctttatgagaatctccatggtaaatactatgtgaaagttattctcattgttgcaatgaggaataccaattttttttcttcacattcaagtgataacatgctggtaaattatttgtgcagatgaggcctttgatcacatcgactggagaagtagaatgagaataatcatgggaatagcttactgtattcagcacatgcatgagctcaaccctgccaacgtgcaccctgatctgcattcaagtgcagtatttctttctgaagattgtgctgcaaaggtacatatggtctaactaaatccttgttatgccttatggtttatcaagaattaggcatcttagccatattcagttgctatggtttcagtagttcttttaatgtccttctgatgtgaaggaggtttagagaaaaacgcagtttcagtacccaactttattcagtactcagtaaagtacagtttgatgctaaaatctgtatcctttcttcagattgcagacttgagtgtttggcaggaagtggtttccgacggcaaaaagtcgacagcgaataatgatcatcatgaaccaatatctgctagactggcagggaacgtttacagttttggcatactgcttcttgaaatcatctcagggaaacccccttactctgaaaacgagggctccctggcgaatctggtaatcacagcagcctgcaaagtcaaatgcttcaacagtttaacttacacaaaagaaatccaattcaacatcagattaaagaaaataaaactgttttttatttttcttatcttacaggctttggggtgcattatcaaaggtcggagtatagcctccatgcttgattcagtactagagtcacacaaagaaaatgagctagatgtgatctgtcagataatcatggaatgcatccagagtgacccaacgaagagaccaggcatgagggggatc

SEQ ID NO: 19389 - DNA, 2902 bp, Oryza sativa
cagattgcagacttgagtgtttggcaggaagtggtttccgacggcaaaaagtcgacagcgaataatgatcatcatgaaccaatatctgctagactggcagggaacgtttacagttttggcatactgcttcttgaaatcatctcagggaaacccccttactctgaaaacgagggctccctggcgaatctggtaatcacagcagcctgcaaagtcaaatgcttcaacagtttaacttacacaaaagaaatccaattcaacatcagattaaagaaaataaaactgttttttatttttcttatcttacaggctttggggtgcattatcaaaggtcggagtatagcctccatgcttgattcagtactagagtcacacaaagaaaatgagctagatgtgatctgtcagataatcatggaatgcatccagagtgacccaacgaagagaccaggcatgagggagatcaccacaaggctgagagagaccatagccatttcgccggatgcagcaacgcccagattgtctccgctctggtgggctgaagtggaggtcctctcaccagtggagccaaggtagaaacaatgataaatgtgcttctgaaaaaccaacatcctgcaggatgacgatcttgctgtgcatactgctgttcgtgcaacctttaccttgtgcaactccctgcccatgtttgatactgcccttgtgcaactctgctgcaaatgtcaaagatgagtactttctgtgtgtcatactccatccgttttcaaataactgacgttaggcaataggcactaatcattttgaaaatttggccactcgtcttttttacaaaaaaaaaagagttgcaaatacgagaaggaatattgtgccacactatcataatgtattgcatcctaaaataagcatgatgctttaattcatcatagattattcagtctaactatttgagattaattagtggttaatatcgaaatagtcattgtcaaccgtatcagttattcaaaaagggaggtagtaataccagtgatgatcaggtaagctttggcatgcggttggtacaaccaagcagccaaatgaggagcagctaactgacaaagaagcagtaagctctgaagtccaaaacctttgtactccctccgtcctataatataagggattttgagtttttacttataacgtttgaccactcgtcttatttaattttttttaaattattatttattttatttatgacttactttattatctacagtactttaagcacaacttttcattttttatatttgtaaaaaaaatttaaataagatgagtggtcaaacgttacaaataaaaacttaaaatctcttatattgtgggacggagggagtatacttgtataaagcaaaagggcaaagtcagagcaaaactctatacgttaacatgagtcatgagagcaaggtggccttggtcaggtaaggccacgccgccatattcgacatagagaactccattattgacaccagaaagcacaatattaatctgacctcgtgagcagtagcagacaacagtatccacattgtcgcacactccgacttagcccccccaaaatgttcctatcctcacaagtcacaccaccagaaaaaccatatgccccatttttaatctgcagaacacatgatctgtgtgcgatgttcttgaagctacggactccatcccgaacatctgcagccagccagatggaacccagccaaaaaggcgttgctcaggtggtgtttggatccatgaacttagctttagtccatatatttagacactaatttagagtattagatatagactacctacaaaactaattacataaatgaaagctaattcgtgagacaaattttttaagcctaattaatctataattagagaatgtttactgtagcatcatataggctaattatggattaattagactcaatagattcgtcgctcgaattagtccaagattatggatgggttttattaatagtctacgtttaatatttatagttagtgtccaaatatccgatatgatagtaacttgaaagttttagtccaatctaaatagggtctcagaccggccaaaactcccatgtgcatcaatgatttttgatcggtttcccggctggtcatcgctcacgtcaggcgacagatatttccaggcccaaatgatcatcgcctcgtcagtttaattttgggtttgctgctgcaaattaatcgagcattgttagtagcagtattgaacgtagcattagtactctttctgtttcttaacaaatgataccgttgactttctaacataaatatagttattcgtttggtttaaaattttataaaaataaattatatttaaagtattttaagtgataaaacaacttcaacaaataaattataattatgtaaatttttaagtaagacgaatatttaaaggtgtgataaaaaagtaatgacgtcgtatgctgaaaaaatgagttatacatcattttcgcaagctcaaatcaaatcccatccatttcgtgcaagatttgggcaacgaacgattgccgatgacgtgacatgtatgaacaggagggcagtattgcagtagaatattgctcgcgtgatcgttgagaggggaaaaagaagaggaaagaagaaaaagcactgacctttgggcaggccaggcgggcaccccactggcggttgggccacatgtcattggctcccagcagccagccaccctcgccgcggcgtcgtgacgtcgtcgccgctcgcggccggtctcttctgctcagtggctcacacatgggcctcctgcatgcgcgccacctatcgcctcctcatacgccgccgcggcgcgcccccgcgaccgtccgttcgtcccgaatccacggccctggatccccttcttccgccgcctataaaa

SEQ ID NO: 19390 - DNA, 7482 bp, Oryza sativa
  unsure (1)..(7482): unsure at all n locations
nnnnnnnnnnnnnnnnnnnnnnnnnnnnnnnnnnnnnnnnnnnnnnnnnnnnnttacaggcccagtttttttctccaatactgttggttttactgggccgaaaaagccataaaatcttagtgagtggtgtgctgggacgtggctgggcaggactagccctctgttaagagaaaaaatgtaataaaatgcaagcaactatgatcgttttttgctgtgcaaagctgatgattcacccatgatcgattgctcgatccgtttaagatgctactccctccgtttcatattataaatcttaatttttttcttagttaatttttttaaggtttaataaaattaatagaaaaaaatagcaacgtcaaattagtttcattaaatcaaacattaaatatattttaatattttgtttcgttttgtaataaaaatattattatatttttctacaaactcagttaaactcaaagaagtttgacgaataaaaaggttatgaatgtcaggagtaatataaaacggatagagtagtaaaaatattctacagttccatcgacaatttacatcgagatttctgtctcaactcccatttttcaccttgggacagagggcacagacgcacaggatccctcctgttccctgaaacaatcagaaagaaatcaccataagcagtacactgctgttcatcacatcgcacagcaattactgggcgggagtacactggagtacgtacgtgctgaattaatcacgcgaggattaaatataggaatacgtacatttgtacgtataaatttcatcccagctacagcctgacgcagctataaatatctcgtgctccatgtttggaacgtccctgaatttccaagccaggcaggcaaaaaaaacggaaggaaaagaaacagagaagaagaagaaatggtgtagcttagcctcgcctcggccgtggtgtgatgctgacgcgtcgtcggtgatggcgcggccgctgctgaagatcgggcacggcctcgacaggttcaggtggcggaggtcgacgtcgtcgtcgtcgtcgtcgccgctggcgctgtcgctgtcgtcgtcgtcggcggcggcgttgtccgacgacgacccggggagccccatggacccggagatgccgcccgcggcgaggcgggcgctgtcgaggagctcggggtcgagggggaggctgtcgttcgagctgccaccgctggccggtggcccgtcggataaggaggaggcgccgccgaggacgtcgtcggctccggcgccggcgaggcccgcacccgccgcgctgcatgagggcccaccttcaggtgactaatatatatctcttctgggatgatcaatgccggccaaaattgttgccatctctcgttcaagaaatgatgggtttcgtccggaaattgcagacgcggagatggtgagggagaagttctcgaagcttctactcggggaggacatgtccggcaccgggaaaggggtgtcctctgctctcgctctctccaacgccatcaccaatcttgcaggtagtgtgtaattcacttctgtttttttctgaagaaaagaagaatctctggttcgatgatgatgttgttgcatgcttcgtttcttgctaaattccagcttccgtcttcggcgagcagcgccgcctccagccgatggccgccgatcagaaggcgcggtggaggagggagatcgactggctcttgtcagtctccgatcacatcgtcgaatttgtcccgtcaaaacaagtctccgaggatggatccaccatggaggtaaaaaaaaagaaaaaagaaaaaacttaacgtgcaaaaagattgcacgttaatatattagaaggaaaaatagtttttgttacacaacgcaatctgccagacatgcttataccgggggaaggggaaatcgctactccaattagcaggatggtggaggcagagccgcacaataaaaaaagaaaaaaaaatgacccccttttatttccattcggtagacacactgtacaacgtatcagtgaacttcattatggaattgaatgagttagtggtgcattctaattctcaatacttctatttccgaattgtttgactcattcttgtcaagcagatcatgataacccagcagcgtcgggatttacagatgaacatccccgcattgcgcaagcttgatgcgatgctccttggaagcttgctgtgctgatctttgaaccaccagaaatcaacatctatatatctgaaattctgaatcaaacaatcgtccttctgttgcacatttcccttgtggagcaggaatatctcgataatttcaaagacaagcaggagttttggtacgtgtcgaaagacgcgagtgaatcagagaagggaaacacgccgaggcaggatgacagatggtggctcccaaactgtagagtcccttctggtggtctgtcagatgcatcaacaaagtgggttcaacatcagaaggatctggtcaatcaagtccttaaggcagcaatggccatcaacgctaatgttcttatggaaatggatgttcctgaagcatatatagagtctttacccaaggtgatcaataatactacattgcacaaagaatctattttgacaatttgcaacatttttttttctagttactgactgtgttacttttttttttttttgcctgatagaatggcaagtccacccttggagattcaatgtacaagattataaccgaagatcatttcaatcctgaagaactcttaggaactgtggacatgtcagctgagtacaacatcatagatcttaagaaccgaattgaagcctctgtggtcatttggcagaggaaaatggtgcacaaggaaggtaaattgtcatgggggcatggtgtcaaatttgagaagcgggagaaatttgaagcaagagcagagaatgtcctcctcctcatcaagcacagatttcccggcattgctcagtcagctcttgatataagcaaaattcagtacaacagggtataccatgagaatcatctgcttttcatgttgtcttttcggatttgctacagtacgtatgtttactcattgcaaaaattctctgctatttttccccctcaggatattggcttggccattttggagagctactccaggactcttgaaagtttagctttcacggttatgtctcgaatcgaagatgttcttcatgctgactccctcgcgcaagcttctaatactagaacccaagaatcaatgagaatggccagcttatcaagatatgacactgataaggttgtcattgatgctaaggccgaggtagagagactgggaagaatggaaccagtttcagcgacactatttgactttgtcagtcctcgagatcaagatgttgtggcgacgaagatggactcaaaagaaaagggatgtaggggggatgctcatagtcgaaagttgacaaaggtctcaccgattgcaactaagaggtattcttacctagaaaaacttgagaatttgagtggaacaagaagcccaatatctagacactagtttatgtgtagggggaaagacatatggatgatgctcgctgcagcagctcattcagaaaaatacatgtatgtaaatagcttagatgttcatagcatcatgagatgcagaattgagcatgtaccagtgtgaggtttggcaaattttagccatcttcacctccattcccaatggaagcttggtgcacaaagctatgataattagttgatcttgacctcctgtacattgtatgaatcaatcagaatttacaccgaccctcaaaatgcctttttagtgttaattggaaggtataatacctaaactaaagaggtatacacatcctcaaaatacacgtaactgtaacagtgtctcgtatgatctcaaatcttgtaggtgggctatgcaggggttgtagttgatatagacaatgtagtatcactcaatctggataatcatatgctctagactagatagaactagaggtaatcatgcacgccattttcagtttttcgtagatttaatgaaactactagtggtgaatactgaggagacatatttactagtgacataaacgcaaaacagaagtactgaagtagtaagtagtagtatcaaactactaaggccgggtaatcatgcacgccattttcagttttttcacactaccacatgaatgtcgagatgcaaaatcgaggggagacagaaaattaaaaccgaacacatgggatcgcagtacgtcgcatgcagcatcgaattggatcctttacaacttatatagccataggaatagtacaattatatcaacatcataaacagggggaattaatccatggcgatccggccatgggggactagcagtacagtacagaggatttgcatggatggatcggatcaagaagaaggtgaggcagagacgaggaatttaatttagatcttgccgcgtgggccgggcgtcggcggcagctgcgggcccttcttgatcggaagcaggtctggcgacgccgacgcgctgacgtaggccaccagcgatccgccgccgagcagcaggaacttgagcaggagccccctcttggtgaagggccccgcgaacgtctcgaagaacttgctctgcatcgatcacccacacgaattattcagtaaattaatcatcgagctaagtatatattttagtcaggtaatactaacctggagagggttgtacggcgacggcgcgtcggagccgtacaggtcccactgcccggtggtgttgccgatgtcctcgaggtcgaagtagacgctcttctcgccgtacttggccaccacggcggcgcgcggcctgtagcaaagaaattatgagcgtgataagaattgaacacgggatctcgggattgaaaccacatacacctcttgccactgcaatatcaagtgcatctccactgttactcgcgtactcctcgtatgtacctgcgggtggtgcggcagagcgcccggggcgacggcctgacggcgagcttcctgccggagatggagctgccggcgaggcccttcacggcgacaggctggacggcgacgagggacgccattgctgcggtgaattcgcgggaggacgcaaagctgagtagatagatggatagatagccggtgtactatctgcggcggcggctacacgtacgtgcacacagacttaattcggcggatgctgttaaggatttggaacgcgtagtccgcgtggctcccgcgatggccgacgccccatagggagctcgccgcgtggcctcttccggatagccttatcttggttctcctggatttggagctcgctgacatggcgcgcctacgtggcacagcatgcctatactgaatagatcgcacaaaacacacacattgagtcgcatcgaatgcagatgaatcttgtcttcttcttttttacacaaaaaaagagcgtgagagttctttttgaaaactcggcaaaacacccatatatctgcacactcatctttgtaaaacacatacgtgtgcaccttatctctacgagcatttcagaatgactaggccggtttatgtcgagacaaagctaccacggacaccttgcatcgcctgcactaccattaaaaaaataattagtcataaatacgagcatccatattaaatataacttaaatttatctatccaattaagttaggcgcacttcgaaaagcgtagaaattttttttaatgatggttggcaagtttcactacaagaacctaaccggttaggtcgcacacacttcaaaaagtgtagaaattttgtgtggagatgcatgaaaaattatatcatggtgtaatttgggttgagcatctatcaccgaccatcactagtgatgccaatgatctgatcaatgcttggggatgtactcaccgtcatcaatccaacagtactcccctgtatcgtagagagacaacatacggcgatccagatctcgtagaatttttttattatcgtcctggacgctgtcccctacggcgtcagtatatttcagcgtactgtaccatacgtcgcatcaaagatcgtccctgtcttctcaaccgaaaatatcagcagcccaaatactgctattcgggcctggcccaagaacacccctacctcgcagcctctcatcaaaatgggcctaatgccagaagcccaaggcccaaacccacttccactacatgggccgtcgccgcacttgcgcgacggggaggcgcacccgcaccatccacggcgactttaggccgagatccacccactgctgcgcccgcgcgggccggcggctcagatcacaccgggggcgaactgctgcgatcaccgacgcgggggaaccaccgccacaccaccaccccggggcgaagccactaagcctctctctttctctctctctctggccgccgccacgaccgaacgcgacgcgacggggcccagcccacgcccaactccccctacatctcccccccgccgcggcggcgggggcgcggtgaagcttcctccccgctccgctccgccgcgctgctttgctctgcctctgcagccgccgccgccgttcccggcccttcgatcggggcggggggccagatccccccgcgcgtcggccgagtgggagtggggcgcgcgggacggaggtgcggatctgattggtctacgcgcgagatctagccgggtgctgctgttcctgctggtggttgcggggatcggagcggaggcgggggaggaggagggatggcgtggtggtcggggaaggtgtcgctcggtggcctgcaggatatcgcaggggccgtgaataagatcagcgagagcgtgaagaacatcgagaagaacttcgacagcgcgctcgggctcgaggagaagcgcgacgatgaggaaggtatggtagcgtcgctggtacactggaattgtcactctcgcccccttctcctccgtgtaattcggctgcattggggcactcgtgcttgtttgcaagtgtttgatcgaaactatgatgagatgaatcagtgtcggcaataacttttttcccatttatttcgttctacatctcgctatctgtagagattgggtaatttgatcgtaggaggatggatcctgcttatcacttgttccattacatccgatgtaccccgtaggttcttaagtcatactctatatactggccaactggagcctaagtactgccagtacccggcagctgaatcatgtgtgtttgattggtttagtgacatatttcatacttcttttccaactggttctatttgtaacagtcgttggtctatgagtagagcggtcatatttggggtagttaagcttattgtttctttgtttacatggttaaccgaattgtgtgtctttttgttgtaggatcaggatcacatgcatctaactctgatagaatagggttctttaatcctgtcatggcattcatgggaaataatggcgaggaggactctgctgaagcatcagaaaagnnnnnnnnnnnnnnnnnnnnnnnnnnnnnnnnnnnnnnnnnnnnnnnnnnnnnnn

SEQ ID NO: 19391 - DNA, 7992 bp, Oryza sativa
  unsure (1)..(7992): unsure at all n locations
gtagatgcttctgaagaatcggaatcaacaccatctccaaagctttctgaacaaggagagactcttatcagctcaactgagtcacctgtatccaaggctgaggtttctgagcaactagcaacaccaaaaactccaaaatcactttcagcaacagaagaaaagcctagtcattctactgaatcacccacatataaaggggattcagaagcaccacaatctcccacagatccatcaacagcagaagaaaacagtggatccactgagacgggtaatacaattgagacgggaaaccaggatcatcaagagacaaaatattctggtcctaatgatgaagcgccacaaagtcagattggagaatctgacagaggcatacctgatggtacaaagccttcttcacctactgaattagatcaatcaggtaacacgggaacaactgaataccttcatgctggaacggaaaacatagatgataaaaatgccatacaatcacaaccactagattccattctagccagttcagatgatgtaaatgaagctgtgaaaattgttaaaggagctgatgatcgaaatgaaataagcagttcacatgagaatactgacaccgttgaccaagctagtcatgtggaagtcatagaacatgatgagcatactaatgctgctgaaaatgatgaagaagctaatcgaacagaagcacaggtagcaactgttgttgaaagggaggagaatacaatggtgcagcttgaagaccttagctcaatgtccataattgtgagcaatgattcaaactcgcaaaatgagtcggtgcccacttctgcagatgtgcctgttggactggtagaggttggttccaattcaaatgatttgagaaaagaagaaaatatccagggctctgttacaactagcaatcatctggaatctgtcggtgctgtcgctgaacttgagaaattaagacgtgaaatgaagatgatggaagctgcattgcaaggtgctgcaagacaatcccaggtatcatttccacgtggtctactagcaacccagttatgcttgtacggtcgaaactgtatgttgagaaaactaccacatgattttccacttgtaacaaaacttcctttagtttgtgaatgcatatttgttctataaatgaagatccataaatgtttctgtgacttatggaaatatgctctaaccctgcagaacgctagttgatgaacaatatctgatttgattttgatagtagcacaatgtttttctaggaaatgaactgctgctagactggatctatctgctcaattaattgcattcaagtttcattcttctatttttggtgcagcatttttactgaaaaagagaaataaacagagacacgttcatctaatattttccacatgctcagtgagcattcctatttttgtcttatattcttggaatgcattaaagcatggacagctatttaaaactcttgtctttcatatttgcctgatttatatgaggaaacaaatataattccatgagtatatgatgctcatatgtattcagcatacagtcagaggtttttacaactaagtgcatcttttacttccatattctatcatttctgcgcaacatacatacctgggcccttcacttgtctcacaacacttcttcctgcagtccaaagctgatgaaattgcaagactgatgaatgagaatgaacaactgaaatcaacaattgatgatcttaaggtatgcttgatagcagactctgtgtttttccttctctaaaaaggtatttaagatgttatatttagcaattgctggaggttttagttaatctgtatgaaactgaatgacatgaatattatacaattatcctaagttactcagtagtgctataagcatgtgatgaacttggattgttttgttttgacatggcacagagcaagtcagctgaagccgaaatggatgcacttaaagatgaatatcaccagagagtagcaactcttgaaaggaaggtgagacacgttatcacttattaagacagtagtccgatagacataattatgctaagactatactctggtgaagttcttaaatggcactgcctagttcctgcagtcaaagtagtaaattgtttatttttcaaagtagcaggatgctattttcaccacaaaaagttattaccatattaattgataaactattttacttgttggatgcaccttacatattcatgtatttatctaaagtcggttttatttattcgatacttaattctaatagtttggattaaagcatgatgtatttattttttaaatacaggctaaccacattctttcttggtacctagtgcatctaaaataagattattcttatcgctgatatgttttatatttgcatgcttcaatgtttataggtgtatgccttgaccaaagaacgggatacattaaggagagagcaaaataaaaaaagtgatgcagctgctcttttgaaagaaaaggatgaaattatcagtcaggtcatggcggaaggtataatgaaccaacattttctttgtctcttctattatgattgcgtataaatgttaaatttgcaatacacaatgttcgttccgttgtaatgttgagacagtttgaagtgttgatccacaaatatattgcactgtgccgaataccctctgttcataacaatcatcatgattacatcacacaagcacatattagcaacattagaactatggacatggataatcgtagtgcttcaccagtaaggttgactctggttgccattggtaggcaaataggcatagacatttctctgtgaaaagggcctggaatttatataggtttgctaatgtttcttcttatgccccttttatccagctttacactttagagcccatttgattttttgcccccttcatttttatgtttagtaggttttgaggcatttatttggcatcaacaatttttttacaatgaacaggtgaagagctatcaaaaaaacaagctgctcaagaagctactatgcggaaacttagggcacaggcatggactgcaactcttatcattaagcatattttgtgcaaattaaatattttaccaatttcactttcttccattttgttttctttcaggttcgtgaacttgaagaagaaaaacaacggctgaactcaaagatccaggtaaaaaggataccaactttgggtatctatgaacattatacaaattttcttatctgctttaatgatgaaaaatacttaactttactttctttgttagacataatgaaaaatatgtctatgtttgcaataacgcaaaatcaaatttgggcctcctttagctggtttgttctgtcgtgcttgtttggtgtataccataatactgtgatattctactagacaatcacttgcttcacctgtgtaactgtgtccaaactcatgatttggttacaacagatatactcccccacccttgcacccccaccgcccaaaatcttgttagctagatagctttgagacattgcttccatagaataatggagttacttcagcttcctaaatggagtacctatattcccagtatcatatctatttgctgtcagacattgagtgtagtaatgtatttagcacttttctgatacaacaggttgaggagacaaaggttgagagtattaaaagagataaggctgcaacggagaaattgctacaggaaacaatagaaagaaatcaaactgaacttgcagctcagaaggagttctacaccaatgctcttaacgcagctaaagaggctgaggcattagccgaagcaagagtcaacactgaagccaaagttgaacttgagagtcgtttaagagaagcttgtgaaaaagaaaatatcttaattaagacgattgaggagttgaggcatgctctcacaaagcttgcatgcctgcaggtcgactattaaaatatcccctgcattggtatatctacctttcatcattgtcagtagaaatagtcgacaatatgtgctgatccaatccatgccttaaggatttgtccagttaggagcctactaactgtagatactttttgggatgttccaggctgcattcagggaagaaaggctgaaaagggattatgatgatcttcaaaggcggtatcaagtaagcatggcccttctaggtttgtttgtatattgcactgtaaaacagtcatcagctaatacttactattattcgttatttaatacttcagtccagtgaacttcgttacaatgaactggtcacacaagttcctgaatccaccagaccacttctaaggcaaattgaagccatgcaggtactggtgcatttgttttctttcccttgggctgcaattactttgctttcttcaattatttggagtctggataacacttctgcaatttgtgagttgacctcttttttctgttgtgagctggttaattaattgtgtgctaacattaacaggaaacagctgctcgaagggcagaggcttgggctggtgtagagagaaccttaaactctcgacttcaggtctgtttgtgttctgaaattatctgtttaacagtgatcccataacagcaatgaagaattctagaacaacaagaaggggcatttgttattattgtagaatgcacatggttaatgacaacaaaagatattttttaaatgtacttgagagaccagtcctttcacattggttaaaccttttgtaaatattttttataattaatatattcttactgtgggggcttcccctacatcgcaatgatattggtaacactgcaatgatatggcaagcctacagactcctctagttgtggcggctaccttctgatttcgcttttttttttttaccaaagcaatcatattagtaactgccttgccttagtgcagtaggcaaaaattcagaaacactaaaataaatatctcaatgacataatactttgttactttgctctaatatgcaggaagcagaagcaaaagctgctgctgcagaagaaaaggaacggtctgtaaatgaacgtttgtctcaaagctcatcccggataactgttctagagacccaggtttgtgcatcaagttattctgaaataaatcactattaacattaccataggtttatggccaaggtttagttttagtcagaaaggtgacttcttacaaaaatattttgttcttatgcagattacaattcttagaacagagcagacacagctgagtcgatctcttgaaaaagagaggcagagagcatccgaaagtagacaggagtacctggcaattaaggaggaggcggcaatgcaagaaggacgggcgaaacagcttgaagaagaaataaaggagcttcgtactaggcacaaaaaggagctgcaagatgcagcagaacacagggagctgcttgagaaggtagccaatctgctatgctattttttttttcaggaaaagagctggatgtatgtcattgttttgattggtttggtaacttttatggtataccaatgttgtcctgtcaagttcattaatgtgtggagccttggggaaactgtttttaacctttttaaaccgaccatcagctacaggtccgacataaacattgaactttggaatctctcttacagtaggtccttctcaggatttaacaaaagggtttgtttatgtgtgtgggtactgatgatgcttttgtatttactatgttgtttaccgcacgaggaagtttttcgactccctctgatcccaaatataggttgctttagacttgtgcacatgaattaaggaagcaactccctttcatttatactgtataggaaagatgaatcatttatttattacttgtgagaagggtggcatttatttagcaagggcaaacagggaagaacagctgcaaaagtgcgtagaagttccataacgatttactacatttggaattggatggggtatatggcatcaatcatctcttctatgaaatggcgtagttgaccataccaatcaataattgtgatcaacctacttattttctggtttatacatgaccaactcggaagaatttctcgccttacatattttattttacgaattacgttttcaggaccttgaaagagaaaaggctgccagggcagagcttgagaaaacatcttcccgtgatgcaccaaaaattccgcttccagatcagacaagtatgctgtttattcgtttttgactaatttgtacgagttcaatccaacttctttgtatctgttgcctacttgccttacctgtcgtttgtttcctctttgcatctcatgaaggaaatgctcctctcagaaagctctctagttctggcagtatcaatagtctggaagaaagccatttccttcaagcatcattagatttgtcagacaacgcttcattagagaggagaatgtctgctgaaagtaatatgtcgtattatcttcggagcatgactccaagtgcttttgaatcagcactccgtcagaaagatggagagctagcttcttacacatcgcgtttggtatgtcctttggagatttcctgaaagtactaattctcattttggatatttcttatttaagtacccttgcatgtgttcttgttaattttcgtcgtatttgctattagttgagcttgctggtgttagcacgacatgcacatgcccatcactgaactaatgctactctatattacaggcctcattagaatctattcggaattctctggcagaggagttggtgaaaatgactgaacaggtaaatcctgatgaaccaacggaagtttttttattcaactaccaacatgtgtgcaaactaaactaaattttttcaatgcagtgtgagaagttgcgtaccgaggcttctgctctgcctggtttaagggctgagctggaagctttgaaacaaagacactttcaagctctagaactaatgggggaacgtgatgaagaggtacggcttccctagaaggcaccatgactttatatttgattattttctatggtatataaaagaaacctttttccatgaattggatttatatggagctcgtatactggaattttttataaagtccctatatgatcgccaaacccacaattcctgtgccatgtaggttgcgtagctaccatcttttaaggcacaaaaattatctgaatagagataaagacaattaataagcacatgcttataaacctttacctgttatttcgtgtggatttgctctgaatttctgtactgtgcttgcagttggaagagctaagaaatgacattgttgacctaaaagagatgtacagagaacaagtggatcttcttgttagccaggtttgaagcttatcagttgaactttattttttcatttgataaatcgttgttgccataagtccctaacccccggcttccattttatcagctccaatctttgggtgctcgtgtatagtgctgctgtatgtcagtatgtagcttcggctgccatccatttttttttcgcatcgcgctaatctactaagccccatacagcagatctgaagcttggcgtgtttcttcgaaattcaagccgtgacaaataccgaaagttcatagccataccagtgtgaaaatattcgtttttgtacatcttgaagcacaagtctttttggacagttgagcacccttgtttaatttagtaggttactctgttgtatactagtttggatagctttacggtttttaagcctattgtttgcaattctttccagtgaagtgtatcaaatttgtaattcgattaaaagtgtatcacagcggaatgcaaccccaataatatgagagctcgtttttgtcattttcctcaggttcgaccattttccgtgtacctatcatatattcatatgtctttgtgtgcgaagtataaaccgcatcataatgatgaaaaaaaatcaaaaccaaatctgttctattcatatgtctttgtgtgcgaagtatcataaaggannnnnnnnnnnnnnnnnnnnnnnnnnnnnnnnnnnnnnnnnnnnnnnnnnnnnnnnnt

SEQ ID NO: 19392 - DNA, 7118 bp, Oryza sativa
ccatccatttttttttcgcatcgcgctaatctactaagccccatacagcagatctgaagcttggcgtgtttctttcgaaattcaagccgtgacaaataccgaaagttcatagccataccagtgtgaaaatattcgtttttgtacatcttgaagcacaagtctttttggacagttgagcacccttgtttaatttagtaggttactctgttgtatactagtttggatagctttacggtttttaagcctattgtttgcaattctttccagtgaagtgtatcaaatttgtaattcgattaaaagtgtatcacagcggaatgcaaccccaataatatgagagctcgtttttgtcattttcctcaggttcgaccattttccgtgtacctatcatatattcatatgtctttgtgtgcgaagtataaaccgcatcataatgatgaaaaaaaatcaaaaccaaatctgttctattcatatgtctttgtgtgcgaagtatcataaaggaatcatgcaacattcaaatattcaaatcattcccagatccttcaattttattgaattcgaaggaggcatgctacatcatacaccacctcctgctttaaactacatcatcatgctacaacagtgaaacgctcggctccccgccgaagcatattcatcgcgccgcgaccgcgagcccagccaccgtcgtcgcgcgcccaggcgacgcgcgacgcgagcgcggcgaccttggggcggaccaccagcgccgcgcgcacggcggccctgaccacggcgtagacggcgagcgcgcgcgccagcctcaggttggccgcggcgacgtcggcggcgcggcacgcggcgtgccccgcgacgagcctgcgcgcgtcggacgcggcgagcgcgaccgtggcgagcagcgcgcccgccgcgaacgcgagcagcacgagcgccgtggcggcgaggagcgcgccggagaagaggcagccgtagaggagcgcgacgaggaggaggtccagctgctgcaccgccgcctgcatggggaacaagctggtgatgatcgccggcgccggcgccagcgaccagagctcgccgcgcgcaccgaggtagaggaggccggggcacatggttattataaggagaggaatcatgtcatgcgtcgcggccacggcgcgacgcgattccctcttgggtttttcttttctttttttgtttttttttggagaggttttcttccagccctctcgttgcctgtactgaacgcttggtatgcttgagcaaggtggctatataggtgccagtacgaggcaaaagggtaacggaaaagggtggtgctagaacagttcatggaaaatgcatgccatgcattctggtttaaacatggaagatgagtagtttttgatagggatgacaactgggtgcatacaggattgagaggaagtctatctcttctatattgtagccatctttataagcgtgatattattattgtcttttaagtagagtctacatggcgttttgtgatgctactgaaataaaaagtagctagcgttaccataagtgacggtacgaaagagaggcgtgacaaccgagaagtggcgagtgcggttaagttggcaagcggccacctacttttgttttttgtcatcatattgaaaagggttaatattatagctgttggcttgttgtagccatggaacaatgtgaaaagaatgacaagtggacggcgaaatggtagtggatgcatagttagacttacgacaaacctacaacctattttctatatacggatgaaagaagtgtcatttttatacctgatacacctattattcccgctaaatttcataaaaatgagccaaacttaaattccttatttgtgagttctttatattattcctttttatatcgcataaattgtgaagacacggtatctatgaatgaggtttgacaaatgctatcaatgtttacaaactactccatgtccttcctaaaattgtgcttcacggtttatgctaaaatagttttgctcctaccagaagagcttgtggagcttgtgacgattgacttgggccatgatcaccggccacgcagagcacatatgcaccaccttgatcacaaccctcgaggcctctccatgactccatccatccacttatccacagtggcttagcataggagtgtaagtggctaacctgcgaactcacttgtagattagaataagcgggttcaattatttattttggtctataaataagcttcacgggttagccgcttatgcacccttaggccttagctcagcagctcagctcacgtgttcctctctccctctcatgctcaatcccaaacccaaaccaaacttgcttagcttgctgcctagagtagcatgatgcacgcagccaattatagttcagtgaaatcacatgaaatgcatgattccatgtgtattttctctgtctcctccgtgcaaccatgaactttgcatcgctgtgatctatcatcatccatgggccatggttgattgcgcgcgtcagtgtatcctatcctttgctcgccgttccctcccccttcaacccactttcataactgagctcttactcggtctgtctcgctaaaatagccaacgttgacctatagataggaggcccaattgtgccatctcgccgaaaaagctactgatgggctcttactacattttttggtgggctgaaatattgcccaactttgtgtggaggtatggaggaagaggttgtgtttggcaacgatttatgctacaagaaattggaaaaaaaatcacttaggtccctcatctcgtcgtcaagtttcaaaatcgtcatgaaccagaatactagatataacgcatctctaatcttgcaaaatatggatacgttatatcatgatgcacacagcaaaaaaaaaaaaaaaagacagacattgacaaacacaatcacatatatgatatatgagcctactccaaaataataccttctagataagtgatgacctttgggtgaaaaaattaaatggggaaaggttgttattagttgtgatgaaaagatatgtgaagaaatagttatattttgaggtaaatttaaattctagagatagctatatatcgaggcagaaccgcagaagagagtatgtttggtttgctctcagaatgtgacaataacacacgcaagttgtcacaaatttgacactgtgaaaacttgaaccaaataaaccatgtaatcgagtctccatccaaacaaggtgctaaatggctgtgtcagggaaaaacgaaaaaaaaggcgtcgacagcaggattcgaacctgcgcaggcaaagcccaacagatttcgagtctgtctccttaaccactcggacatatcgaccatcgcgtttgttatgtatgtgccttttatattactcgaaattaatggaaatcatgctttgttaaacagttctttccaaaacaacgagagcggctcagatacagtttcagtgccatccaacgaattaatatttgacttaggaaccatcattcagaccattactggcagaggacaaattcaatttattacaggctcgtgcagaaacagcacagtagcagctctgcgagaatggccgatcgagattgcagtattgttgcaatatttgaagcatatacgtgaagttgttcacaatttaggtacttgcagaaattccaggtacagcttatcttggcccagcgaagacttcttgtgcaacagaaaaacaaacgactgttttattatttgttttacttcttgcagagatctcatggcgaagaaactccaaaaggaattcggcgacaatgtacagcaactcccagtcacaacctaaattatttgattcaaatcttttcatgtatcaatagtgttgtctttgctcttaacagttacaatggctgcatgattttacatctgtaaggtaacacacagtaaaacaaaggaagctaaaaaatctataggggaacatctagctggtggatatctgggggaaaaaatgaacagaatacaaaaaggaagtacacatttacctcaaaaaaaaaaaagaaagtggagaagaaaaaaaaaaggaaaaaaaatttggtcaggcatcttgcttggcacagctactgataatctgatatgacaattgctgaggatcaaaccacggcaacttcgtgtaatccagtgtgcggtttgttcaggaaggcatcactgagcagcctcatggccacctgtcaacagcagaaagttgatcaactcatttttacaatctgacaactcagaacctccatgccgataaaaacgaaaaaaaaaatcgaacttctggcttggcaagagaagtgacctgtacgaggtacgagcatacacagtgggtggcatggcatcaaaatattatgttacaggaataacggcatcaaggttcttatgcaatgaccagccaggggggacattgagtagaggaggttccaagttaaaattccaaaccataaccctgttgcaatcttctgggagaccctctatctggcgctcatgtttaacaagcttctcaataaatcttgactcctgcaatgaaacgtttgtcagttcaggccatatacagtgaattatcgttttttagttatctgctgtatggtctcatgctcattcagaatgatagtcatgatatgttcctgcttcttcatgagtagcgtctatagttgctttaggagatcatatgtctgcatcttatgcaattttattcattacataggccaagttttttttctcaactccaagctacaacttcctcgttttccgttagcacgcttttcaaactgttaaatggtatgttagcaaaaagtttctacatagaagttgtgttaaaaaatcaaataaattcatttttcaattttataatagttaatacttaattaatcatgtgctaatgagttttctcgtttcgcgtgcactgaaaatatctctccaactaaacagaacgaacggggacaaagtaatgaactttcatgaatgttacttagcaataggattttacacacaaaaaatagttccattagctatgctactatgattgatttatgcagtttattttgagaacaaaccagctaactcacctgcaaaccacctcttccacctgagtggacaataacagaatccataggtgggcggttccacctctcaggatcccatagcattgtgctgttgaaagcaaacccagagaaaccaactggaaatcgacgaactgcactcttcttctggatgttctggattgtattccatccagtgactcgattacctttacatataggaccttctaaaaccaccctgtacttgatcccagtatgaattgctacaggccatgcaccaaaccgcctgcaaaaaaggtagagagacatgagagagagagagagagagagagagagagcgtggaggtattatggccaaaaataagcatgctagtcttattgcattctgctttaatatgactacgggggttcctttgatctgaaatttctgcaggacagtttaaggcaacagcccattaatgttgtttcacctggtaccagaagtttttctcatagtaagtttcatcattgaaagattgcttatgatcagctcagacagagcatgacccttttgcgtaactcttcaagttttactagcctgattaatactctgatcattaggctaaactgaaagtaaagtatcgaaatactctttaattttttttttgccagtaaaagactacatttcatgaatattggacaaatcaacaatggagtaggaatgtgggggttaggtttgccattaaaaaatggtgctggttaaaaattaatcagtttcccaggactagcattctgagactagtccaaagtaactataatcaaatggagtaggaaagcaggagttaggttttattctcagtgggattgtcaaccttaatcatttctatttattttaccgaagttgctgcttcacatgtcagattactacattactgggctgcagtacacactgggaagttttttgctctactagtattcattggtatgacaaaggttcaactactaaggtggagaaactctttttatttgagttaggttgctagtcaagatacatcaagttattaaatcattcctcctactatagtggagaatataaaccatgctttggtatgaacgttacgtcatgcaactctaggagcaaaaagaattcaataattttcagttattgtactgaaatagttagtgataatttctgggaaatgccagccatgggtgcaagactttgaaactcactatgttggctggctattgtcaaaatcctacctcccatacaattcaagaggatgcattttcataaattgcgattaaggataatactcgatcagaactatttctcaactggataattcaattcatgacatagaatgcttgagacagaagcatttagcagtccactactagttcactgatttcataagcaaagaatgtggcagtcaacctagcactgggcagtggcttgtatcataagcaaggaacattgaacatttcactcacccaatatactatagaatagcaagattagaggaacaattttctaaaattggacacccacaaaagagaaagggaagaaactaaaatataataatttctgaaaaggtagagcggccataaccttatttatacaatatttttttaagagaacttaatagtcattcaacgtcaaatatgtaactacagcaaatgaagtttccaaagagaactgtcacctgattttccgcatttcttcaaatacatcactcatgtatgaccgctcttcatcagcaaaatgcattataccatcaagacgatgctttttaatatgatagattgcagtattcctctgacatacagcaattttccgtacactggtagtattcttcctgcagatgagatgcctgtacataaccccagaagacctaaggatttctgctgtttgaaaggactgatcaggccattctaccactaaccacagaagaggagactgtacagttttcaagacatgagccaaacggttcaggtaatacggctgttgtggccgaacagtagtgatcgtaccaatatccagaagctttctcacagtgatgtccaatcattgaatcaggtattgcaggggtgat

SEQ ID NO: 19393 - DNA, 788 bp, Oryza sativa
  unsure (1)..(788): unsure at all n locations
nnnnnnnnnnnnnnnnnnnnnnnnnnnnnnnnnnnnnnnnnnnnnnnnnnnnnnnnnnnntcagtgcaagctattaggaatggaaaacactggcttatctagacgcctagaatatttttttagataaaggagatttcttgggaattatcctggtcacaagacaacttcctaagttctcgtcagatacttgcagcataaacatactagcaaaaggctaaacgaccagcatgacacttggtacaactactccaagtatctcgcaatgtgacttggcagctcagcgctgttcccttccatagtcaggagcttgtagaaaagatccctgcgcaaggcagcaaccctaccctgcgacagacaaatgatggggaatcacggttattattcaggttaatcgaattggtggaaagaaaaagaggaaatgtatcaatgcaatgtgctcaccgaatctagaacattgctcagcttgccatcatagaactcgcgcgcatagtataatgtgtgaaaaacagagttccatctgcagcaggaagatgactcaaatttgttatgggatgaaatttcattttcttttctttcttgtgtatgtgtggcattggcagaagctacccacttttggcacctcgggctaatctttgtgtggtacgtacatgtccatccatccgggttaatatcccagtcatcgaagaatttgtttatacatgttagcaagcctgtgtggatcatcgtaactgtctgacggtgcttagcactcacatcggagaccctcccgtggttgcagacagggtcca

SEQ ID NO: 19394 - DNA, 5739 bp, Oryza sativa
cagtgctggaggtcgcggtgagcgaaaatcggtgttgccctgccgccgcgccctcttccctcgctcctcgcaatcaggcattgagcgatgggattagttcaaagacacaggacccacgattggtaagttagtttggatggccaagtttggccagcgaaagaaggaatttggcaactcatttgatttagccatccaagtatagaggctgatggagtgatactttttactaaagttaccaaattttggtttggagaggttattatagaggccgctggaggcctggagatgctctaacctctgctgctgcgggtgcattgcagcttctggccctgccgaccacccgtgtccgtgtgtatttcttctactagcttcagatcatgcggtccccgcatccttcgcaagccagggcctggatgagatcacaagagtgcatgttaggatccccgcaccacttgagccgcttgacgcactgccactgcaccaacggaaccctcttcccccggcggaatccttcagcggtcgcccactcgccccaccttctactttcgaaaatctcatcaggatttgccagaacccgtgccgtgaacagcaggaggttagaaacctgatgccgcatcgacccttgtcaccgcgctcatgccgattttacacggcacaagtgatggaacattcatatttgttggtgacttgtatcaccataaacaccgcaaacactgcgacacaaagatcaaaaaaacaaaaaaaggaacactgaggtggtgtttgaattcagggacttaattttagtctctgtatttaaacactaatttagagtattaaatatagactacttgtaaaattaattacataaatgaaagctaatttgcgagataaattttttaagcctaattaatccataattagaaaatgtttactgtaacatcacataggttaatcatagattaattagactcaatagattcgtcttgcgaattagtccaagattatgattgggttttattaatagtctacgtttaatatttataattagtgtccaaacatccgatgtgatagggacttaaaggtctagttccatctaaacagggtctcatcgacactttgtctattgatcccacaaaagtagacagacagcaaagcattctgctgttggataacacaattatcatagtacaacaaaccaacactacaaacacagcagcgatctacacatgtcctctctctcatctcaaaatacagaaactagtacaggatttgacattacctaagtactccagtacaataacttaaaatgccccatgcccatatcaactctgaaccttggagcaaacttctgccgatattaccttcagcttcttttgtagagtacttacctatgcaaatacgcaccaggatttacccctgaatctatttatttctgaaggctcattttgattaattaatctccaaatagactactagtgagtagtaggtctgcacaaatgttgctctgatgcctgcttacttccgttcctgtcccctttcttcacttgtgagggacgagtcaatgctgcaaatgaaaagaagaaaaaaagagaagcatatggttatactgtcaaatttaactactgaattaaagagttactcagaaaactcattcattcagtgatgcacttcccaaagagtcctaacatgccggaagccatacaaaaggcttttgctacatgctactagtaaacaacttgctgctatacctttattcagtgcaagctattatcaatagaaaacactggcttatctagacgcctagaatatttttttagataaaggagatttcttgggaattatcctggtcacaagacaacttcctaagttctcgtcagatacttgcagcataaacatactagcaaaaggctaaacgacccagcatgacacttggtacaactactccaagtatctcgcaatgtgacttggcagctcagcgctgttcccttccatagtcaggagcttgtagaaaagatccctgcgcaaggcagcaaccctaccctgcgacagacaaatgatggggaatcacggttattattcaggttaatcgaattggtggaaagaaaaagaggaaatgtatcaatgcaatgtgctcaccgaatctagaacattgctcagcttgccatcatagaactcgcgcgcatagtataatgtgtgaaaaacagagttccatctgcagcaggaagatgactcaaatttgttatgggatgaaatttcattttcttttctttcttgtgtatgtgtggcattggcagaagctacccacttttggcacctcgggctaatctttgtgtggtacgtacatgtccatccatccgggttaatatcccagtcatcgaagaatttgtttatacatgttagcaagcctgtgtggatcatcgtaactgtctgacggtgcttagcactcacatcggagacctcccggtgttgcaagacagggtccaaaatgtgcatttgcctcttctcccatgtcccaaatgtagcatgcccatgtatcactagctaattgaaccggggaaatgagctgtattttcgaaataaaatggttcactagtcagtatatgtgatgatcaaaggagattggataaagaaacacaatatataatccgtaccagttggcagttctgtattttgtagccgctaatatgttgatcaaacatgtcactgactgctttcatggaactgaagtttcgttcaaacatcaaagctttctaaaaccaaaatcaaggggaaaagacaccaagctttggtcattgttttaaccatgatttcttatatacatgtacatgtatacatatgtatatacatgtacatgtacatatgtatatacgtatatatatatatatatatacgtatatatatatatatatatatatataggacattcatatggggcaccatggtgcccgggcaccatggtatctaatgcacaaaattactcaaatttttcaaaattttcaaattgtgagtatatacctagttataataatttgattcatacctatacttatcaacaaaaaaaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaataatggtgcccgggcaccatggagcaccaaacaaatttactatatatatatatatatatatatatatatatatatatatatatgtgtgtgtgtgtgtgtgtgtgtgtgtgtgtgtgtgtgtgtgtgtgtaccgcgaattggggtaggaagaagtgacgccaccgctgcccacatgggtttgtattcatcttggcatctaactgttggtagagtctgatcaatgctgaacaaaggtccgcatgtagaataccaccgcggatgacctgcattttgatttccttggcacttatctcaattgatgtaggcttgtcgtgcttgaaccaaacccttcatataggataaacaattaaaaatcagtacaaagtttttgtgtaatgagaattcacgcatttttaaagaactccttttgcacacacccggttatatcgtcatcacatgactcctcaagccaacggaataatctcccagctaatatagagtttggccaccattcatgaactgtgcgcattgaaaacgatgacatgcaagatggccttagatgattccccgcctctttcgtcatctgcgtctcgcaacgttctgattgcccttggtacttatcctgtgcaccattgttgttttgatccaatgtggcgccgtctcctgcaacagcagcaacacaaacacgatagatgcatttcattctttaaaatctctcatttaatttgttgtgtgttgggtgggttcaaggatatatacgaggtgtatacgtactcatgttagcttctcccacagcagctgctgataccaaccaatcgaggaaacatttgtcttgcgtttggaaaactgtgttttggacttgtgggggaaaaacaatagtcacattactgcacattactcagaagtgtttttaccttttttttttcttggcaagctaaccttgatccaacccacgatggtttgtatgaactgctgacgtcgcttgggctggtgattttaatagatggtgatgtgcgatacgggccgtgcgtgacaccgacaacggatttgcacggtcagcagctggattttgctgccctcttgctgcatttgccaatttgtttggccctaacaagtcacctttgcctgtgatggattgaaatgtttgtgtcatgagtacacatatatactcgatcgaaaaatgcaacatcatgtcaaacgcaatacctctcaaatcaatgggggtttgggatctatttgctgcagaagcctcatgtgacaacttgcttcgtttacgagtagtcttggcaccttctttgacatgcatacggtgcacagaaactaattgtaagtgtttttcttttcactttgaaaatgtagaaacctttactagtatgagcttaccaccatgtgatgcagttcttcgcatcgttgctgctagcatatcgtcagtatccacaccttcgattgcgccatgtaatcgagcgttggatcgatcgggatttgcttggacagcttgatccattacagccgagtaacatttctcaccgtgttccgctgccaaagcctgcatgccttccgttaaagatgaaaaaacgaggccgcatttctcgttgtgcttcgctaacaatgccagaatgccttcctgcgttgcctgaaatgaatctttgatctctgccatggcctcatccaacatctgcgtgcatcgttcgccaaaatgacgcgatagatcggacagctgcaacgagaatagaaaaaaaacacaaatattaaggaaaaatctaatatcaaataaatagaagaggtgaggctttaaacccaggctagctagctagcccaccaccttggaggtagcgagaagaccctgggcgtttctcaacaaaaggacgggattaattagtttcagaatcgatttaattagcaaggtgtaatatgcaactagttttgttgggatgaagggattagcggctaaccttggcaggcaggtcgttgccatggctatcgctattgctcgggtcagtgtcgtcgtcgtccgaaacgtctatgggctcctcgtaagcatcacaccgagctttacctttgcccttcattgatgaagaaacaactgactcaacaacattttttcgcttcaaaatggagtactacgcagtaatacgcttagctttgatctctaccgtcttagtaaagcacaatcgtattttttcccttcccactgaaaaaccgctgaaaaaaatccattgtatataaaaaaaagagaccaaacctaaagagattctgaaaaagagagaaaagaaagaatcacgttcagcagatcccgtcccgttgcaatgcttgagcccgaggcagcctgtgactactccctccgtccctcccaaactaataagcgtgtgtttggtttggggacaaagtgggatgggttagacctatcccagttttttaggatgggatagttccagttgtctgtttggtttgtggtatgggatggttatagttttttgtttggtagaagggattgaggtgggatggg

SEQ ID NO: 19395 - DNA, 16544 bp, Oryza sativa
  unsure (1)..(16544): unsure at all n locations
nnnnnnnnnnnnnnnnnnnnnnnnnnnnnnnnnnnnnnnnnnnnnnnnnnnnnnnnntcccaggtgggacgagttcgtccggctctttttcccggatcgattggtcccggatgaggaatattactctccagggaccaatccatcctacccacccctcaaccaaacacctctaaaaggttcgtcccatcccatcccagcaaccaaacactacctaagttcatttttaaccaatctcacacataccaatacaaaaccaaccaacaactagaatacatatactttattaaatcttaatgcaacgataactctaaaaataaacttattttaagataaatataaaagctaaaaacaaatttattatgaaacggaggaaataattcctactactagtaacagtgaaacaccatcatctcgctgcaataaacccaccattttggccccaaccccttctagtgaacgatgccgtaatggcgtaatgggccatattttgcttacagatactcttttcgtcccataatataaaggatttttaagggacatgacacatactagtactacaactctagactgatttgtcacattactcgaaaatcccttatactatatgattgaggaaatatttcgtctaggctgaagaaaaaaaaaagaacagtagaaaaaaaaatgcacgaagcgggcggagcgatgagaggggggattgtcacctaccttggctggcatcctgcacctcgtcggcgccggcgggccgcgtttgccgctacttgggaacgttggacggcgaggaaacggcggggaagacgacggcgatccttcctcatcagtgggagtgggactggaaggatggaagggggaaccagcactggacctggagaagatcatggccatgggtgctactactagtccaagagggaagtgagctctgctgctgctgctgctacttctactactccagtcaactgagacacagcaccagtcagcatggtgcttgtgtgagaaggaacggcagccgaaactgttgagagcatcgcgaagagcatttgctacttctcccagcagtagaactgcatttgatagaaccgaagaactgctactccaacagtacggttgagctgacagcattttctatcaaccggagaactgttactccaacagtagaggttgcacagtcgcagcctgtgggccaccacggcattggttcctttactgctgtagctgccacctgccgcgcggccgccggaaacacccgttctgccttccgccgcctctgtcctgccgaccaccaaaaaccacacagcacaccgcatagtgatagattagtgtatggagtaattaattaaggctgtgtttagactgtggaaaagttggaagttgaaaaaaagttggtagtttatgtgtgtaggaaagttttcgatgtgatatgtgatggaaagttgagaatttaggggaactaaacacggcctaagaattagcaaaaatttaaaaataagttaatatgatttttttaaacatttttatagaaaactttcaaaaaccactattagtagtttggaaaacatatgtgtaaaaaacgagagagtgaaattggaaaggcgtagtaaataacacaccgggggtttagaatttcagatcatgcgatcttcgcaagctggatgagatcaaatgacaaaagctgacaaattaggctgctttcatttctcctataagagttggatgaaattttggatactcgtggcacgtttttcaaattgctaaacggtacgtttcgtgcgaaaactttttatataaaagttgctctaaaatatcagatcaatccattttttaagtttgttataattaaaactcaattaaccgcacgttattaccacctcgttttgcgtgaaacacttaatttttatcttcatttttatctccaggagatacaaacaccaccttaatcttcattgtcccaacttagggtgtattttagagtagaacgaactagaagatagaaaagatatacaaaatgagaaaaatcattagcgcacgattaattaagtattaattatttaaaacttttaaaaaataaattagtatgtttctaaagtatttttttcttgcaaaaactaggattgctagcccacacactcccaagaaaataaactagcaccaagcccagtcgacaattgctagccctacaaaggggtcaaatacgctatgcccatcaccagctccaagtagccaaaccctgatggacatccagccattgccacagagaaaggttgtgaggggagagcgtgagagaagattcactcgtcccccacaaagactcaatggcgacatctaagtgcgtcgtgcgcagaataaaccatttgaaggctgagatggtaagagacaaggcttcttagacaatgcctccaaggaagtcacggtgctagaaacactaccacaactgccttgcctacctatccactgattacacttggctttcaagtaaagaatctcactaggaaggagagggaggtatctcgacaacaccctcaggagagatcacaacgcccaaagcgtcaccattgtcgaccaagatcaccaagctatgctttcacttgtaggccctcccctaacattgcagctctgtcaccctaccaccaagcaactactactaccagtatgcgatcttcgccaagctggcgcccctccactgaccagctctccattcgaagcagacctcaagggaccttatgccgcttcctccgccacgttaatagccctttgtcaactaccatcacttctttcgtgcatcagatcaaagtgcacccatcatgtccgcctccaagcgtcgttcctcgttgtaagcctcccacacgaagcgagggcggcaagatccagccacctctgttgcccaaacaccactccgtcctttttccaaagcttcccatgatctgatctgataagtagatcagccgtagtatgggagaagcactgaggatgaaaagagagcattcccaacgagtcaacgccaatatcgctcacggggaggcatggtcgcatggggaagagggaaaaaggttaagacacaaagaggcatgattgcgacaaactgacaatgcatcaacttttggttggagggatatctctccatgggagatggcaatttaacttttgagtgtgtttaattggtgggctggatgagtcgtcgagagaggaaatattccacaaagatatatgaagatatctgcccttgctaattttgactattagtaattgattagcgataatatattttgttgttaattacttcctccatttcacaatataagtcattctagcattttccacatttatattgatattaatgaatcaatatagtatctagattcattaatatcaatataaatgtgggaaatgctaaaataacttacattgtgaaacggagggagtagtaattaacgtgtcactaattagatgtaagtagtccaattttttaatcaattagtatagtttcgggtagaattaatgatacctaatctttgtcttcattaccattacctaatagtttgttgtttatatttaatccattctagtcaatctaaacaaataagaaattgaataggcaaaaattaaactaccatatcccttaaaatataaatggtcaatatcttattcaatcttgacaaccaaccaaatacatctttattagccacaattcacacacggcccaagcaatccacacacggcccaacccagaaaccttccagattcctgcacctctcgacacttttggcgtcaccctcgcctatgccaaatgccaatgacgcactggcgctgcacgaactgaacccacctgctacctctgaaatctcttcaggatagccaggaaatcttcaggataaccacactcgtttccgtgcacaacaggctagaacccagatgctgcatccctcgctccttttcaggttagggctgtgtttagattcaaagtttggatccaaacttcagtccttttccatcacatcaacctgtcataaacacataacttttcaatcacatcatcaccaatttcaaccaaaattcaaactttgcgctgaactaaacacagcctaaaaacacaaataccgacagaattatagccgtattaaatagactaaaaaataattaattgcacagattgcgactaatttactagacgaatcttttaaatccaattgctccatgatttaataatatggtgctacaataaacatttgctaataataaataatttaggcctaataaattcatgtcgctatttaccgacgaattcgaattctataattagtttttttattagtgtccgaacacctcatgcaatactctatataatactcgatatgcacgccaaaactttacaccctcgtctaaacaccccccatcccccatgtatcgatccattccataagactgttacagcgtcatgcagtggcacggtacaagtgataccatcacgtacaacacgttacagatgcttcatcttacagcataatcttccaaaaccaaccagttgtaaacttggtttattatactctcacagaagtagacaaactgcataccattctgctgtcccgtaacataattattacgttggtacaagaaaccaatgcttctaaacatagaagcgctacaaacacaaccgcgatctgctacgtgtatcgtatgctgatcgcggattgttatggaactggagatacagattacagaccggctacaataacacttaagatgcccccgggcccacatcaactctgcaccttacgggaggaaacgacgcctggtgccgcagaagcgtgcctatctgccatggatattaccttcagcaatttgaccgggcacttatctatgcaaatatgcaccaggatttacccatgcatctatcgactacttaggctcatcttgatttattaatctccaaataaagtagtgagcagcaggtcttgcacaaatgttgctctgacactcgcttgcttccgtttctgttccctttcttcccttgtgagggatgagtcaatactgcaaatgaaaaaaaaaaattagcagatcattcaactgccaaaatttgaaatttataatgtatacctcccaaatagtcctaacatgcaggaagccatacagcagcttgttctacacgctactcatcagtcaaacaacttgctactggacatttattcagtacttcgtacaatgctattatcaacggaatatactggcttatcttattggactcgaattattgtgatcaaacatgagctcatgttctctgaacgtattgtacttaaaattgcattgaaactaaacattgacatagggcacgagtacaacaatagcttttatgaaattttgtgatgagtcagatagcgatgctagttctgaatttgcaagacaaccaagtctcaggtgttattcaggaggataacaaggaacaaggtaatcactacaaccttcgagtataccacgtgtttctatctagcacgaacaagagcaaataccttgaatcccatggctgagcaggtgtctcttttatcacagatgcatcatctggaatggaaataggtggttttgatgtttcctctgtgtctgatgttggaaagctaaggccaaacgatgacagaagagggtcagctgaaatatttgttgtgttgctgctgttgtttgacctatgtcccccacctcccagaagcacctgcaaatgggcttcacgtagatctcgactcagcaaagatagggcttgactgcctggaataacgaatctgcgcaacctgcgacgattctgcaggttgtataaaattagcaaacctcaagcgtgaacctctcaaaactcaaaaatatatatcttttatgcatcagctgtcatccacagcatgtattacatggggctgattggttgagtaggcactagataaatatacaggaaagcggaagtaccttgaacaagtacccatgttgcacagtgatatgattaagcatatcttttgcaatcttatcagaacatatagggcaaggctgaaatgaaggaaagaaacaatcaaaacaagacaataaactgttatctagaatattacaaggaaagaaaatatatttccagccatgtatagagcttgcagtagaacagataaacacaagattatgcagttgaggaataagaaaagaggcatctgtgtgagtccaacacagaacaatttgatttttttttcacaaaatacaaaagctaatctgtttttacaccttacgcaaagcagctgcacaacaagatggcaagagcaaactttctctttcactccaggttccataacacatactcaagttttacctaataaacgaactagtgaccatatgaacttcggacaagctgatcctgaaaactgaggcaagcaaaatttaggcctcctttgaaacaaaggatttgtggaggaattttgtaggattccaatcctataggaaagtttcatatttggtcctctgaaacaaaggattggagcttctcaaatcctatgaaattccttaggaatggctcaatacatgtagattttagaggaaagctagcaagagatacaacctcttggaaaatttcctttgagtctatctttgtcatctatttcctgtgcttctcctattcatgtattttaccattcctcatttcaactggagccttaacttatctttggagagctgatggctatatatattaaccacagttaagtacgctatcatttcctcaagcatttgcttataacatcaacgattgccaacatttccacttcttttttttttgcctctccatatacctatttttgcgcagccccaaatctggtcgtggctccatgcaaaactacaaacttgattactactttcgatgcccaagagaatgatccaactaaaattgcatcgctgtacaggtcaacacctcaagctttccatcttttaattcagcaacatatgctctaagcatgagctcgtcctccaggtcaaccaaaacaaagaacgccatctcttctactcatccaacaagagcagattacgagggggacgaacaactcaccgccgcatggggctcgaaggggtgctcctcctccaggtgcgcgcagagggagacgacgtcgtggtcctcgtagcagtaggggcacgcgaactccggcctcacctcctcgtccatgtccacctcctccatccccgctcgatctgcacccagcaaaaccaaaccaaataatcagaaaaaaaaaatccccccattaaacagcccccgcaccgcacggcaaaagggagaaatcgaacaaatccgaggagaagagagagagagcgaggtggacgcaccggcgtggccgagctgcgcggcgtagaaccgcttggcggcggccaggcgcgagatccagtgctccgagtccataggcttcggcggagcgggtaagataaggctcgctcccctcccctcccccactctcctctcctcgtagcgttggccgccgctcctctcctcggctccacgcgatcagcacggcggagatgtagctcggcggggtcgtcggcggggagaggaggaggagggggaggagatagtctcctcgtgccttatcgggaggtgaggtgaggtgagatgcggggcaggagtgaggaatggagctaggtataccgcgggtttttttttttattctttgggcaccgggtcgcgactcgcgaggtcgccgtcccccgccgcgtcatcgactcctcaccagccaagccggtggctgccgctgcctcccggtgtttttgggcggttttactcttaccccgccgtgaaacggaaacacgccgcgtcgcctttgtcgccgcccaccgtatggtggattggtggggccacgccgcggcgccggcggcgttcgcgccaaatgcccacagcgtacgggcgtgggagtaaaattcgttggcataaaatcgcatccgtcaccgtgagcccgtgagaccggaccgtggccgagacggcgaacggccgaggacggggtgagccgggctccgcttgaccgcgtgaggtcggcgcatggtcgggctagcgtgggccgtggggtggagttcgtgtgtcggcaacagcgtggtggtgtcgctccagcgacgcgtgttggtagccatggcacatcgggacgaccggacgagtatacgtccattcttctctcagtactccctagtccctagtcttaaaaaaaaaaactcaattcctaacgttagttccaatttttttttccaaacttctaactttttcatcacatcaaaactttcctacgcacacaaacttccaacttttttatcacatcatcgtaattttaaccaaaccaatttcagtgtgaactaaacacagcctgtttccgtatataacgtttgaccgtccgtcttatttgaaaaaattataaaaaaatttaaaaagataagtcatccataaagtatgttttatcatctaacaacaataaaattactaatcataaaaaaaatcatataagacgaacgatcaaacgtttgacacggaaatccaagaattgagtcttttttggagcggagagagtgtctttttagaacggagggagtaggagttactagcagtaactcagttcagtcattataatttttaaacggttaaatgtgtcaaatgctgcgtttcttgaaagaattttctatataaaagttgcttcaaaatacgaaataaatttatttttcaatcttctaataattattaaaacccaattaacatacattaatgatttttttcctaactttaatctacggggccatgaccggagttgggtgcaaaagcactgataagcctactaccattctttaacccactcctaaattaaaccctctaactaaggatgcaaacggaccgacccacgaatttacttataggtcaaatactagatgataaccgcatctaaatatgcaagtgggtcaatatatactcatttttaggtcaaattattaggtaacccgcgggttacccactaatttaactcgcgggttacccactaattttatctataagtgggttcgcggacaagcccgcttgcaaccctacctctaacccaaaactatcttgacttgtcaacaattacggattacgggtacaacttcccagtccatttcagaatgaacattttgtaccatcaaaatttcgtgcaataggtacaacaacatctacacctaggcatttttagttttttactccaaagcaatgtgaatcagactaccaacctgaaagagattgtacaaaggaattcctcctctatgcaccacaaaagctgtgtataacgtttctactagttctcatcagtatctcacacatctaaggccgcattgcctttttgcatcgtgtcacatgacctgaaaaagctctcaacgagaaattcgtcgcggctgccggatgatcaccagttcaacaccaccaacacaagaaaaggctttgatactacatcggtgcagttgctcgatctactgccccagcagccgcttgacgccggacttctggtcggcggtgagcctcgccgggaacttgatgtcgaacttgaccctgagattgcccttcttggaggggtccttggggatgggcatgccctcgccgcggacgacctcctcgtagcccgggttgatgacggaggtgatcgggatcgtcaggctgcggccgtcgagcgtagtcaggtggacggtgtggccggtcagggcctcggcgagcggtatcttctgcgtcacgacgaggtcgttgccgtcacgggtgaacaccgggtgcggcttctcgtcgatgatgaagacgaggtcggccgggatcacgttcggctgctcgtttcctttctccgggaaggtgatcttggtgcccttcttccacccaggcttcacatcgatggtcaggatctcctccactggaattgtcttcctgcacaatcacaatgagcagcattgttcagtacacaatacgaactgaaacataaggctctgccacattggattattagattaaggaccgaggagaattgctcaagcaattgattaaatactaatatagctaacaaatacaactagcttaaagaagttgtctacacaatgcagtttgtgaagaaatcataatattagaagcgtggcacaaataatccatatctcaattactatctatctagaacacgctgtaatttggagaatgtatgaaattaaaactatttggatggaaacagttttaagcatccatcccaaattcaattgacacaagtgctgcagtactaaataagtactgctaacaaaaatcgctaatggccgttcgaaaaaaacaaaaatcgctgatgctaattgcatactaaatcaaaacagttttaagcatccatcacaatttccaatctgataacagtgctacaatactaaatcagtactaacaagtgacaaatcgttaatgctaggacatactccagtaaacaagattgttaattttgtgatctgtgaagcaaagggagagagacttacccactggcgtcagcgatttccctggaaatcttcatcttcttggtggtgcctttgtagagctcctccaggctgcacggcagcttcctctcgatcgccggcgccttcaacgccctcccggcgccaccgccgtgcatcccgtggtgcccgtcggcgccgccgccgaacgccgagccgaagatgtcgtccccgaagatcgacgacgagaaccgcgtgccgcctgtccgcatcccgggccctccccccatgccgccgcccatgccaccgcccatgccgccgaacgggctggacgagccgaagaactccgcgaagatgtcctccgcgttgcgcgggttgaaccggaacacgttgggcccgtcgccgccggtggagaagaacgtcgcgcctcccgggccggccccgccggcgcccggcggcgggacctgccccttgagcccctcctcgccgtactggtcgtacaccgctcgcttctgcgggtcgctcagcacctacgccgacacccagcacaagcacaaacacaaacaccatggaagcgtcacgtcattgcccaattcagcaaaaaaacgaatccactcagaaacagatctctgtctggctgcttacctcgtacgcctcggagatctgcttgaacttgttctccgcctccttcttgttgttggggttcttgtcagggtgccacttcatggcgagcttgcggtacgccttcttgaggtcgtcgtcgctggcggccttgtcgacgcccaggatcttgtagtaatccatccccatgggctaaaaccttcttgagctcgatctgttcggcctcttgggtgtggtcgcgtcgcgttcttggctattctcgccggagaggagagcttcgtgttgccgtcgctgcggttgtgtggtttggtacgatgctggggggagagagaggggggaagaaaagaggggagagagaagagtctggagagggaggagagaagaggagtgtggagatgggtgtggaagcttccagaacgtcctggagggcgcgcgcgctatctcggtgcacgtgagacggacggacgcgtagttggttcggttgggtcggaaatattctgcgctcatccgtcgtcagctgccagcctgccacgtttgcagcttgggtccaaacttttcgatgagagaatttacgcaagaatttatacgattaaaatgttatataaaattttccatggagagctttgattttaaggatttggagttttccaaatcctacaaaaattactatgagtctcattggttagcctaataactcaaaataagagctaaaatttgaattttcgaatttggttttgaagttggtgggactatggaatggctcattgcacgtaggttatgcagtaagtttgacaagaggtctaactttttgaaaaaattcctttgaatctatctctctcatctaattcatgtgtttttcctgtggtccaatcaaacgaccattcatatatctgtttttgtgttttacaatcctccattttgtacttgcattcatatcagaatctcgtgtttttttatttctatgattcaaagggcgtttcgtttttggaattcgatttggcatgtggtctttgtttttatctcggattagagtttgagtttctgttcttcaaattttgttcgacattgacaagttttggcaattcttagattgctaccatgtcaattttttataatgtcaaattttagtatggttaatttaacaaaattaacagcccataacccccataacgaaagcgccaccgagaccaattaccggcgatgccttctcatcaagccggatcgactactcggcattgctacatctgcccagcaactcaaccaaaggagagatgaactcggcatgcatgggagtatcaatccggacatctctatcgccttcggcataaagaatagtacgatcatgttaggccaacccgagattagaactcgcagcaaggaatgcaatgcagacagcgggttccatattggatgggattttatcgggcttcccctcttaacttttcctgccgtacgaggtaactttgtacgggaatgatttccgacattgaatatactgtgtatacatcctgctacatgttggtaaattaccaatacacttctacaaaaccgataatcctctactatgtatggataaaccatctgtttgagctagatagaaccagatgtaaaccgtaccatcacttggttgccacgtgaccttcaaaaggccagacttcttaattcattcgttttattcgctatactcggaagaatatgatgtaccgtcttcatcctcgtcaccgttctccgctccaccaccgccaccatcgccatcgtcattgtcctcgacatcatcctcgcccatctcagcatcgtcgttgtcttcgtcaacatgctgttctgcatcgtagtcctctccatcttcctcaccatcttcatccccttcggcatcttcttcattatcgtcactcccatcatccatcatctgaagagggctggacccagaattgtcccttgaataatctgggagcagctcatcgtactcctcgttcatgggttcactattttcctcactcgattcctctgactgagaagctgaattgtcctcatcatccttgacatatgacggccttctctccaagccccactcttctgcaccagaactctgaggagactccatggctgttgtatgctttgcattccttagcatgctaaagctgcccagcaagtttggctttggaattgatctggctccaatatctgatggctgccgaggtctaacagttctaagtccacgcccacgtccacgattacgccctcgacgagcatactttcgaggagctttctcagatgacacggcgctggcactgtaacccctgaactcgatcttgggggagctgctaatacctcttgggaccttgccaccacgactccgggatctgcctcccctgctaccgcctcgactacctcgtccacggccaccccgaccgcctcgtccgttgcttggagttagccatgtttcttgtcgatcaaaacctgttcccataggttcagtttcttgtttggtcttagcaggagtatatcttggcggaagcttctgcatagaagtatcaacacaattacacaaagggacagctagaagggtgtgattcaaaaagaacaaactgctatataaatcacatttaatgaatgaataacagtattttacgctatctatttattttccttgcgtaaaaacctcaatacaatgatcataagaaataagactcaccatgaactctccagctccccgctccttgtttgatcccaccttctgacgaagagtgtatgagatggcagaatctaggtctaacaatcttaagacaacagcagcaacagtgtcaggaacccatggaagtacatcagcagatccagaacgtggaacagtatttcgagaagctgaatcttgcgtgcttaaattaagtaactcagttgttgtctcaaagtcagatgacaagaaatcccgtcttatggcaccttccagaatggttagcatctggcaaagcatgacaaagcacaattcagaggctgataggcatagccaatatatacgaaaaagctgctatcaaattgccaagatttccattttaaaaatcaaagcatttatcttgcagaatcaatttgtcacggcaggttttttaacgacccattcttccaaagagaaccccttgaactaaaaacacttcctaaatagaccaaacaggaccaatatgatttagtcttccagcaacatgtgtatcatggcagctaaaataccagtacagtaaacacagcttatttagtgaaataatttcctataagtatcatgttactcttgccaaagaattatcctcttaataatttcctatagagcaaacacagcttatggggttccaagtgaaaccccaatggaccaatgcaacttatgtctagcatagtaatactcttttagcctgctattgcaaatacagtagaactcagtgtaaaagatgtcctcaaaacggaagtaaggaactgctgggtgtattaaagaaagagaaggaaaagatgcacaaacctcaaagacttcttttgtagacgatgtggaatacaacttcacaccccaagatttccgataaacatctgtccagaatggttcgagagcttcagctggaactgaagcctgtaaaacaaaatgttaacaagttagacacactcactacttgcactcaacaaaatagaaagataaggccacatcagaaatatgttgcttgacctcaacggttgctaaaagcagctttagcaatctcaatcctacaggaacagaatagtctgaaatttgcatcttccaattaggatctgttctccgtttctcttcacactgtgaagagtgttctgagatattgtgaatggatttgaatgtcttgtggcaagaagcacagtgtgtttcttcagctaagtaaatctgatagcagaaatcacaacattgtatcagctcagagcatcgtttctttccatgtttcatggcacatgttggttggtgattgttgcattctttccacatccactttataaacagatcagccctttctgaaattgcagtcttttcaacatcattacgcccaagttctatcctgaaggaatctgaatatgccatagcactatcggttgcaacaccagaaagggtactgcatggacttccaaactcgttactatgattcggacttatgatctcactagttccatttttcaaaacccttccggccgacggttctatgctggcacaccttttcctcccaatagcttccttgaaggttggttcaatgctttgcaacattgaatgaagatgtgactcacggatgccacgagtatcaagagaagatactaatgcatcaaaagtctgcatttaattaggcataacattgaaattatcagagacccagaaagtacttggacaagggactcttaacatcaaaagctggttcttagataaacaaaacaaaggacaatataccctaaatagagcacatatccatttacgatgcaagtattcatatatatataaaccactactgcatgtagcatctaggttttctacaactagtcctgggaattgttcagttgctgttatcaagtacgagcccagaacaccacagaaaaatcttgaatcagcactccgataggtatcaatcatccaagagagaagttagaaaagcctaatctttgattgaatccaagcaaatgcccgtacaatttagtaccactgctccaccagttaaaacactggatcatgacttaatcatttaactgatgtaacccagaagttgtgctcgacatgatatgtccctatccttagataaataaaagcaagctttaaaatagaagcatatgggatagtgagaactactatctaagcaatatggctcatgtcaaccaccaagacggtttacattttcaagaccctctaaaataattccactttactattacaactgtgacatcgtctagtggtatggacaaatctctctttatctaccataagtaaagctgatgtagcgtcctatttcaagggatacataaattacatgaaaaagtgattaatcggcacatcgaaacacaaacctcaccagctgaatttgtgctgttagtataatatgtattgtgaataagctatgggttacaaaagaaataaaaatacctcaattgagtcaatcagcctccagtatccatctctagattcaaaaaagatccttccagaaccagggtcatcgggggatgcagaagttgaaaactgccagtaccggtttcttctccgatcttgcccgaggggtagtgatctgtatacatgaagttgttctgctttgtggcctatatatgatttcaactgagatcttgttttctcagatgtaacatattgttgaccagacaaattttctggattagcactaaattcctgccttacaccgttcctttcatgaaccacgctgcaagcattaggctgactctgctgatcgannnnnnnnnnnnnnnnnnnnnnnnnnnnnnnnnnnnnnnnnnnnnnnnnnnnnnnn

SEQ ID NO: 19396 - DNA, 1059 bp, Oryza sativa
ttttctcagatgtaacatattgttgaccagacaaattttctggattagcactaaattcctgccttacaccgttcctttcatgaaccacgctgcaagcattaggctgactctgctgatcgacaggcaactcgttgtttactaagctgccatttccattactgtctttaacaaggttatgcaccggtgtaagattactttcggcgagagtattttgttgatctacatcggtctttaaacccataccagaatcatattgcattttactagaaaattcctccctcgaacgtcttttatcaagttgtgcttctgcccacatttgctttttcaaagcacttgctgcctccagccgttcctgcaaagatccttttggttcagatgatgggaaaatgacaagatatcaagatcatgcaagataattacctcaagaactgcacgtatagaatttccttcagtggcaacaccaatcaatgcaaccaatgcattgaggcgctcctcaacactgagatcacagtagtcaccctccgctagcccctgtacccaggactccccctggttactttcgtcaatctctgcgtcttgagcactgtcggaagcaccttcatgattatccgatgagatttcagctggtagatcacttgtagtacggacttgtacagacttgtccagagtgcgcaatgagctactctcagaagatttagtgtggatgagtggtgtcgttaatgagttaactatgctatttgtttccttctttatgtcaccaactgcagttggcatgccaccatcttgtgccttaaccagggaagtcttgacatctttttcctcaatattcacttcatcaccatcaggatcatcgtcagcatcatcacactcagaatcttcatccctctcagcatcatccacatccttctccacttcttcacactcagaaatagtgttctgaaacacccttattttttcacgtgctgctgccaacacagcctctgaatcagcaggatctttcctgtatggagttttaacacagtatgttgaaggcgcagtcctttcgaaaagctttgaatc

SEQ ID NO: 19397 - DNA, 950 bp, Oryza sativa
ggggtgtgtgggtgtgaccggatcggagacgtgccgccgttgaatgagtttgaccgggtaaccggcgaaagcagcgttggctggcgaggaggaggtttgggataaagacagggcgcggcacggcacggcaacccaacccaccggggtccggagaccggacggggcggaatacggtggcggccgcgcgaaattacgcggctgcccacgctgcgctgcgcgcggtgtgtgtcaggcgggcgtgggattgcgggtgcgctgaggtggtcgccgttggtcggctttgcgttgcgtctcgtactctcgtctcgttcgttcggcttgggcgccgaaagaggaggagagagagagactgagacaccgaggagggagaaggccgcgaagagggggtgggtgggtgaggtggtgtgggccccaccggcgcgctggggaggcgggcaattattgttgtctccatcgagcggtggcgagacctgcccggaaaagtggacggggtgacggacggacggcagcggcgtgcaccccaaggccggctactacttctcctcgttccgttcgtagctgacacaagattggacgagcgagcacctctcgcctttggcgaggtcgtcgtcgtcgcggcgaacgaacaatcgttgaaatcaaggtactatagctgtacaggaaacgcgagggaaaaaaacgagcagcacgtcgtggtggtgggggtggcttggccggagtcaagtagagcggccgtgtgcgtacgcacgcacgtcggtacgccacatcagatccccgtccgtccgtcctcccgtgttcgcgcgcggggtcgcgtcgcggccgtggacggcagggcaaccgcgtgttcgcagggtcgtgaccacgacgtggcgctctcctctcctctctcctgccgcgcccgcgacgcgccccggtggccaggctaggccatgcgacgcgcattgaattgg

SEQ ID NO: 19398 - DNA, 780 bp, Oryza sativa
  unsure (1)..(780): unsure at all n locations
nnnnnnnnnnnnnnnnnnnnnnnnnnnnnnnnnnnnnnnnnnnnnnnnnnnnnntgcatcccggaaatgcttgggaggaagaaaggatcgtcgtccaggttgagtgatcccatcaacacgactgtcactactgataacggccaggaaatggctgcttcgcatttcatctcgcagcaggcttcacagctcggtaggttcaaacccccgcttcaaactttcaatggacgtttacattgttcccggcgtaagttgagcgataagagagactcatagttcttctctcctctttgtcagatgaggctgcgaggaagagactgcaaagaatgaacgagaggctgaagttgctggagatgcagatggaaacactggaggctggcgtcgcgaaggcgagcaatgactcctacgagtagagatgtttagcaatctttgttatagacaccaggtttggtgacatgcaagcaaaattagatgatagcttgagtagttttacctgaacttgcagcaaatcaccgtcacctcgttgtagaattccggatctgtttcaggtttcagcgcttcagttttgttctttcactacgagccaataagctttagtgcagatgtcattcaagttttctgccagaaggaatttacagaatttgacccatacaagcgccccgcaggcatacaagcttgggtatttgtcaatttgacccacagcacaacccatgatggactttcgcggggtcnnnnnnnnnnnnnnnnnnnnnnnnnnnnnnnnnnnnnnnnnnnnnnnnnnnn

SEQ ID NO: 19399 - DNA, 769 bp, Oryza sativa
  unsure (1)..(769): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnatcttaagaaccgaattgaagcctctgtggtcatttggcagaggaaaatggtgcacaaggaaggtaaattgtcatgggggcatggtgtcaaatttgagaagcgggagaaatttgaagcaagagcagagaatgtcctcctcctcatcaagcacagatttcccggcattgctcagtcagctcttgatataagcaaaattcagtacaacagggtataccatgagaatcatctgcttttcatgttgtcttttcggatttgctacagtacgtatgtttactcattgcaaaaattctctgctatttttccccctcaggatattggcttggccattttggagagctactccaggactcttgaaagtttagctttcacggttatgtctcgaatcgaagatgttcttcatgctgactccctcgcgcaagcttctaatactagaacccaagaatcaatgagaatggccagcttatcaagatatgacactgataaggttgtcattgatgctaaggccgaggtagagagactgggaagaatggaaccagtttcagcgacactatttgactttgtcagtcctcgagatcaagatgttgtggcgacgaagatggactcaaaagaaaagggatgtagnnnnnnnnnnnnnnnnnnnnnnnnnnnnnnnnnnnnnnnnnnnnnnnnnnnnnnnnnnnnnn

SEQ ID NO: 19400 - DNA, 2246 bp, Oryza sativa
gcaaagtggtgtggactgaatttttgtgctctaatagcagcacccaagctatgcttagctaaactattgtctattccatttggacttacaaaaatgttgggcaaattattattctatactaatgatgaatacataagccaatgggaatgtaagaggatgactatagcacaaacctctagttacataacttttgtatttttcctcctaggatttccagctccttttaggatatttagttaatggtgaaaaaggtgtattgtaaagtgcataatttacatgtggatttgatttttctaaactaaagcatatttgctaattcttccatttatacacgggtttttaaatgagcaccaaagttgggcaaatggttaggtccatggagatggagatcacacatgttggtttgaagatttttatatgaaatgaggggtgggaggatggatgtagtgtaaagcactaaagcatcaccaccttcttcaattgaaaattcaatgtaacaatacatgcatatatatttgactacagggcacatgatatatttcgcaattcagcacattttgcaagtaaaacaggccattctagaacaacacaaacacatccacctatggttagtgcaagaattcatgatgtgataagtttcagaatgagcttaagtttaggaacatgctaccatctgtctagattcatagtactaggatgtgtcacatcccgttctaggtttgatttttgtgggacggagggagtacttgattgcttggcttgcttgctctagataatttttcaagtagaactttgttctgtagatattgatgcatagacagccaaccgggataaactgcatagctaatatttaacatgaattttcccacttcctcttgcaattgtcttcttaaaaaaaaaaccaaactacttatcataactcataactagcactatctttcttgccaggttcaaaactctgtacaggtgctgcaggataagcaagagcttgctgaaacccagaaggaactaactaaacttcaaatattacatgaggaatctgcacagaaaagcgaaggtactgctccatcagttcttatgacaaaggaaattgacggcagcatgccagttgcaaaacatgagcttgcccttgtgcctctgcatcaagtaaatgctgcccaatctcctgctatgcaattccaaagttgcaatgggcttgttctgcagcaactggtcccagtctcattgagcactcaacaagaccagcagcacatgaaccaagccaccttgtactgtatgcaaacccaagctcatgttgagcacaggcaggcccaaccatttcaacctgcacctcaacctgtgcagcgacatacccagaatacgccacagactgtagttgaggcacaacaggtgacaagtcaggccccagacttctacattcaacctcagcagcaatgggcacatcaaactggccagcaagttcaccaggcaaggcagccacagccacaggttgtgcaacagcaacattacaacaatattcagcaagttccagcacagatagttcaaatgcaaacttcttctccacaggctcaaagtgcaccacatgtcacactgttgtaccctccttatggatctcaacaacctgcctgtgctaatagtgagccacgctcgcgaagcatggctatgcagccttcctactctacaatttcctcgtcccaaaggaatcatcatgaagtcgctcctgtttatgtgcaaagcaacacaatttcagtcccactggctgagcatagcatccagtctcagcagccaccgcaacttcaatcgtttggtaatggctcatttaaaccaagcaaggtcagcctacatggtgttgcctcatatacagtacaggggaatgcccaggcctataacactgcttatggaaatccgtccaacaatgctgctactgttgttgctgtccttcctcaacaagcccagtctagtgctcccatggtgcttcatcatttaggaccacagtctctgcagaatcatccaatagacatggttgaaaaggttgctcgtatgggttactttaaggatcaagctgagagcatggcacttcgaatggctactgctggacagaatgtagagttcaaacacctcgcttgacaagcagatctctggtggcgatgaggtggcgagtaggagaatgaacaagccagtttggaaccgctgcatgtggtttgttggcttgttcctgtgaaatattatgatatcttactatcatg

SEQ ID NO: 19401 - DNA, 676 bp, Oryza sativa
  unsure (1)..(676): unsure at all n locations
tttgagtctgtaggaaaaaagtaatgttttccaaatattggagtatgtggcttcagaccgccgacaatcttatttggtccacaaattaggccaacatagaagcacaggtttggcttgtttttcctccaaacaagaaaagcatagaggaaggcaaactggcaacttgttttctgccgaacagaatattcattagagtcgtgcctagccagctgccaactgcagaaaagcatagaaatcaaatcttttttaggacggagggcgaggtcattatcagaacaagggttcaaattttcaactaaagcatcggattcagatatcgggcacaattgcccgggaggcctaggactgaaccggcccaagcaattcacacacggcactacggcagccagaaaaccatccagattcccgtgtcacttgagccgcttggcgtcacacgcgccaccgccaatgacgcactgtccactgcaccaacggaacccttcccccggcggaatccttctactagtacctctgaaaatctcttcagtgtttgccagaaaatcttcaggtagacgcacactcgtgccgtgcacagcaggttagaaaccagatgcccgcatcgctcccttccatcagattnnnnnnnnnnnnnnnnnnnnnnnnnnnnnnnnnnnnnnnnnnnnnnnnnnnnnnnnnn

SEQ ID NO: 19402 - DNA, 583 bp, Oryza sativa
ccataataaaatggcaaagagaaccatgatttagcttcaacaagaagcgaatggggttaactgcaaattacacgcaacgaaaaccctgcatcgagggcacccagccgccgtttgtttactcctcctccgcctccctttttcttcttttttttttctttttcctcctctatccacctcgatcgccatcaccaactctcgatttgcgaggtgaggacgagctcgccccgggcttgattagctcaagccctgaaccccccagagcagcagcagcagcagcggaggaggaggaggagggagaagagtgcgggcgcctcgggaagccggctgacagtggtacgtgcatccatcgctctctcctttcccctcctccgctctctctctcgatccatctttccctctctgttttcaatctacagattcggttgattcagtcggttgtggtgagggaaaatgtcctcctttcgtgatctttatgatgcgttctttgtagatcttgttgttgatgagaggttatgatttagtagcatgtttgtgggtgagattagagggggggggggggttgaatcttgagctgaccttgagg

SEQ ID NO: 19403 - DNA, 645 bp, Oryza sativa
ctattctgttgctatgtactgatactactagtatccagacattcgataccatatagtaatgccaatgtacttagattcctcctaatcctagtgccaataatgtggctacaaattaactctctcaatcatggagtaggagcacacaataaccaaaaatttaatgtcagcttcagctgccttagtcatgtttaatgatatggtgacactgtcttgactttgttgctaaggcactgacttttttcgctaatcaaaagattagccacggacaagatgcttagttagttagattagatattgagttggtgagattagttaccgggatgatattgagaggcttctggataacctgatcctacagaatggacggcttcgattcatcctgatccgacgttgttggcttgttgccaaccgacgtggctaccattttctgacgactcgccggtgctcgtgtggggccacactgtcattgaccacccactatcgtgagcaattctcagccgttggattttccacatggagaatccgatggcgccacgtaagcacggcaggagggtaggcgcgtctcttgtgggcccctgtaccgctcctactactacgggtgtaaagctggaggtaatttgcagggacagccctgcttaatattgg

SEQ ID NO: 19404 - DNA, 439 bp, Oryza sativa
ccaaattacaagcctctgaatagggcatcccaccctgccgaggctactgcaaatcaggatcaacgcaaaggattcaagaagtggctgtatatagatctgattccagtggctcgcctgattatgcttgctggcatggcatggatgttcttgccatgccccaagaaatccgtcgcgactattggccctcgcacgactggactcactggccaactgcaaaaggctccgcgtcacgtaatactgcaatattcgccattttgatctgtaacatccactcatattgacctgctacatcctattcttataaccgaaagctctcgactgcgcccaactctggccttcacatcaaatattcatgtcgcctctccggctctcactgcgttctgacctcaacgtgcctcacgagtgccccaactacagcccccacaactggaacgagctt

SEQ ID NO: 19405 - DNA, 668 bp, Oryza sativa
  unsure (1)..(668): unsure at all n locations
accccatcgagttctttcgtgctcgtggtgctgattctccaagctgtcgtgatcggttgctcctcactggacgagctacccgttcagcttagcaaccggaggctacttcatgacagaaatcacgctgctctactctacaaagatcatttcccaacagttggaaacatgacgtttccaacatctcatcaactgcaaaatgatccaaattacaagcctctagatagttcatcccaccctgccgaggcttctgcaaataaaggatcaagcaaaggattcaagaagtggctgtatatagttgtgattccagtggctggtttgattatgcttgctggcatggcatggatgttcttgccatgccgcaagaaatccgttgcgactattggcccttggaggactggactcagtggccagctgcagaaggcatttgtgtcaggtaatactgcaatatttgccattttgatttgtaatattttcttatattgttctgttacatcctattcttataacggtaagttcttgactgtgttcaagtctggttttcagatcaaatattcatgttgtgtttctggttttcactgtgttctgatctgaatgtgcttcaggagtgccccaattacagcgtccagacgtgnnnnnnnnnnnnnnnnnnnnnnnnnnnnnnnnnnnnn

SEQ ID NO: 19406 - DNA, 726 bp, Oryza sativa
  unsure (1)..(726): unsure at all n locations
nnnnnnnnnnnnnnnnnnnnnnnnnnnnnnnnnnnnnnnnnnnnnnnnnnnnnnnnnntcgatcaaaacctgttcccataggttcagtttcttgtttggtcttagcaggagtatatcttggcggaagcttctgcatagaagtatcaacacaattacacaaagggacagctagaagggtgtgattcaaaaagaacaaactgctatataaatcacatttaatgaatgaataacagtattttacgctatctatttattttccttgcgtaaaaacctcaatacaatgatcataagaaataagactcaccatgaactctccagctccccgctccttgtttgatcccaccttctgacgaagagtgtatgagatggcagaatctaggtctaacaatcttaagacaacagcagcaacagtgtcaggaacccatggaagtacatcagcagatccagaacgtggaacagtatttcgagaagctgaatcttgcgtgcttaaattaagtaactcagttgttgtctcaaagtcagatgacaagaaatcccgtcttatggcaccttccagaatggttagcatctggcaaagcatgacaaagcacaattcagaagctgataggcatagccaatatatacgaaaaagctgctatcaaattgccaagatttccattttaaaaatcaaagcattaatcttgcagaatcaatttgtcacggcaggttttttaacgacccattctt

SEQ ID NO: 19407 - DNA, 744 bp, Oryza sativa
  unsure (1)..(744): unsure at all n locations
nnnnnnnnnnnnnnnnnnnnnnnnnnnnnnnnnnnnnnaaacagcacttgtaagaaggttgtgttacctttctaacaaaaggccaaatgcctatctttccatcaaaagtgcagttaccttcatcatcaaacctaggtctcgcaaccgccgacaagaacattaccttctcaattgcattcttgttttggacagtcctatacggctccggctcaagaggatgtaggtagtaagtcttgtcctttttggtggcgttgaaccatttttcatctatgtggataatgttttccatttcaataaacttggggttgtttggcaacgtacgatggtctaacataccaacacaccaccgcagcctttcttttttattggcttccttcaaataaggcttcaatgagttagagtgacgtcgtagatgcccttctttgaacaacctatgcaatgtgctttttgacacacctagcgcttcagcaagtgaccttatagtgcttctttgccgcaatggaattgctgctacaactgacaaatctatttcaaccttcttgcgcccacaattataacgcttccttgagtcaacattgacttgtactccctgtgcaatgcanagttgtgctctcttccaaatacgttggactgtacggatgctcacattgaacacttcagcaactacacgtgtgctgcctttttctaggtatccatccagactttttgtaagcaacaattcataaatgcttcggctttgtgggt

SEQ ID NO: 19408 - DNA, 909 bp, Oryza sativa
ataatcgactaagctcggtaggacccactgtataacaagtcttatacggaatcatacctcgtatataaaagagttcaggatccatatttgttttccaagttctatttggacaaggacaagaggatatctatgggtataaatacaaaacctcctagggggagagaaaaagacaagccaacacaaattaacacgctcagtcagaataggcaccaatacatgccaccagacaccgacatcagagataagcctagacagatccaatctggtgccattagaggccaacaagagggatctagcgctatatctgatctcgccgagtacatatttgaggaagaagactaccccgtcgtcaactaggtgttggtgttccatgccgccaagttgacgatgactagaaaggttatctcaaatattgtacttgtgtgattctgatgaataagagcaacaccggcttcggccaataggagtagggttattaccttctggtgaaggggtccgaacctgtataaaaatccttgtcttcgtctcttttatctcaatctcgcatataccctggtaccaatgatctccatactatgcaaacaccatagtcgtgatctaaaacatcgacaatggtgcgcctagtaggggattttgatgcttcaaggtttcgacgagatgggttcaagaagacggattgtccgacaacaaacaatttggctatagggggatccgacccaaccgaagtgcgttctccgatggatcgggatcctcagtcatcttaagcttcgtcgccgaggatttttttcgacgaggatacttaaacgactttggccctgggagatctgacccgaccagagtacgtcccttgactagatcaaatcatcgtcgctaacaatttgatctatcgagatcacccaagcttgagta

SEQ ID NO: 19409 - DNA, 9713 bp, Oryza sativa
gactcccctcgggggagggccgcgtggcatcggggggccagcctcctccatccagtctctagaaaggagtggccgccaccccacttgggcttattcgcccctcgggggggggggaagggggccaacgtggcctcggagggcagccttctccgactagtctttgggaaggagtggccgccaccccacctcgggcctaactcccctccgggaagggccacgtggcatccgggggcagcctcctccgactagtctttgggaaggagtggccaccaccccacctcgggcctgactcccctccagggagggccacgtggcatcgaggggcggcctcctccctctagaactgatacccccgggcccatatcaccgatagtagcccccggcgttagccctgaccaaaacttttcccaggtggtcaaggttgacgccactctcctagtgtgatgatatgttggcccggtctcttcttctttctttgctggcactaggacccatgcacctttttcgccccagcctgagggcgactcgccagctcgtaccttaggctgtgaacttattttctgtatatattcagcaaacgttgttagattctctcgggcccgcgacctcatgtcgcgtacctcgcttgcccctgcctcttgttaacctctgttcgtgttctacttcatctattcaaccgattattttagcgtgagtgtgaggactgaactttccatagctagcaatcttcacccgcgatcaagctaagctgggcaccgtagccagctgacggggccaaagccagccgctacggaagagttagcacaaggggccccaggcgtcgacggtacccaaagctcgatgcagggctaggatagagctaggaatcgtagccaccacacttgtagcaaaaaatcgtttggatggataaagagaatacaaactttttgttaccaagggaggcaagccagcgcgtgacacatgggtaccgcgggaccgcgaggaagagatgagagataaatataagcaataataattctatgcaaatgattatcttcgcacgagtgcgaggactaaattttccatagccaacaatcttcacccacgatcaagccaagctaggcgctgtagccagccggcggggccaaagccagtcgctacggaagagccagcatagggggccctagacgtggacggcgcccagagctcgtcgcagggctaggatggagctaggaatcgtagccccccacacttatagcaaagaatcgcttgtacgaatgaagcaaacacaaaccttgcttgcatgtcgtgacctttcaaaccgttagctcgaagagggcctcccaccatgggttcctaaccatttgggaagcttgcgaccacttagcaaacgctgcgaccacttagcaaacgaggtcaggttcccatgagcctacgtccccacgctacacattctgttcgctctttcctttcggtggcctccttccaatctcttttcctcccacatggacgattacttccgcacgagtgtgagagccgaaaaactccagagccagcaatccccgtccacagttgagccgggccaggcaccgtggccagccggtgggaccaaagccagctgctacgaaagagccagcacagggggtccctggcttcgacggcacccagggctcaacttaaggctaggataaggctagaaaacttagcccctacacttagtgatgaatcgttcatgtagatgggagaggggttgggctcttaccaccgagggagcaaacaaatgcgcaacacgcgagcgtcgcagggccatgagagtagaatggggggaaatcaaatataagatttcaagctgatgaattgaaaaattgaaaatacttgaaacttgacaggatgattagttgagctaggccgggcaccgtagccagccggcgggaccaaagctagccgctgcggaagagccagcacagggggtcccgggcttcgacggcacccggagctcaactgcaagagtcctcctaggagtagaccgaggcaagcagcaggttcatgagccaaccccgcgcttggcccctaagggccatgggaaagaagctcgccatgacctgatcatcgtgcagatctagagggactcggaggggttgacaccgccgttgtacttctcagtgaggctaggccagaactttgggggctatcggacattccgaagactcgccataaaagcctggccgctggccttttccgatgaggatgtggggggcctagccccctgcctagggtggcgcgacactcctgaggaggctgcgccttcccctgcattggcgccgtgacgctcgtcacgccggcgctcgaaacaacctcaaaaatcacgaacgcgccccctacctggcgcgccagatgtcggagaatgaactcctccaccagggaaccgtgaggcccccctttgtgagttcggctgggggcagcgggtgagattcgagggcttggtgagtgaagctgtgtcatcttgagggagttatccccctccaagatgatgagacaaaaagagtttatacaggttcgggccgctgagaagcgtaataccctactcctgtgcttagctgatcttgtgagaaattacaagatcttcttgttggggtagaaggtgttgatcatcaggggctccagcctcccctcctactaggcctggacctccttttatatcttaaggggttaccacatgggccaaaaaacacaacttagtggagaaggattacaatctttgcattaaatgcatgtcttatctcttgacttgggaagcaagcgcacgtcatcttgatgacgaggcctgtcaaatcttgccgcctgacacggggggtgcccctgtcagtcaccatttaatgggtggggacttctgggctcctattacaccgggaaacgggagccttgctttgaccagagcgggagaaccgactttggctgggataagaggatgagaacctctcaccatcattatttgatgggacatgtcaggctgcacgtcgcctgacacacgagcagcgcacaggcgcactaccccagtcccatcggtcattcgaccggtcacagaccggttgagtgcattgcacaccgcattaaatgcggcgtggcgcgattactcgggccgccataaatgcgggtaggtgggcacctggaggcggacacttaacccaccgtacatggtgacctagagaggatgtcgggggagcccgacccctagtcatgggagggggcgcccgccgcccgacctcgggcccgatcccccctcgggggagggccatgtggcgcctggggcagccttctccctctagtctcggccagggagtggccgccgccccacctcgggcctgactcccctcaggggagggccacgtggcatcggggggcagcctcctccatctaatctctaggaaggagtggccgccaccccacctcgggcctgattccccccccctcgggggagggccacgtggcctcggagggcagcctcctccgactagtctttgggaaggagtggccgccaccccacctcgggcctaactcccctccggggagggccacgtggcatcggggggcagcctcctccgactagtctttgggaaggagtggccgccaccccacctcgggcctgactcccctccggggagggccacgtgcggcctcctccctctagaactgataccccccggcccacatcaccgatattattatttgttttgttataactcgatttatcattaaaggtaatttaaatataacttacattttcacatattttaaaaaatgaataaggcaaatggttaaatatgagtaaaaactaacagtgttatatattaaaagttggatggagatgcagctgacagtctgcagttgaccactggtgtgaactttgtagtagtactactattactactaaataataatatgtgcttaatacattgctttttgatgtatggaaactgcaagtttaacatgcagaagattgccggccgtgtcataatttatataatcaaatataatctactaattaagcatgggtcatgatgggtatgggtgtgtctaccatcattcattttcaggtggtccatgtgtgactgtgattctgtggacattgtcacatgtgttagcgagttgtaattttctttctaaaaaatgttagtctcacgtttcgctttcactataaacagggctaatgacattcgatcttaagaaaatgttagtctcaaattgctacgtccatgaggctttactcaagcctgtactatacaatacttagcttatactgtacatagtttcggaggataattcctaagttccaaatgttaagcaacctcttccaagagaaaatttagagaaaatttacagtgcgatataatttcttagggaaaagatagaggggagtttgcgtattaattagaggtcctagaaagcaagatcctagatgtatacgttttcggacggaaaaaagaaaaaaggataaagttgattcccatatgaaacatcaaagttgtttcatgtacaattcttacatcagaagttactaagggcatgtttcgaggaacttcaagcagctacaaattctctttaaatcaaacatttgagatttttgctcagattataagaagtcaaaagctaggttttctagcttttcaaattctcaccagctgcttctcagaattttagactcattccaaaacagacctaactatatatgtctggctttgtatcctttgtatctttgtgttatcacatacatcaaactttcattacaaaatgaatgatgcaagtgattttttttctagaggatgattcatgttccaaatccaatggtgcatatttagatgtcatattgtttcacctataaccgattataaacggttacacttattagcgaaaaaaaaggaaaataaagtgataaaaaccttcaatccatttcacattggagtctgaacaactgaacctgcatctgaggacctaggatcattctgtaatccattatgatatcaggggctttaggggaaaaaataactaatctatccaaacgcaccaaagcgccctgcttcctttccccacacacaaaaaaaaaaatccgcaacagaaaaaaaagaggaaaaagagaggggcccatgtgtcaaagttacaccctaataagtataaaaaaaagaggaaaaaaaacaaaccgcaacagaaaaaaccgaaaaagagaggggcccatgtgctaaagttaccacacaacacaagtgagagagagaaaacgagtaactaatccctccctcctctcacaaattcacaaatccatcctcgcctcgcctcccacctctcgttcccctccccttccccggcgaccggccgccgccgccgcgcgccgccgtcatggggtcggagcgcgcggagctggcgagggtatgcggggggcgcaactggtccaaggccatccgcatcctcgacgcgcacatcggcccgctccccgtcctccatccacgacctctggttagtactaatgtctctagtaatctctcgctcgccgatccgcgggatctctgatctggtctagggtttgtgacgcggattcgtgcctctctctcgcagcaaccgggccttttgctactcccagctcgagctccacaagcacgtcgtcaaggattgcgaccgcgcgctggagctggacccggcgctgctccaggcttacgtgctcaaaggtttccgtcctcctatgcttcccttgcggtttcctcattcattatggattgccgctactacaactcatcatattcgttagctggttcgtattggattcatagcattgatttgttctgttactagtgtagtgtttaatcaaaaaaaatattttctggtttcttgattgaagaacttattacttagttatttttgggatggatggagtaggtcataagctcaagtatcttggatgaatgttctttgcttcttgaatggaacaaagacacgcctttggttagcagtacaaggttaagttggactgctgaattgaagttgatctctgaccaaaaatatcttctttcaaccaaatgatatgagtggaaaaatctgtctctctctagccagcttgagtatctttgtgtcttctggtctctctggatcaacttttcagtgatgagaaagaccgcatctttactgacaaatccattaaggccttaacttattatgaacaaagtaatgaaagcgtgccatcctaaacaagtaatagctataatgttccaggaaaccagggtgttgagaacttgagcttatctgaacttttgattcatgagcgagctagcattgaatgcccttttatctacttctaatatagaaagtttaaccctccttgcaaatgctaatgtttatgttgaagtgacaataatttctggtgtagtgcaagctagctttgaaatgccattttaccattctgcggtagttcttttcttttactttagaatgggcaagtgaagtttctttgtaaaccttgttgtagactcctgcaagggtatcatagctaacttttgaagataaaatctagtctttaggagtatatcaagatttcatttggttcatatatatgcccttaatttcacagtacaagtatctgcagatagctaacaagacttatttgacatatgctgatagttttatgttttgtttaagtgcattttactgtaaagaacatttatttttaatagatgagcatgaagcatgcccctgataactgcttgttgtgcctgtctggtagggctcatggacccatgaatattggagttcagtgttctcatcagcgcatgcaactgatagaaaaatgtagtgtgagtgcgtgactatattgttattaggtatagttcaatgattattatttattctatcaagtaccttgggagtgaataatgatgaccaggcagggcccgtggatttgatatgagtctgcattatatatgctttctttcatttctgaatttttcttttcttcatgctagtatctttacgtgtgatccaagaacacctgaatgaaaaaaaaaaatctgcaatgagacttacctagacagtgacccatcttttctataaccagatactcctttattgaggcaaatgcctctagcaaactttgtatgatgatatatatttttggttcaggcaaggcattgtctgcattagggaaaagagaggaagctttggctgtttgggagcaaggacatgaggttgctgttcgtgatacaatggacctgaaacaattgcttgagttggaagaattggtttcctctgttaaaatctgtgagacgatcgagtgtgaagaccgtgtcgtggatgcatcaccatgtgataccaaagttgttatatccgaagatcgtgttgttgacacatcatgcactgcaactacaatggctgatacaaaaactgttgtttgtgaagaaaacatcgggaactctggagttatatcgaatggtgctgtgatattggctaatgataataaagcggacaacaataaagaatgcagcagtccaacaaaagatacaacagggacacatcatactcccaagaaaacaacaaagccagataagaaaagcaaagcaaaaggtagaaaagaaataaacagccaaatcgaagatgtggcagaaagcataagttccggtgaaactgtagcagtagatcaaacactatttgcttcaaaaatatcaaaatcatcaaaatccataagcttggatttccgcctttccagaggcattgcacaggtacattccatttgttataattctgactatcggtttatcaaatagtatggcttcggttagtatgtactactctcagtaaacatttgaataaccatgttcagatggcacattttgcatttaaaacaattgcatttttttaccctagaaacaatcgttagagtttgacagcctgatgttcaaggttctaaaagtatctaggaggatatgttatactcaatagtctgactattatctctgcacaatacatattcaggtgaatgaaggaaggtatgaccaagcaatatccatttttgatcaggtatttgtctaatatcagttttttttgggcgtatttgttgtaattggaaagggagctgaaattttgcttgtgatctctttagatactgcgagaaactccaacatatccagaggcactgattggaagaggaacagcttatgcatttcaaagagaattggattctgctatttctgacttcaccaaggttgaacttttatatgcttaactctttcctttcaagttgtgtaaaaatgaccttgtggccttttcttgatggcaggctatacaatcaaacccatcagctggtgaggcatggaagcggcggggacaagctcgtgctgctttaggagagttcaccgaggcaagctcgctgtagttgtcacaatatcaacactaacatggattcaatattgagaaaagcagtaggggttatctaaactcattaattctgttcttttcaggctgttgaagacttgactaaagcattggaatttgaaccaaattctcctgatattttacatgaaagaggttagtttctttaccgatggatgaatctcacttcgcatttacgcttgattcgtgcaccctagtaataaagccatatgtgtagactgcaagagcatactgcctactcttgtattctgatagcatatccttgtggtaggaattgtgaacttcaaattcaaggactactatgcggcagtggaagatctctctacatgcgtcaagcgttacaagaaaaacagttctgcacacacgcacttagtaagtaaatgggtttccactgaaaaatctgttttctcctgctaggtttggttacccacaaacttcaagttctctcatccaataaccatatggaaatattttccttatgcaccaaaacagcactttattccacttttccaccatttttgatacaataattttgggattatccattggatttcttctgtagggactcctgccacttaagtaattaacacaggatttgtaatttgactaagttaacttgcatgctaaaaatatgttaaggttggaattaaccatcttaaatgacatacaacatttaggaaatttgccatgtatttgcagagtattaatcttcttattgcttcagggactaactctttcggcacttggggagtacaaacgtgctgaagatgagcatctccttggcataaaatatgatgagaacttccttgacagttgggctcacctatctcaggtgagttctgttgtcttatggacgtgcaattccatgtcttatagtttcttctgtcaagttatcttttgtacacattttcattcatgttaatatttctatacacatacttgtgtcaagtaactgatatttggctacttgggtgtcttgtgtggtagctttaccttgatataggttgtccagagaagatgttgaataatgttgagaaagttcttcaaattgatgtcaggtaaatttcatgtatttggtattccttctttcatctacgtgattggcttatttatttatttgcccatttatgtatttttcttgattgcttctagctttggaaaagcataccatctacgtggaattctctaccatggaatgggtagacataggtaaccctttctgctgttgcttatttcccatggtataataacatgaattctgtaccatggaatgagtagacatatgctacctctctacatctacattttta

SEQ ID NO: 19410 - DNA, 1743 bp, Oryza sativa
ctacgtgaattctctaccatggaatgggtagacataggtaaccctttctgctgtgccttatttcccatggtataataacatgaattctgtaccatggaatgagtagacatatgctacctctctacatctacatttttatgtccacacttattttcattaacttctttttcctgtctaagtcatacatctatgacatattttcatcatttattcataattgttaggtccctttagtttagtgggcatactgttttatgtcgatgtgattactgataatgaatttccaagcgtagttactctcctgttagtgccatagtatttggtgtctagtttattagttaatggccccaagattaatggggcatacagaccataaatgtgatctagttacgtagaagctgccatatttaatacttgtaaacttttacatgatcttgagttctgggtttcctgttttattaccaacttaagctagaaccagaaaatgtcttggttcatattctactttagcctatttctatgcgtcttctgtaaattttacgatatgcatctggaaatttggttctcactcaaatgtaacatatatttacttgtttgccctcccacattgattgcttttattggcttgggcaagtgctgtctgtcctagttcctgtctcaaactggtatcttctaagctccccttaaagctaattttggttttgcaggagtgctatcaaagatctgtcggttgctttaaaacatgagagttcaaatatagagtgcctatacttgcgtgcctcttgtcatcatgcgattggagagtacaaggccgcggtatgttactgtttaatttagtgaaccggcaaatgctaatttaaactttattagggatgataatgattgtgactgctctaaagctatcattctgccatcagttgcatgactgcatctatgtctattttgtcatctatactagtatatactactacattttgcgcttttttaacaaaaaaaatcctttttcctttgaagatcaaagattatgatgatgtcctcgacttggagcttgactccatggataaatttgtgctacaatgtttggccttctatcaggtacataatttattccctttcaattgctttttccatggagcttgttccttatgccaataccatgaattccctggtctaaagatctgaaatccattcgaggagatgaaaaggaatataggcattgcatcccactacgactagagtatcaaccctttctttcgccttagaaatccacagaaagtttttaaagctacaggctatccataattaacgagcttataactacagtattagatacctatatttcattaggaatgcaaatctcacatcgagtccaaaacttactgtgattgttaagttatcttataattttgcaaacggggccaaagttttctttacataactattgttgatctctcgcaacaactagcactagcatgatgcataatcaaaacttttgtctgtttgcctcagatcaagcagctttatttgaacacaagcacttctttatcttggagtcttggactcccgggttctctactaactaacattatcttctgttctatatctggggtcatgtcattgtttcttttgctactaaccctggttttcttgcctgatattccttgcagaaggaaatcgctctgtatactgcttcaaaggccaattcagagatctctcagtttaacattgatgatgatgttgacc

SEQ ID NO: 19411 - DNA, 3048 bp, Oryza sativa
tgacttgaaatatgtcaataatgcggaggatcgtgcagtcttccttacagatattgaaaagttgaagaaggtaagttggtaagttatacaataggctgttgaatgtcatagctcatgcatgagtcatgacatatcaatgtttcttttgcacctagagtaagtttatacaatacaattccaagccctaagaggaacaaagggaaagttctagcttccacattggagttgaggaaagtttccaaaagggcattcagggtgatgtagcatttgtataatatgctatattagtatttctcattacatatatctaatataagttacataagcagtggtatcaagcagatgtgaaggatgggcttcattttgatgaatttctgtgttcaacagcactttgattgattctagcatattttctttgttgcatcattttccttcttccaatagatagcatgaagcttaatgtgttattttctcatgataattaaacctgcagatagaagttgcatcgtcgtgctcggagttgtaccatatagttggtgagacctactgggtctctactagatgcgacagcattgcatttcaggggtaaataccttttacttgctcggatatttactaggatgtgtttgttgttctcccatgtgaaactgcagcaaagtacttacaaacagtgttgcactacccttgtgcttatttaataacaaagtttgggctctttcaggaggcgtcttgaagggacaagaattaccactcaaaacatgtaagttgcttaatcagttctctttgttttgctacaccctcctgctttcctgcttacttgtatcatgatggcatcgcaggggcaagacaggattcgactttgcaatacgaacaccttgtacaccatcaaggtgggaggaatatgatgaagaaatgtctgcagcttgggaggtacagttagatttattgtactgtaactttgttggttatggtctcttgagtttacacggtatcggggaaggttctctaaggaagagcttagaaaccatgacatgcttttaaatttattgttgtacactgttgaattacattatggggagccttggaacttcacatgagttgcaatagaaagagttgatgctgcagcagacaacttgtgtttaggtttctgtaatatttacagtttcagacaaactaatagctctgtgatctgcaggccatttgcgaggcatattgtagtgacacgaacccgacgcgtgaccctgatatgcttgatgctgtgaaggcagcaatattgcgtatgacatattactggtacttactgcaacctcttctctttccctctctctctctctctcctcccgtaaaagatacgacaattgcttttgtggggtgctgcaggtacaacttcatgccgctttcaagaggttcagctgtcgttggttacgtggtgttgcttggcttatttctggcagcaaacatggatgtcactgctagcatccctcatggggttcaggtagattgggaggccattctgtctcaagatcctgacacatttgttgataaaatcaagccctggctgtatccatcaataaaaacaagcaggaacctgaaagactatgcagatgtcagcgtggcattcagcaccacaggatcggttgtagcggccttaacttgtgttgacacatgagtttgatattgatttcagcggatactataggttggctgaattgttagcgtctttgtttcaccataatacccccatgaactgttaaaacagctttgtctagattgtcgagcatttttcggtttgctacagtttttcagttgcttcatagagctgtatacctgtatgttgtaatgctgtttgtttgacacaataatgtcattctttttcccttgaacgatggctttgtaataataattaccaataattcatgaaaacgtttgacaaacggagcttgtttcttatgctatgggtggttcagatttagccttgtttcttcatggattcgcaattttggtttgagatttcgggcctatctgtcagtcctgatagtattatccccttgccaagaaggtggaatttgtttttgtcaaaagaactgttcagattcagtgaaggattgttcgactcctgggcatattagttcaaactgaaaatattacgttcgaaagttcagtctccctgctttcaactatttgccacttttagatttagcaattaactatttgccatacctatctcaatgatatgtgggttcacatgtgtctatgacatatgggtccagtggcaaataattaattgccacatctaaaagttcaatatgattcaaacgtggcctgctacggcccagtttggataggcccgttatgattcaaacgtgggcctctgtgcggcccaagtttggataggcccattgggtttcgacctactttctttaaatggcgacacgaacaccgataaatttcgcaaaccccccctccgccgagccgaaacccaaaatgccgccgcctccgcctcctcctcctccgatgggcgacggcgaggtcgagagagccggcatggaaacagacggcggaggagaggatcgcatcagcgcgctcccagacgatctcctctgctccatcctcctccgcctcggctccacccccgccgccggccagaccagcctcctctcccgccgctggcgccgcctcccctccaagctccccaggctgctcttccccttcccctccaccccgccctgcgtcggccccgggatcgccgccaacaccgccccggtccttcgccacgtcgacgtcgtctgctgcgactcccccgccggagccaccgccacctggctccacctcctcgcgccccgcctcgcccacgacggcgtcgtctacttcaggaacaccatgtcccggaggcgcctcatggcccctcaccgcggccttggcctcgcctccccctccccgaccttcgagctcccctgcttcgccaccgccgccaagctgtggctccgcctcgagttcctcaacctggagctcccccgatccggcgtcttcgcccacctcaccgagatg

SEQ ID NO: 19412 - DNA, 13429 bp, Oryza sativa
tacatccaggagtggaattgctcgatccatgccccggatctggagtctcttcgatggggcgatcggtttaatataggttctgtgcggttcgtcggcttcgcgcgcctccagcagctcgccgccttcaccattcctgtctttggtcggccggacaacacaatcattcaggaattcgcgttgctcttggggcgcttctcggctgtctaccgtctagacctcctgctcagctatgaaagagtgagtacttatcacctgctctctctattgtggaaatagattagcaagtagttcccgcgaaaatgctttaaacggttcttactctctttgcgacatcgaaccattaagcattaagattagttaagggggaagcacgggaggattaagcatatgtagttacatgaatgacatatttttgttatgttcttgttttggtaccgtcgttgcatgttcgcaatgtttacgagacgtaaatgcgagtatcggacatcggcatgcatcgaatttggcaagtggaatggggagagtatttgagacgcgtagctaaagctaaaaaaaaactaaaactatcattaacacacatagttcaaacatggaaaacataacacctgttctctaatgtggaaataggttagcaagtagttcccgcgaaaacactctaatgtggaaataagttagcaagtagttcccgcgaaaacgctttaaacggttcttaatctctttgcgagatcgaaccatcaaaattagttaagggggaccacgggaggattaagtgtatgtagttacatgaatggcatatttttattatatatgttcttgttttggtactgtcgttgcatgtttgcaatgcttacgagatgtaaatgcgagtgtcggacatcggcatgcatccatgttctgaatttggcaagtggaatagggagagtatttgagatgcgtagcttaagctaaaaaaataactatcattaacacacatagttcaaacgtggaaaattaagaaattattatgttagaactcgagagttgagaaatataacctatctttatggagtatttgtttatttggtcaaattgtattacattaccacatagaggtttccttattcatgatcaagcatcatgtgcctagaattcaagtataggtttccttattgttggccaaacagataaaaaaaagaagaagtgtagagcatagcactaaaagctgaattcgaaagtcccatgttttgtattccaccctccccctccgtgtcatatcaatcttcagtgttgatactcatgctcagagtttgtttatagagaattagcaatgcaactgtttgtttgtgaccatggaatatccaaatagataacacccctttcacctttccgtcaatttaaatgctcattttaaattataaagcattccttatgacagatgaataaaactatatatttctgcatttcttgtactatcttatatgacccttcttatttttgactgtttttttaatttagtgcaggatttagataaatatgaatatttgatggaatacataaccaagcttcccaacatgaataccatgtctttatggttgtacgcaagaggacattcagttggaacttcagtattctatttgctctcgctatgccccagtgttaaaagattacaactgacattacttgatggaacagtggtaaactactaaggctttatttcctaatagcacataccatgttggtttgaatatgatacttagctctgatgtttctggtggttcgttgggaaccttaaactgtgcctattttcatatgtatgctagcttgtaaactataacaaaacttgatgtatgcgcaaaggcacaagaaactccaaattagaagttctttttgctgactcagggggtgtagcattacctgttctataatgttctgtcgtttagattggctttatgttcacatccattttggtagttgttcctgaacatgtgatttcataggtattatccttggtagttgcgccatgcacctgtgatttcataggtgactaccggtgtgatacaaaccatttcatctctatcactgtcatgttgagatagaaaatatatttgaattcgtggtaattgggctgatatgttactcggtacgtcaacattgaaagcgttgttaggatataattctaagattggttatgtttgtcatatgattggtgtatttgagaaggcctacttttatactatgaggcatgaacattaagatattccattgtaaagattattaaatgcgcaaacttgcaactatgggcacaatactctaggcttaaatgttacactacattgtttttagtgatatttcctgtcacacctcattttgtttatataccaatcaatcagccatgagtatattgtctactgatttcaggcgaatagtccttgccattcgaattgcgagtgtgatgagcacccagactggaatgaatgggaagccatcgtgcatggtctcgaggaagcagaaattcgcagcttcagaggaacagagcatgattttaactttgtggcgctactgttcctggtgtcaccagcgcttaaaaaaatgacgataactttagattgtatggctgatgcaagtgaggaatcatgccagaagctacgcgagattgtagcaggccaccctggggcttgccttgaaatacaccagaatacgagtggggtgttctatgaatttcggcaaagcaatttcaccaagacacctgatgatcattattatggttagtaagtatgttgcttgatctttggtatctgatactttttggtggtgtgataccttgtggtggtaaaactgcaattaaaacttaaaacggttgttgttgctggtacttttagtgtcacctttacctagttgcagtactatgtacacttttagtgtcacctttacctggttgcagtactatgtatacagagctttggtactctgattttaccttgctatgatcgtttaccatgatttgtgttcttctgcatagttattatgttattgattcaaaatatgtgtgtggtggtcaaaaatttttatggacaattttttggtgttaatagcttttttagtgtttagattcgagggtaaaatggagttgaacgtgggatgttatacagtagtgacgttggggtcattttggaggcacaccaagcagcttctgcttcagtttttctcgcttcagtctcagttacttccggaagcaaagactgacttaggtttccaaggcaactgtcaggaaaaccggaagcaaagactgactttaagtttgggaatgggaacttttttccatctctatatttgctctcttttttaaagcaaagacaaacctcaattttctgtttctactcaaattgtgaatggtaaacttgtcgtagaagaaaaatcccagtataggttagtcggctcatatctcaatgtaatgggttttgaataggccataatggatggagcggcgtagaaagccgaatattggaggatgtaacatttgttttgctattatttatttatttatttttactttgatgagctgaaggaccattattcgtccaaatttcaatgaatttctcaagtgaattttatgtatgtggtacttgtacataataatgcttgtttggtggttggaacagagtgtggatttgtacaaatctcacaagaaatacaaattggattcacaagaaatacaaattggattctctcgcagtaatctggaaagcttcaattgatctgagcgtcttaggatctaaatgtcttaggcttctaccagtttctaaacaaacgaaaacaacatatgcatgccagagcctgtacctttggtatacctatgatatcttgtgattatgaatggcatcatgacggagaaacacttttttcatacataactacttccaaaatctcttacacatcaatatgatgaattcataacaattcgtgtgtcgtgtgcatatatatagtcaatctaaaatagatgaagattgctagtggtgtgccaaatgttaatgtttagaaacttatacaacatatcgagagattggatgccaaatctatcagaataacttacgtactccttattgttgatattcttgtataactcaatgaatctttgaataaacatataacagtttatttatacgtttgataggtcaatgttaagagaattgtgcataagcaaaccgacaacttcctcacatgcacagctcaaatctaagactcaaaatgatttatttgagtaatgatttaatgagaggcatttaggtttttttccctcccaactaattcatgttttgaatgttttgaatgctacaattaccatgttttgaatgctacaattactcttttttttacgaatagagtatattccaactaattgcccttcaataaagtcttaacaagcttccttatcactaaacctcattacctatacttcaattttttaaaagagaaaaaatattgtttaataggttttcggtgtttagattatagagtaaaattagaaagtaacactatgacttagttctggacatatatatgtgatatgatggtaatgacatcgtttgcataatgatagctaatattttagaacatgttgcgacacttcctctagcattacgacaaggctgacttgttcttgttctcgttcccttgcatttgtttttcttttaacaaaaagatgcctgtggtttttccgtggctatgtgatgtatatgtggtcctttctttttgactaatcgaaactttgctgcaacagaaccttgatgacaagcaatacatgatggactacataactatacttccacatgcggagaaactgttcctgcggttatcatcaggaccccatgcttatggagcttgtgtatttcatgtgctacggatgtactgatagtggacttacagccttggaaggtaaaattgcatcctccttatttagtattatgcatggttattactaggtgactgatgggtaaagtatttgtggtcagccagatgactggaaaactaagcacatctccttggattttcaagaagtgaaagtacatggtattgaaggagtgaaacatgaattgaagttgtttttccgaggtaactatttcgatgggcaactgatctcaggatgatagcaataacttttgatccgttggccaaggtgcacacttccttgtgtaagatatgtaattagcttctctcaccctagaagccatgtgaaattacgacaataatgatgtgatgatgggatatatgagccagcagaccagcttactagacggaagcacaagcatcacacaataatccattgattagaagcaagggcggagccaccgcccagctagcccgggcagcctcccgggctcgccgatgaaaactccattaaattgtaactatttttagttattcttgaatgagtagcttgtaactatttagttaccaattcgggtgttgaatgtgcccactgatccttgccatgggacaggttgtgccactgtcgactggtgttttgtttcaagttatttcacatagatgtttttatattagttttttggcacctggtgcatgaaattgtataaagatgcttacttagaattattctttgaatgatacagcttgattttcttacttatagtagtacatatatatatatatgccttcaatgcacatatattaccgcaaatgcggtcaggaaaaatctgaaacaggctccctgagtacagtaaagcaagtttgtctaaaggacagaccgtagatggtgacttgtttccttctctatagagtcaccatctacattaacactatagagtggatttgtacttaagtacaaatagaattatctcgtggtaatctggaaagctttcattgatccggaacatcttaggctcttagccctttccaaacaaacaaaaacaacatatgcatgccggagccagaacctaatacccctaataacttgtgattgtggatggtaccatgatggagaaatgcttgtttcatgcttaactactcccaaaacctctagcacatcaatttgatgaattcataacaacgggtatatatatagagagagttaatcaaaaatatgtgaagcctgctagtggtgccaatgtcaatgtttgaaacttatacaacatatgccaatgtcaatgtttagaaacttatacaacatattgagagattagatgaaaataatttgtgtttatcaagttttgcggttacaatgccgttagtgtttaaacaactctgtcgagttatctgttattgacatgacaccaaaccactatatcctatgctctgctttgaagactaagatcttctgcactttggtgccgatgtcaatgtttagaaacttatacaacatattgagagattggatgaaaataatttgtgtttatcaagttttgcggttagaatgctgttagtgtttaaacaactctatcgagttatctgttattgacatgacatcaaaccactatatcttatgctctgcgaagactaagatcttctgcactttatgttaattagattttatttatgttatactagtttggcacccaaaagtcaatttttagttgtcatctgtcctatttaagttatgaaacatatcataaagtatcttcgtttcttgatctgtttataatcttatcatacatggagacacttattgtgccaaatctctcaagataaacttatgcgtgcaagaaatattaatcttgagctttgcaggtgaggagattgcttggtttatttatgcacagttctcctaacatcaacctatcaaatatactaagaaataatcatacaaaaaaataaaagtaaactcaaatacacacaaaactgtactaataaaagtaaactcaaatacacacaaaactgtactatgaaattctcacgatggcgtgaaaaagattaagagaaaggcagaccacataatgttagaagctgcaaaagccttggcactctccatcctaaaatataagggatggatggagtatgtaattgaattggacaattacagacaaaccaacaaatttattgtggagttttgtgttagaataaaactcctttggttctttgtgagtatcctgttactaacttttaattattatggaatgaataccctcaggtcaggtgtgaatgtgccaactgatccttgccatggaacaggttgtgctagctgctgtggactggtagatgttttgatgctagtttgttggctccttggcgcatgaaattgtagaatgatgcttagaattacactttgaatggtacaacttgattttgttttctataataagatgcctgcctccgatttcccaacatggctgcaaacatgatcaggaaagccggaagcagactgtaaaatgtaacctatactaactcgatttttagcaaagccaaacatcaacacttcattctattctaccaaaatctagtagcaatgctaaaaccaaatcaatcctatgagctgtgagacgccatggcggcatcaccagtaatctccacaagtgcatgacccatcaacgaaatggtgaaacctgttcctgtccctgaacacgatcttcctcccagtgatcttcgatatcagcttcagcacggcatggcaatcggcgcacgccctcaggttcttgacgatcttgatcgtctccccgggcgccgtgcttatgagcccaaacgcaacggcgagcttctcgctgtgaactgccaatgccttctccttggtcacctcatccagatcatgtagcaccagctcggtctgtggaacatgtccctgctctttcacaatcccgttcatcttctccagcatggcgtatatctcatctgtgcgaggatggctcatgtcgccggcgacgaactcgtagaccttgcggccgacctcgatggcgctgcacccgggctccttctggatgccactggccttcatcatggaccttactcttgcaacttcttcccagttaccaacagccgcgtagatgttcgacaggaggatgtacataccggagttggcaagtccaccggcgacgagatagtcggcgatctgctggcctaacgccatgttcttgtgaagccggcacgcggcgagcagtgacacccacatgacggtgtcaggggcgatcgtcatgctctggacaaggtggaatgcttcttctatgagcccggcacgaccgaggagatcgaccatgcaaccgtagtgctcgatcttggggacaatggcgtactcctcctccattgattggaagaattggtggccttcgtcgacaagcccagaatggctgcaggcattgagcaagccgatgaaggtgatgtcagttggccagaggccttgtgaccgcagctgcgaaaacatctccagtgccttcctgctatctccgtgcatcgcgtagccgttgatcatggcgttccagacgacgatgtctttgtcgccgatgctgttgaacactgacacggcgtcctccaggctgccacacttgcagtacatgtcaatgagcgccgtgccaaccctggcattgagctgaactcgccggctgttcttgacataggaatgaagccacctcccggactctgctgtgccgagctgcgcgactgcagagagcgcaagaatgatggccacctcatcgggatcgacacctgaccgcagcatccaccggaacaaccggagcgcctcgttcggcctcccgtgctgcgtgtagccatcgatcatggcgttccagcagatgaagtccttgctgggcatcccgtcgaacagctcgcgcgcgtcgtcgagtgcccccatcttggcgtagcaggtgagcatcgccgtgactggcacgacgtgcggatcgggcatttcgtcgaacagcgcgcgcgcggcgtcggcgtcgcccccgcgcgcgtacatgccgagcagcgcggtggcgacgtaggagtcgccggcgagcgccagcttgaaggcgtaggcgtgaagggcgcggccaagggcgaggccgtggcagcggggagggaggaggagagggtgtgctaggtggggatgagccccctacccagcatctcggagagcagcgcgagcgcggcgaggtggaggccgcgggaggagtgggcgtggatggcgcaggtgtagaacacggtggtggggtcgggcgtgaggcggaggagcgtgacggtgaggtcgaggcggtcggatgcggcgtaggcgcgctggaggcggaagcccaccgcccggtcgccgtcgacgccggcgcggaccgccgcggcgtggagctcgccggttcggcggagggtcgcgcagccggtgagcagccccgccacgcggtcagccgtgagtacaccatgctgctggcctccggttgaggcggaggaggaggggagcacgggctgcacggcggcggcggcggcggcggcggcggcggtggacatgggaggcggcggagtggcccgcgcggcttcgcgagctccttatcctcctcgtcgcgcgcaaaaaatataaaaagaaaaaaaaaagggacacttgtgggctattaggcccatctgtggacgcaatagggctttgaacggggataaagtccaattggacaccctcaaatagtagtatctataagtgaatgatgaatcccaagaattaactaggatgatctacataattaacaaaataatagccattgaatccacatgaagacaaaatagtaagaagaaatatgagccattggattcactttgtctagaagctttcttaacctactaagaaaaaacagtaaggttatggatataattttacaatgtacacttttaatttaaaaactatgcaactttcctgcgaggaaaaaaattgcaaatagatcattaacctatatttagaaagatccaacaaatattgtgcatataattttacaattcacatggtttacgaataaacctcatcttttaataaagattaatatgatccgactaagctttatatcattcaaagtatatctaacagtgatgagcatatgtatatgtgtgtgatatactgatataactatcagctatgcatccatttaaagaggttatgattaatcatcattacaaatttaagcttattattactaccgcaatctagagagggagtttatagctgcgcgaatacgcaacttaatacactagtatcttaagaaaagtcaagtttactccctcgaactattgtgatggatcacttaactttgtaaactagttattttctcattttaccttgctaaactattataaacgattcattttactcgttattttcttgtttctatttatatgagtcgtattttcagctttagattttgtagtgccataaataacaccaatattaaaattctaaaataattttaaattttttttcacgaccatttgcttgatatttaaaacctctatgtttaaattagttttcttgctccccgcaaaaaaaaaatagttttattgctttcaacctatgtaaacagcgaaaacaattccaaaagatgttgagagataagttctaatgaatatcaataccaccaaatttcattgcataatatgacctatatagaaaaacgaaaaggacaaatatcgttagggagtaagatgaactattttcaatagttaagagtgtaaaatgagctgaaaaattatttagggggtcaagcatttcaacgaaaagtttggggggagtaaaatggatttcctttttatttctcagtgaaaaagtccaacgagccgtgtgctggactgctggaggatgaactcatgtttgtcaaaaattgattaatttctcaaagtgaattttatgtatggggtgttgtgctcttctcagtacagaacaatgcttgtttggtggttggaacagggtggatttctacgaatctcataagaagagcaaattgtattctatgacggtaattctggaaaccttcattgatccaaaacgtcctaaactcatggccttctctaaacaaatgaaaataacatatgcatggcggagccgaaatctattatgtgcctctgataacttgtgaatggcatcatgatggagaaatataatgcttagtttcatgcttaactactccctcttgcatagcaatttgatgaattcatgacaacccaagcaaaatttttcacgctgtcacattgaatgttggacacatgtatggagtattaaatatagataaaaaaaccaattacacagttcgccaggaaattgcgagacgaatcttttaagtctatttgcgccatgatttaataatgtgggtgctacagtaaatatttgctaacaacagattaattaggcttaataaatttgtctcgcagtttacagacggaatctgtaatttattttgttattagactatgtttaatatttcaaatgtgtgcccgtatatccgatgtgacatgtgggggacaaaatatttttgcctttcccctccttaaacggatgccaaatctgatgtgaatgccaaagccaagctcctcgcctcctccaacgctcaccgcgcgctgccgcacaaggtgtttgaccgcatcccggagcgcgccgcccgcatggttcactgcaagcctctcccgcacctctgcctcgtcgacgtgcccgccacccacgacgccgccctcggagccctcggcctcctcgacttcgtccgcctagacctcgccgccctcgggcgccctcgcggcacttgtctccaactaacacttcaaaggccaggcggagctacgtccgtggcgccggcatcaccctctcccgcctcgccttcaccgccacgctttccctccctcggacgctcgtctcccccgaccctgccgccgtcgcctccgccgcgaaggagttcatggcggcgtacgtcctgcccggtacggcggagagataaattattaagagtaaagtgtaccggcggtccttaaacttgtagtggtgtgttatttaggtctctaaactctcaaaacgcatattcaagtcccagaacttatcatagtgtgtcatctagattccaaatcaccacaaccccttcagaatcctacatggcgttgatgtggcatgccacacggaatgatgtggcatcattttgactgacaaatggatcctatttaaaatttttcctttttcttttttttcttctctatttttccctttcttcttctttctctgtgacccaaacagaagaaaggaaaaaaagaagaatgagaagaaaacaaagaaaaataaaaagaaaagaagaagaaaaaagaaaatgacatgtcacatccatatggcatgccacatcagcgccacgtaggatcttaaagggaatgtgtcgatttgggacctatatgatacactttgataagttctgggacctggatatgtattttgagagtttaggaacatatatgacacaaccctataagtttgaggaccgccaatgcactttactcaattattaaactgttttgcattattagttgtttatatttatgcaacaatttgcttggagtactttttttgccgttatttttaatgtaaatcaattttcaactttaatcgacaataaataaaaatgggcaaaaaaaaaacaattgtacttcttgacagtgttttgtattgatatcaattatagccgcgtttagttcccaaaatgttttttccaaaaacatcacatcgaagttttggacatatgcatgaagcattaaatatagataaaaataaaaactaattacacagttataatggaaatcgcgagacgaatcttttgagtataattagtccatgattagccataagtgctacagtaacccacatgtgctaatgacgaattaattaggctcaaaagattcgtctcgcggttcctgtacgggctgtgaaattagttttttcattcgtgtccgaaaaccccttcatttacatctcgcgaactaaacagggcctatatttcccgccaaaagaaaataatgacaggtgtcggtaactcaaaagtattcttgagttgtatggattgaagtcaaatccctggcgacatacatttctggctaccaataaaccgtatcatgtaagggaagtttcactttacaagttgcaaccaaaacaataaattaaactaaatatagttttctacatttatatttatatttattatttttgttataatttataaaagttgaattttagtttatatgtttgtggtatgatatatttcatattaatctatcctggtattttattttaaattttttataactatttagatgatatacatgaaacaaggagatatctgctcgatggacgaatgcactttcccttatgtgaatccatttggtatgaaaccatgttcaaggtgagtcagtcgcaaaagttgcctgctttttagtgcttacgaatttttagataaggcagtgaacaaaaaaatatccctgaaaaaacgtgcctttgatttttgtatcagaataaaaatcacgcctttttccacgaccactcggcactcgc

SEQ ID NO: 19413 - DNA, 21197 bp, Oryza sativa
aaaaaggaaaatgaatgctgtcccgaacaagaacgcggaactagtgatgccagcaaccttccacatatcttgcatgttgtgtgtgcccatcttcttcttgcgcttaaagatcaggctgcagtatattgaaaagtgttatactccctccgtttctaaatatttaaatatttgacgccgttaactttttttaaacatgtttggccgttcgtcttattcaaaaaattttaataattattaattctttttctatcatttgatttattgttaaatatacttttatgtatacatatagttttacatatttcacaaaagtttttaaataagatgaacggtcaaacatgtgctaaaaagtcaatggtatcaaatatttagaaacggatggagtattatgatgtgtgcagagacaagggtacattagtgaggaaaaattcatgcatgttgcatcccaagttctacctctcggagctttgtttcaccatatccctttttgacaaaatcttccctattctgtttatttcctccaggtttcctgcatcctgcaaagcaacatgattaatatacaaaccttctatgccagaagctgtatggtgaaggcttagatgagcgataacctcagacaagccaaagatgtaatgtactaatatatattatccgtattacttcagataaatatcatagtcgtaaggggaggataagaacgaattttgtacaagtgtaggactgtccctcttctattcgaaattttgtcagatagccaaaaaggccattgcgttcgtgtcagctgtgcatttttattttttgattaagttcttcgacactcacaactcacctgtatgttcagtctcaacaaagcaaaccataccaatacacggggccatacttggtattgcacaaaactaatgatagttgtgatacccaaccaaagcaatcaagactaaatttggaagacaggtaaaattcagtccatatcccaattttcattgatctgcacatttaaatccacagccctaaaaacacaagaaacttcgctagtaggacattagtacgggcagggaaataagaatcctggtaagtggtgcaaaaagaaaaacaagaacataacaaagttaaaatttctccaaacttccatcccaattaaaaaatggtacaagaaaaaaagaactccagcagtgtcctactgaaataaatccactgggtaatataaattgcgtgttggtgcattccagttaacaaatgcatatggagctttaattttcctcttcttctagtctgctccacttaagatttcgtattgcctcacacattcagaaagctatcatactcaaaaagagatttatgactgtcactgttctgttgggaactttggataaattgctgcaaacgacgtaccagtgtaaatttcaaacccagatcccaagaattcaagagagaaaaaaaattcccaaaacaggttaagtttcaatccagacctagttatagggtggatataactaagggaaaaagaacactagacaacaaggatatactgacattagtatgttcgggaacatctggtatttccacattccaccgaacaaaacacagttttagctcaatgtatttctccatgaattcaggctcggtgcacttgtggaatactttataaaaactgactatccccttctcagaggcccacttcagggaaaatacatggagcccaattattcacaaaaaaaaaagaatctgatcgactcttcatacgagaaaaagcaagaaagagtaagataataatcaattgattgcagtgagtttgatggttagcatttcaaataaatgtttggactgaattcctacttgaactcatcacacaagataatcaagaacagaaaattaagcagcagctgccccacatagaatagggggtttgagtgagtacaagctaaggcgattcacacaccaagttccaggacgattagacaggaggctatttgcttaactgaaaaccagctagatcaagagtagcttaatttctgtggaaggagcgcaacactgagcatgcagctggtggaagagatcaaagaggaaatcatgcatggtgtggaaggccgcaggagttttcacggcgtgtaatatatagtagcatccattagcgtctaagccttcgggctgttatatatgttctttgcttgctgggactgaggcttgtaattaagcacagtgttgtaatttgtagtaactgaacttcccttcataatgaaattaggtcgacgaccaaatcccggaaaaaaaaatcaagggtacctcccctcaaaaaataaaaaataaaaaagagtagcacggcaccctgacgatccagagatttattagatcatctgggagttgacaagcaggttggcagttatacttttgtacagcacagcaaaaaggatttccatatagcagatattcaggccaaaattgtagtgtagcaaattaagatcgaagcgggtttaatttgcggagtacgcacgcaccatcaacttccggatgtagctatcgagaggtccattaggctcagagatgtcgaggcctcgccctcgcccgctgttcatgtgccgcgctttcggtgacacgccgctgtaccagagtgccctccgcgccgccaccgccatccccgctccctagggtttgctcttttttcttttctcttttattctcctctcttctctgtcttgttctctctctctatatacgaggataattatatatacaaggggtcgtttttagaaaagcataacacatttgatttacttccactataaaatattgttatccttgttgcaaaattgccacaagtgacctcgacctcaactcgatcggaagtcatagccctaaccggtgaaggtaattactgagtcttcatcaaggtcacccaagttggagaaaaaactcgctggagcacataggaggagcaaattttagatcgaggagaaactcactgaagcacaaatcgagagcaaatcagatggggagttagattctccctgattttaattcgaatttagtttagcaaattgttaaatattattagcttcaatatatttttatcccgttgaaactcacggccactcaggtagtaaataaataaataaaatccaattctagtaattatgaacctaaacatatgctactacttgtgtacgtactatttgcggtttcaggcgcagctagtgccctatcttttcgcttatatttatccgagccgtttattatcaatgacaaaataatttgtgagtaaattaaacttgtatatatatacattcttagctatttaaaagtatatattatgaaataaacttaaaatttaaaatttggagcagaatgatggggccctggttcgtggggagccacttctacactgtgagcgtgagtacatggtggatcgagctgggactcgcacatgttcagccttgcggtagagctagcgaggcaaacttgaagcgggtgacgtcgttgttatcatgtgtggtggcagtggagcggtgaatggaagaaccttgtgaatatattgaagcacagatcaacccaaagagagatctcccagtgcacatatatatcagtttcagcaacagagaatccccaaccacatgaacacatgtacaggccggtcaaaccgagtgagatctatgtatataatagtactattatagaattcccacaccaattagatctaggactaaattagttatagttattatgcacaggatagattatgccacatatcttcactgcattcttgattctcccagacttccagactcccatctccaaaagaaaacactatccagtcctctactccacctcaccttctgttggtggttcagagccagccacaggacgtttggtgatcactctgttgtacccccagcaatagcctgagataaccgctgcagcaatcacccatgaccggagaacattttgaaccagaatctgctgacgagccaaaatagaactagagaagcagacaaggaatttaggatggttaacaagacacagaacaaaaaataacataagctggaattcagaggtttacgtactgccgcacagttctgataattaagtaatcggaaatcatgctaaccggcgtattcttgacttcctcgagcaacgcatcaacctgcacatatatcaacgtgcgtaatattagacatccacatctgctatcagatttacacaaaagaattatatttaactgcagttctccataaaatttggcacaatatcagtgtacccacagagtcataattaagtcatccataaaactaattaaggcccctttttgaagtgatgatcaactataatctaccctggatcaatttatttgctccacacttctgaaaatacgattccttaaaataactttattctactgtattgcttagaacacttgtttctagctactctctccatcccaaaatataagacataaccactcatagcacaaaaactaagaaaacatttaatcaacttcatggttatatcacattgatacatgcaagcaatgtaattgggagatttaatgatataagatttaaaacaaatcaattttatagatccaaaagatggtagttaatgtaagcatgcatgcacgccttatattatgagacataagagaaaagtggttgtgccttatattttgggatggagggagtatttgttaagttcatttctcaaaatattaattttttgtgttaatcaagcagaccatccatttgatttcatccacatttcatcacttccgaacgaggactaaagatgaaggattagcatctatcctttttaaacaagtgcctgtgcccgacaaaacctttctttaagatgtgaaagtttcttgattcaaccactatgataaggaaaaacattgtatatgaatgcttgcgcaaaaaaaaaaagctaatcatatgtgtataaactgtaaaagaacaacttagaattgaaaattttagagtaagatgttcagatgctactacataattaagcacacaacaactactggatttcttacaacttcacagtgagcacaaccaaaatcttagggaacacgaccccacaaactcatttatcataaataagtgtacacaatgatatataatctagggaacatgcattcagagggccataatagaaggaaaacttgcagctccgttctttcttgacagtgccttattttcatcaaggggggtgagcttcaattggcatattagttataacattgcagcatcatcagaaatactgaatttaaaattgagtgaagtttgatgttggcacttgaaccaaatatttgggaatttgtagtggttaagccctgacaatatgggaggacaggtaaaattttgtaaaaaaaaaaggaaaaggtgatcccccccccccccccccagtttgcagggaaaacaggtgtaactgtgaacaagtacagtgattgttttccgagccacgagggtttcaccaaactaactttgaacaacataggaaggaggaacaaaagatgaaggctttaaatgcatcatttggcacattgcactgtgcacaagaaagcttttccttttcttgtgagagcgttcttaattcaacctctaagataaggtatttaagttatagagataaataaattagagatggaggcttgaacaaaagacaagcttttaatctgtggtaacagcaagagtcagaattaatctagtgcaaagtgacagatgcttaacacaccttaaaaacatcacaacgcctaaaaccttatgaaattatataactcaattgtacaaattcattcatcataaataagcatggacaatctatggcataatgcaataatgaaatttgaccgtgccatctcttacccaagaggagtgtgcttttgattgccacataaattaacaaccgtatagagcaatcccaaaaggcgaaccaaatactttggaaagttgcacatgaattttgaggcagtaactaaatacttgaatccatagttgttgtttttgtgtgtgtgcgcggggtaaggttgggagcacatgaaaaaggtaaattttttcaagctaggaggaaacaagtgcaatgataaacagatgacacaggaggatttgggactataataatatataattaactttgaacaagacatgaaccctatatatttggggtggtaaactctagatcgaaaccaaggaatgaacttaattaggggtgcaggaacaatgtgagggccaggtatggtacctcgtggttgtgcctgttgagagggctgaattgggggcccccgagcttgcggggaggaggcccgccgtcggagtggtacgcggctcgccggatggccctgcccgccgccgtggcggctggtcgtcgcagcatctttctgcgactagggttagggtgcggaattgcccgatgagagcactatccctaattaatattggaaaccctcatctcattcgatcactctcccgccatcgtcttatttttactctacaggcctattcttcttggaccctcaacagaactcggcccagcaactaaaaattctgatagcctttttttttttgctcgaaaaatcatttttcttttcttttctcgacgtcttacaactcaagaagaagaggaaactaaaagtcctattcactttatctttggatacaaaccggaccagccttctttcgagcctaccgtagcacaaggttttgatttaacgaccaaaattgataaatcatagattggatccaaggtcagaaacgagaaggtctgtgtccatagaagcagaaaccgtatcggccggctacgggaagcatcttggctatcgtctgcagcatcagttgatactaaactagacaattctaggaaggtggttctagaatcattgttgggatcgattgagacgccgcacaagaattaatgccatgtatggaaagagtccaaagaaggcaactgtatctattaattaggatgtttttagtagtttctttatagatatattcggtaagagtccacctaaaggatttgttcatatttttaagttgtaatagaggtagagtcgtgtccgacaaagacattttatgtattttgggtataaatatgatccgagacgatgtaaaaaaaaggacagttcaataatactttcggcacatcgccaccttttttctactttcattgtttcggcgagttcttgctttcaagttgggctgcatagggttcgatctccgacgaaaaggtaaagcttgttatggcggcttgcgttctcgagattagtgcttacatcttcatgacactctaatctcgctcatctaaatcgccgagttatcatatatgaggtataatctagatcaatatcattatctaaccccatcggctaacctccatcatcaaaaacagccgatagggttagataccgacattgaattagattatacagtgtatccaccatctcagaaaggcttttatcagctcgtgtagatcttatgtttctccttatgcttaatgctgcatcagttaagtttgatctattaagtaatgtttagaaccataacatttaatttgtcttataattgctaatagagatagcattagggtttcagccgatcttacctgatttagctactttgtttcttatatgtttacttgatatgctaaatctgccctttatattaagatctcaattgattaaaatatattaagcttgctgtcaatctgttaagtttttcctaatattagattgattcatgatcagtatgttcatctacgttgacatcttagtgtagagtggtatcggagtactagccgatacacattaggtttgcttcatcggctatcctatgaatatatataatctttgctttgaagtacctttagacataagtgatttatactgtctagacataagtgatttatactgtctcggcatactatatgatctatgccaatcaattagttcaagcatatttcgaggcatagattatatatcattgatatctgcagatgattgagtagatctatctattcttatcttacatgtttttattgctgatctgacccatactacatcggcatgacactggacgatacgttatcggcagcctagctgatcggctatcgtttagggatttaaccttgtttcctcttatttcttgttggttgcaggatcaaaccaactggcacgctcagaacccgaaagcaaatctttggacctgcactagattgaagcaaatctctcaggccagtgtgtgtttttcgcatcaacactatactactataagtttcacactattgatgcgattttgggaagattgtaccgcactaaggaaccattaggaaaccggtggtccacgaaggcctggcctagttactcactaattagacccatcactaaatatggaaattacctatggctatctctataaatagaggggaggagaagatattgttcgcttgagcaatggataaatgaatgagagaatgtcctacccttacatcttgcgtcaccatttttggttgacattatgtaacccctttggaatacgcacgtagcacaggggcagcacgacgttttaccggagacctagaaaaaagatgggtaagaactcgcagatttaatcacgaaaatgaattcctctcgtcattctcgttccacttctgccattcctgacgaaatctactacagctgacttggagtcagcggcgtatgccgattggtagaaaccgcggtcggcaaacacggtattagcgtgccgacgacgcaccatggtggcgaacccgagccctgccatggctgcgagctcacgcatgcgacatcatggccgcaagcctgccgacaaaacacactggccgcggcccgcgccgtcgtgcacccggcagcaacccgcgccacagccgtgcccgaggccacactaggatggcgtgctaagcaccgccaccgcgcccaacggcgagcccacgtcggccgtcatggcagcaccagcaagacaggagagagaaagaagaaaagaagtacaaaacgaataagaaatgaagcagaaaaaaagtagcactgcagcagccgcccgcggcgctgcacattgtgccgctcgccgcctcgccgcacgcccaagcagctgcgagcgctgcctctaagaagagaagaacaagaaagaaaaatgaaaaaaagagggcaccgatgatgacatcggtcgccgcccgtcgtgccgcacccgcccggctgccacgccacccttcggcttgccgcgtaggaccccggccgccatgcctccctagccgtgccatgcaacatctgcttgggccaccctccacagcgccctccgtgcctgcgcagcccatgccgctgcctggcaccgcaccgtgctagcctcgcctgatcatatcatatctttctcgcgttgcaccggattaaccctctcttcactggatgccagtatttcccatgggttcgggtatccgcagatacccgacccgatcggtacaggcataggcatctttttttttgcccgtgggaatgcccgacccgatacccgcgaacttaacggtcacactaactacggcacacgcggttttatatttcgctcgtgggtaacccatgcccaacccgaaaatgtttgacccatgtaacttcaatagttcaagtaacctcccttcatttggcccaatagcagcagcaatatatatccacataaaaccctaaacctaatatccccaaatcctatccccacgtccactccacttggcggtgctagcgcgggctgcgacggtgggcacaagcggcgccgggctgggtgcacgcgcacgacatgcggggcgcaggcagcggcggcgcacagcgggctgggcgtaggtggcgacggcgcacgggtacccgatgggcacgggcatgggcatggatttttgcccgatagacctcgcggatgtggatcggatgcaggcacgtgggtctcaggctgggcatggattcgctctgtcggtgtctgacccagcccgttgccatccctatgatgtaggaacatttcttatattattttctgagcatttggcgtattagtttcaggcttatcctcatgatgtaggagtatctgatttagaatctgagcttggaaaagcatctaaatgttgttcaatgttttaatttgccgagctaattaatgttatgttttgaattccagtagatcaagtaccgaaagtttacgatttcaccaacggatgtaagctttgttcgggtttagtgtctaatcttggcccttgcaatatgtgtaaacaatatactcctattaacattcaaggtcatttgatctctagaagttcatactgcatttgtattatacgaactcatacttaacaatcgatttggattgctaggcacttataaaatccagattattgtctgaacttaaacagggaatgtatctgacttcagtgtgtagacatacccttgccatgtttctcaattcagtgtatgaacatgcccttgcaaggactgcttttccctgtgattttacttatgtaaatatatattgtaaaaacatgccttgcacatgcactactacttaaccaaaataacaacaaacatgttgtgttcatcttcagcagcagggcaagagagtcaaaattactggaaacatttgccctatcaggtaagagggacctaaggaggtagctttaatttcgaagccacacattctactattgttcatgttaaatagtcatgcaggcacgaagtgtgccaaatccaagctcaatatcatagtagggtactatgaatctataatatgctgtaagatactagtagtaggtggccacattctagcttgatgatattccagtctaataagtaataacacaagaaagatgtgcctaaaccatgaatgtatatgaaaaaaagagagatttattgatccttccgactgttcacctattctctcatatccatgaagtaagacattgattttgcaataagagatccattatgttcattgcataataagtaaaatattgctgccatgttaaccgacgtagtgaacatatcatcaaaagatagcatgagaaatatcaactgagcaagttgtattttggggcagacacaacagaaaatccagaaacatatataaagctaacatagaaagcaactatcaagttatcacgatagcatacaaattaaggcggtatagtaggtataggagtagagtacattaagagatagagagtatgatatccaacagaacctcaatggtggctttaactagtttcggtcagcaggacattacatttgtgtagttatagcataataaaacctcctagctagttatgctgtggacacattgttggacgcgtgatgcggcagatggagcacagcatgacacaatccaaagcacgagcagagaatgataaggaaagaaatattgttactccaagcccagttatacaggatgtctccatcagctggcctgcgatcaatgtatgtgaatggagatagattagttcatgcaacgcgtagatcgatcgattgtgctgttgagttggggataataggagattaattagcagcgagcgaacattataatattgagtagtctcgaattaattaaaggttaagaagagagagaatatataataaggtacaaacatacccactgtaagggttagcaagcctcatgatcctccgattgtggttatcgacagccatggcacagccctcccgcagcctgttgtccatcgcgttttgcgtccagggatagctgctcatcttcaacttaattcaccaaaaaaaaaatcgatcgatcaaattcctcgagggcaagggagagagagagagacaacaaattaatcgatcgatatcaaaaggtgatacccaattaaattagaagcaacaacatgaacaagctaatcaattacttacctccagccgttccttggtggtggtggagacgggcctgccgcggaaggcgcggttagccgccaccatcaaccttccggccaacaccgatcgcaacgccatcagatctagggttccacgctttgcacctcacagacacggagagagagagatctactcgtagtagactagaaagaaaagagagggggagaggactcggttttgggctttaactctgcctgggtaggcccggcccatcatctttggtagcctactgcataatgcacataatatcctatatccaaaaaaaaaaaaaaaaaacctccaactcgaatcgaaagagaggaaaccaccgaaccctagcgatgtcggcggcgtggatgctcagccgcgccgtgtcccagaggcttttccgccaccgctcccgatccttctgcagcagcttgtcttcctcctcctcgggaaaggtatctgttaccatcatcctcctcccttttctgtttatgtttctggtgaccggcgcttccaagagtatcaaattattcccctttcctctccactactagccccctccctttttttctctcttctttttgtaatatatacctagtactcgtactagttagtttgacaacggagtatatatactacaactacaactaagccgaccaatttacctgtcacttttgattgttgagtgaggatgtgctagctgttaaagacgcgcgccaatctaaaccaatctcttcctgtgcctctgccttgccttgctcattgcctaaattattcaacactagtaatttgcctgtgctactgctaacgctacgatagcattcagtaatacaaattaaacaaccaaaagaatacaatatatgctttttcaaacaagcacaaaatagaaggattaatattaaacacgagttattattcatgattcatcaaccatagctccaggttcatttgaaaaaaaaaactgctcccggttgtccctaacaaggacactatagaatgtgttttataaatagcgaagaactgaagtcaagcgatagcaattgcctcttaaaataatcatttatatagtatatcctacagtacccttcgatactgaaaaatgcccgaactcattagcatatcaaggatcaaatattctattcctcctaaaaattcatttatagaactcattagtaggtttcaaaaaaaaaagagagaactcattagcaggcaagggaactgaagaactgaagccaacacactgaagaccatcacaataatctgatccaactttacttttgcaaaaaaactattgcaattatcttccttcatcaacatcctgcaaatatcctggtcaatttcttgccaatgtaaagaacagatcaatatcaacccttactaaagtcatatgcctttcagtatgtctgcttgatacagcaatagctcaaaaccaatattttctgcaattggcaaatgtagttgctcatgtcattcctttccaacttggcatttctcaaaaaaaaaaacaccatacacagcacatccgttgaaatataaaattacctagccattgtctattttctgcatatggtgaacaagctcctttgcggtgtttgagaaattctttagcccctgcaacaacaaacaacgcaacaacagtagaaataaactgatggaatgacaaattcaatagtacagacaatacacaaatattcagaattttggagccctgtcattggtatatataccacaacatggacatccgctgaggtgatctgcatcagcttgtttcaatcaaccttgccaggcttctcgatgtacaccggtcagccttcacgatcagtagcatggtagctctgagggtagtactcgatcatgtctttgagttcatcgaacttaaacttctgaccacaacaacccaatagtgaatcaagaacaaaccaaaaattaattagacgttgtaagttgtaacctatcatctaaaatggtctctaaatctctaacacctcccagatcatgttagctccaaactctttcctttccatctcagcatctttgcccacacttgcattatcttgttaggatcgtacttccttgcctccagaagcatgcattgcagtgggatcagacaagacggagttacaattagcagcgacaaggaagcaattgatgggaaatcgatgtgttttttaggcaaaccttagcatcggatggccacatacaagagaaaaaggaaaaagatggccacatacaagtccatctatataaccccttaaaatgggttctttttttcatggtggttttgcctatggggaagctttgagcggtattggcaaattaagacgacactttggtgcctcattaattctcactccttattttggcaaaggaggacgacactgtgttgacatggtggcattgttccggtagattttagtgtctgttcaaatgtatatcccacataagtaaaaccacaaagttcactttagggggttatatcgaaggtattgcaaattcgagggtgtagagacctgttttaaagtttgaagtgctaaatggacttctattcaaagtttagggaggatatgttataggaatgatgtgatttttgcttacttgttcatgccgagttgccaacacaaatcgaagttaggaaactacgtttatgaagtacatgttaagaatgcaaacataatacccatacatgcatcagtctcaaatacgtacacctaaaaaaacaactacacagttaaaagaaatgtgggtgtgattcacgttagatcaatctgctcttttctttgtaataaaagcatgtgcagagaatgcaatcattttgaagagttactaacagaaaaatatatcttgcattggtaaaggctactcttataactcactagattgcaaagcgctatgcagcactagccctaactctgcttctaacttctaagccctgcagtatgctgctggttctttttattccctaatatactaggaagatattttttattccctaatatactaggaagacatgctggaaacagctgttgatgttgagtctatgaatgcttctctctaacactaggaattcacaacttcttgatcaatcttgttgtaatttgatgttcaagctactgaatgataatcaggtcaaaaggatcgaacgatttgatgaatttgaggagatggtgcaaagggaaattgttgaggatgtggagaaggtggagagagcgaagactgaagatagagattgtatcaaccggtatgttagcttttgagtttaaggcttattattgttttccaccctagattcaccttcatatatgtactggcatgcatatacacaggctgttgacttcttgtgggatgcccaaaggggaatttcgagataagctaatgtggggctgtaatgttgctgccatatttgttgcatccggtgcagttgggtcattgattgctaaaattaaaatagatgggagtgtgtaagcatgccgagtttggtggaagacggttttttttaaacgttttcaatttttaattttaaaaataaatcctttcaaaacttaatttcaagatatgaaccttttggcccagctagccggactgggttgacaaaacaacattatcacgctagccagaccggcgtgatagcgttatttggtcaagccggtctagctggcgtgacagcgttatttggccacgccaggataaaactcagtattgttttggccaaaaggtttagattcgagaaataagttttagaaaggggttatttttaaaattaaaaaataaaaaagttcaaaaaaaataaaaaaaatctttggtggaaatgcttctgtgcgttatgtaagcacactaaactattgtaaactattgctgtcctgtcttcggctggaatctgcacatgtactcctgttatatgatactcttattatcgtgtggtttgtgatgactttttgctggctaggctatcacagtccttgcacctaatatccttttgtcttagcgtggtgtaagttaaatattaatgaaaggatggattggaggatcatcatttagctgaaagagaaaatataatttttaaaacttatttgtctgagttcgattttaggtgggagggggttgctgtagtttattttaaagcattggcttttaaaccgctaaaaacacacagatattaaatgtttttttctcacacacgcatacatgtgtgtatactagcaaatatgtctgttggaactgaatatcaaacaaatatggttggatggttaagattgcttgtgtacttataacacatgtgcaactcaaatttgtatatacatcacaaatatctctgaattttataccttgtagattaggaaatggatgtgattataaatagaaaactaaatattgccaaaagaaactaattaccgaagttgattccgcgtgtgatgaatgatggataaaaacttttactggaagccttaattatttttctaggttctttccttggttccatttagttagaaataaattaaaatgcacacacaaatttttcagcaattttatatcttaaaatgatggctcaaagtgattacaaattagttttgtaaacattaaatgatatttttgggtgaaaaatatagggaaaatgaataaggccgcggcgacccacaacagctgcgttggctcgataatacacaaggctcggtgtcgggcccattaggcgaggaggcccttcatcgcacgtggcctgtgcgagcagccaagttggcccagttacaatgtacataattgttagctaacgagagaggtggttgatgtctctcgcgtacgccggtctagatcgatccttgggtctgtatcaatacttgatgacacttttacgaataaaaagggcccatgttctttcttatttcacccagatatgcagtatcacttcctgttctttgcattagttcctttttcattttgttgctacttgctacatggatactatgtactcaatcgccactatatgcacctaagtccagctagcaacaccgtacatcacggttgttgtgcaatcttttggaatacttgccattcatgttggcgaggtcatgtaaatactgtgacaactcaaaagttatgtcaacgtaggttgatttttcattatattttaacactgttgttgttgagtaagggtcctctgcagtactgcacctgtagtactgctcactgacatgtggacccgagggtaatctgcagtactgctcactgacatgtgggccctgcagagtatctggattcgttgttgtcttacttaacttgggattttctgcaatttgcaagtgtgttaccttgcaaactatagatttttcttctatttgaattgtttcatccaagttcattgacatgatgatcgattgtaattcatagacaatgtgggtctactcagctgcatccaacataattcgttcaccaagaagcaatcacccatagctactttattattattaaaatattcttatgatgattactgaatccttttttgttacagatcctgccaggcgtgcctattttttactttattcatgtatcccgcagcaacacgcggggtaccacctagttatcattgatgttgtccccttctatgttaaactagtagatctttcaaaaaattcgtaaatatcattccagacgtatgaggttaataattaatttatcttaatataattttttaacccaagtttgtgcacgagtttcaagattttagtagattgactttttttttatttgtggtgttgtttgaatggagagataaattattaaactgttttgcattattagttgcttatatttgtgcaacaatttgcttgggccttggagtacttttttttgccgttgtttttaatgttcaactttaatcgacaaataaataaaaaggcaaaaaaaatacacctgtacttcttgacagtgttttgtattgatatcaattatatttcttgccaaaaaaataatagcagggctcggtaactcgaaagtattcttgagttgtctggattgaagtcaaatgcctggcgactttccggctaccgattactaacactgtatcacaatttgtcctctcatcacttgcatgtcatttaaaccgttataaaaaatttaaaaagaataataacatagattaatataaaatatatcacttcacaaatatttatctacagttatatttgttatttttttataacttatataagttgaattttaacttacacatgtttatagagtgatatattttatattaatctatactgttattttattttaattttttttgactatttagataatatacataaaacgagaagatatctgctcgacggaggaatgcactttccctgatttgaatccatttggtaagaaaccaaagatgttcaaggcgagtccttcgcaaaagttgcctgcattttagcgcttacgaatttttagatatggcagtgaaccaaaatatccctaaaaaatcgtgcctttgatttttgaacctgaataagaatcgcgcctttgattccatttcgtcggtcgtcttcttcattcgctttgatcgtgaccactcgccggccgccgccgccgccaatgtcaatctcgcctcctccccgtactcggccaaacggcggaatgcgtcggcggggctcggaccaagcggcggctcccgcacctcccccgctccgcctccttgacccgccggctccgccgtccgccacccatgacgccggcctccgcgccctcggcctcctagacttcgtccgtctcgacctcgcctccccacgccccgacctcgtcgccgagctcgtcgccaactacaacgcgctgaccaagcggagcgaggtccgcggcgggagcatcgtcgtctcccgcgtcgccttcgccgaggcgctcgccctcccgcgcacgcgccccgacatccgcgcggccgccgacctcgacgccgccgcagccgcctccgccgcggcgcgttcatggcggcgtacgtcgagccgcaggtgaagctggacacggcggaccggctcgtccgggaggtggaccgcgccgcggagagggtgaggcgcggcgaggcgcactgggtcgactgggccaccctcctctgtgagctcgcggagaacgagatgagggagatggcgagatggcggcgtacggacgcgtgccgcaacggcgcttactggcagaggctcatctgggcgcagaacccggatctctttgcgccgccgccgccgccggcggtgagcaagaagatgcaggggatcgccgcgacgtcgaagaagctcaaccaagacgacgacgacgacaccaagagcaagatgaccgatgaaatgccggcaatggagtcgctcaaccaggctccggcgatcaacgatgagttgcaggccatccgcaaacagctcatacatgtaagttgcttcgaaattccggaacgaatttcggaaatttcggttctatcgaccccattgtgatattattttggccgattttaaattttgattgtactttttgtgaattggcaatatttgttcaaaagttcaaataatttcagaccgaaatttccgtaagaaattttgccatatcggcacccccaatacaaatgccgaaaacgaaagactgagccctaaattatattttcatttattttttgaccaacttgtatcaattttctttgtatttattcggtcaaattgatcttgggtgcaggctttggaggagctgacaagtggccgcgcaagcattggcatcaggaggatgggtgagcttgatccaaaagcatttgctaatgcttgcacacaaacactgactaaaaaacagcttgattctgcgcttctctattcaaagtgggaagctgaaatcagcgactcatcctggcaccctttcagggtcatcaacatcaatggaaaaaacaaggtactcctatttcagtttagctctttcttttacactagacatcaagcgcgcttcgcgcgccctatcgtatataaccatagagcatataaccatggagcatatagtcacacaatagtatataaccatggagcatatgctcaattttgatagcaaggtagcaacataagagaaacaacgatgagtcttaacatggtttagtgccatgtagctttgcccgagccaactgttcagagttcattgccatgctatcgcagatgcaatagtaatggaccctgagcatgtggtgggatgatagctggcataataataataggtgcacttatacatagaggtagttgtccaaaagaaatcgcagtacattttcacttggtactaattaataagagataaaagtctaaagtctggagtaaagtctggagcaaaagatctagacatgtgagcatgctattgttcctttctcatgcccatgaagattccataagtcaatgcccaaaatacttcagccagatgagcatatgatcaagcggtatctgacaggctgcaacaacaagaaatgcttgagtaaacatttaatttatatataacatataatatgtatctgtagatatggcagttcaacatgaaatacctgtcagtaacctccttttcctgagcaccatcatcagtgaacagttttttagctgttggtgaagcctgaagtgggcgggttctatcgagcaacacaagtagtttgagcaaagaagcgatgaaaacaatgaaatagcatctgaatgggtctaaagaatgtaccttttcttggttgagctgtttggaatagatgcagccagtggcagcgtgatgtcatcagaaataataatagccttctgtttctgcaagtaaagtgttagcttcttactgtgatatgtacatattcttatagtttagagcaaacatttgtaagcatggaaagcagtaccatttctgtactctcagaggccactgcttgagtcatgggtggagacagtggatcaacatgacttgcttgctctgtggtagccaaagaaagtatgctagttggtgtttgaggtgctgcacgcctggtcactggagaagctattgtagctaatggaggtgaggaaatggcaatctcagatgttcttgtgggtgacatgatggaagtgcttggtccaggtgacatgatagctgaagaaccaggagaatctgctggtcctggggacattagcataagaggttccccaagaacactcatggaaatcacactgttaacctggaatgatacatccccagtcctaagtgtattctctgtgaagctgacattccatgtaaatgatatctcaagcagagctgttattgcatcaaggataaatttgctctccctgggtgtctgctcgacaagaagctcaactggctttcgcccaatgcgctgagctatttt

SEQ ID NO: 19414 - DNA, 667 bp, Oryza sativa
gctatgcccatgtagtagtgccaggttatatacaagccaagtggtctctttcactttataacctctgcctttactctgtcttttagacgttttatgcagttttgtcgatgtactgatttattcttgttatgtaccagaatttgaatacgctggtatggttttgcttgtaattttctgacttgattgattacgtgttgcctactgagttaaggtttatttaatttcgaattggacagatgatggcaagaatgatattttcccttatttgtacatcttatggacaaataaactgtcactttttgacccatcattttttgacccatcattccctgcgcttttctgccataagagagccattcgtagtataacatgtattatggtgataagtttggtttaatctatattatatataggtggttgaggtctctacttccaagctgggaagcatggtcacgccaaatgccactttgttggtattgacattttcaatggaaagaagcttgaagatattgtcccctcatcccacaactgtgacgtaacatacatacagatcatgctctacagatcatcccctaatcccacaactgcttgctttaactattttgttatccatgtatcatgcaggttcctcatgttgatcgtactgattaccagctgattgacattt

SEQ ID NO: 19415 - DNA, 5312 bp, Oryza sativa
  unsure (1)..(5312): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtataccctggtgcccctgttcatcttgtgatcgggatgggtggtcaagattatcaaccattctggcagccaaggaaggatcaccctgatgtacctgtctatccgcagcctgagaggtctatgtaccgtggtggggagtttggatacacaaaacttgtagctacaaaggagaagttgacactaacgtacatcggcaaccatgatgggcaagtccatgatatggtggagatattctctgggcaagtatctaataacaatggtgttcctgaggtgatcgatgatacaaagctcagcacaggggtcagcaccaaactgaaaatccctctgttctccttggaaattgtaggcagcgtgatgtttgcactggttctgggtttctctcttggatttctgatcagaaggaagaaagaagctgcacagtggaccccagtgaagaacgaggagacctaaaatcacacactgtatctaatgcaaatgcaaatggtttttgatcaacaacctgtttataggatcgtgccccatttcttggggctctacagtgttgtactatagtgcatagagtattgtaacatgtgctgtgtcaatcgtgggcattgtagagtttgatcagcatatctgttgccgtgattctacgatacataaaggtttcaataagtgacattacgttcacatcaattggttggtatgagtggttaacctgttccataacgtaatgcacgattcattgtttcatctgtgtttttctgtttgggactgaatcgagtaacagagaaaatgtatcatgcagcaatttacaaaatcagtttaactgtataagcatttttacaccctgttatttaacgcccccattgtttggtttatttatggaataagcgaaacgacatatttgtaaacgagaaataatttgtgaatataacttttatatacatgttcttagcaacctactctctcggcttcacaatgtaagtcattctaatatttcccatattcatgaatatatatatatatatattcattaatattaatatgaacgtggaaaatgctaaaatgacttacattgtgaaacggaagaagtaaaagcaaaggctggaaaataaatttcgatgaaaaaaaatcttaaaatcagctacaaatttaatgttaaaaattcaaattttggctgataagcataaacggaaatatgtgtacgtcacgatgtaaaggtatcatctttattctgaatgatgatgattcatgatgtaaaggtatcatctttattctgaataaaaaatgatgaatagatttgacaccgattcaggtaggccaagaggtatccccggattggattgtgatcaaatgcagtagctactaggactgcacggtaactactgcacacaatctgagccctctatatcaaaatctaacggacaaaacggatttggcacagtaaaatcagaacagtacctttccacattaaatcactacagtgttttgctacagtgctcggatatatctgggacgtccattttagatcatgcgatgctagtttgactgcttattttgcagtcccactggctactgcacctgaatcggatccccccggattgggatcctctgactttactcagagagctatagtaccgtgactttgggagtatttctagccgtccgatccacagcgaacggacaagatcgatcgctagttcgctacagcgaatcggtgaatagtaattctgaacagtattttgcactgtttgctacagtaaaactacaaatcactattccgcactgtagcgacaggctcattttactgtgcatgtctgccgttcgcttcaaaagtcagaggagccgcttcccccatttgcacactgtgaggaccatgtctgcactatacgagcaggtacaacagaacaacagactataagccaactatgagtatattttaaagaggtaaaagaagagaaagaaaagcatcaggctacagatatatctgtagctagctacagtatggactccaaaacataatgtatgtatagcagatgagactaaatattaatagtatagtaagagctagtagtgggctatactattaaacttgctctactaccatccatttataaaaaaaaatatctatatgttcagatgagcacgccattgaatttggagttggagagactgtccatgttgaatccaatcatgtcgtcggatcggagctccaagaaggtgtgtgtcgtcggcgccgggatggcggggctggcggccgcgcgcgagctgcggcgggaaggcctcgacgtgacggtgctcgagcagctcgccggcgtcggcgggcagtggctgtacgacgcggcgaccgacgccggcgacccgctcggcatggccggcgtgcacagcagcgtgttcgcctcgctccgtatcaacggcccgagggagtccatcggcttctccgacttcccgttccgccccaccaacgacgccggcggcgacgcgcggcggtaccccgtccacggcgagctcctcaggtacatcagggacttctgcgacgcgttcggcctcatggacgccgtcaggctcaacaccacggtcacgcgcgtcgccatggcaccgccgcggcgcgacggctcgctgcggtgggcggtgaggagcaagcgccacggcgaggcggagacggaggaggtgttcgacgccgtcgtggtggccatcgggcactactcgcagccaaggctcccgaccgtcgacgggatggataggtggaggaggaaacagctccattcccactcgtaccgcgtcccggactccttcgccggcgaggtcgtcgtcatcgttgggtgcagcgtgagcggcgcagagctcgcgcttgagctccgccgcgtcgccaaggaggtccacctcagcaccaagtcgacggaggagaccatcacgtcggcgatgtccaaaagtgtcgccaggtacgaaaacctccacctgagaccacaggtcgaacacctgcgcgaggacgggactgtggtgttcgacgacggctcgttcgtcgtcgccgacgccatcatctactgcaccgggtacaactactcgttcccgttcctggacacgaacgggaaggtcaccgtcgacgacaaccgcgtcgggccgctgtacgagcacgtgttcccgccggagctggcgccgtcgctgtcgttcgtgggcatcccagccaaggtgcttctgccggtgttcatcgaggtgcaggcgaggtgggtggcgcaggtgctgtccgggcggaggacgctgccgtcgcaggaggagatgcagcgcgccgtcgaggagcacacccgcggcatggaggccgccgggttgccgaagcggtggacgcatgacatgttcttgaacctggaacgctgcgacgactacggcgagcgcatctgcggcttcccgcggatggagcagtggaagaaggagatctttgtgtcatccctctccgacatggtcgacgacatcgagaacttccgcgacggctaccacgacagcgacctcgtccgcgacgccctgcgccggcacggttggactcccgccgaggaggacgacgacgcccacaaataaaagcacttggattggactccaataaattcaggttaagatgaagcaaaccaaataaatacacgacaattcaacaaaaaaaatgctggcctgtctgtctcaagaggatttttcattgtactaaaaactgaacctttttattttcggaattgctataaatatgccgccatctttcttctcggattacattcgattttctcaccatacaattagtttagagatatgtgcgtgtccgaagactgataatgccatcgttaagtgctgatactgtacgtttatgtgcatcccagtctctagttatcgctggccattactgttgtagcagggggtgaacaccatcccctatactcggccaaaaactcgcatgatgaggaaagtgtttttgagctttgctcaaatcaaattctaatatgtagccgtttctgaccaagaatttgcattcgcccaatagggcctgttccaaggaaaatgtgttcgaacaagattacttgctcgaattggcatcactaaaggcattgtgtttgagcaggttctttggctaagacaagtgaagtgacgaggagctaaaagatgggagagtattcaagtccaggcacaagtgttcgactcgagcaatcgaagttgaggaaaagtaccatccagcaaagcatatattttagaaaagtgttatgggaaccacgtcaactgctctcaccagttagcatcaaatgttacttggggaccactaaaatgttttaatatgcccctaaggtcataaactttataagggtaatatgataacttcatgtaagcctgcaatagcaaactagtgaatcttgggtacatgataacttcctacggtcatattgactttgtaccatctgtaaagttcctttctgttagatgaaatgtgttgttgtataggactttaattacaaacgcgcgtgcgttgcaaacggtgattactatgtacaattaaaatgtgattactatgtacaattaaaattatataactccactggtggagaaaccatctttggtcggtccggcaaaatccataatagtcccggatccaaaaagaaccggaactaaagattgtttttagtcccggttataaaaattttgatctttagtcccagttcatcccctgtcaaatgtgtgtcaggaggccgaggatctttagtcccggttggtgtaaataaccgggactaaagatcaccactttagtcacggctggtactaccaaccgggactaaagatcaagatgatgtttactctcggttgggagtaccaaccgggactaaaattaaacacgtagtatatcattcctatcccttatcctctcgtccacagttacaacgtagacagatcgaatctcgccccctctcctcagatctatcctctc

SEQ ID NO: 19416 - DNA, 5944 bp, Oryza sativa
ggcggggctccggccgccggcgggcggctgggccgcgcccatcgttcatggcgaccggcggcggcattctttttttttaatttgtgatgattcactgagatgtatttgactgagaagttacaaatttgtgattcattgtttggatctgtgatgtatttgagtaatttcttaggatattgtgatgtatttgatttgtgagtataaataactttatgatttgtgatgtggatttggtgatgtgaatttgggatgttagttagatttggggattgatttggggatttgcctacttgattcgggagaaaatgaaaaggaaaaaagaaaaagaaaaagggaccatttgcactgccgctattgtctctttagtcccggttggtaacatcaaccgggactaaagatcccctctctttagtcccggttggtggtaccaacggggactaaaatacatctttagtcccggttatttcaaccggtccatctttagtcccggattcttactcccggttggagaaccgggattaaaggggttcccaaccgagagtaaagatggtttctccaccaatgctcattgcaacgcatggacatatcgaccctaaaaataggaaataaaaaaattctatttttcttccgtcctccgactccagtgcaagccatgagctttccgatgggaagtgcgcagccagtttcatcatccgccacgcctagctctaactcgatctgttttttctaagtacatagggaatataaatagaggctatataccctagatttttttctaaatcctgcactcctcccgcacctctcagctctctcccgcacttctcccctcccctcacctagctctcctcctctccccggtgctgacagcggcggagggcgtgcggcggctaccggtggaggaggcggcggcggctaccgggggccaccggcgctccccttcctcgctccttcccagatctggcctgaggggggcgggggtaggacggtggccacacgtgtggcggtggcggcggcggcggcgggaggttgccagcggagggccgcgactaccgacgggaggcggaggttggcggcgggtggtggcggaggagggcggcggccgctcccggaccctccctccctcccagatctggcccgaggggggcgtggggagggcagtggccggcggcgctcccctccctcgctccctcccagatctggcctaaggggggtggggggagggcggtggccacgtgtgcggcagcggcagcggcgggaggttggcggtggcaggaggaagggggccgtgcgcggcggcgtcagaggaggtggaaccaatggcctggtcggcatctcggcatgcgcaaggaggaggaagcggcggttctgggcaccaatcctctcccttccttcgccccagacgtcggtgccggcggcgcaaacagcaccggccgctcccttcccagatctggacggaagaggggagccggctagcagctacggcaaaggcggcgctcccctcgccctcggacagcagcgccggacggaggtggagagccgtcggccggagggggatgccgacgccggcgggtagcaccggatttttcttctgtttcctcgctttattttcgcagtcaggccgcggacccgtttggattttcgcaggcgttaggatagcggcggatgtctccctcacctacaaaaactgtttttggccgctgtaaaaactatttttctaagtagtgtacccatctcactggaagcacgagagtcgagtccgactccaacaaaaactagatcggatctccttgcgtcgggcacgcgagcaggagcacggatgccacgctagctccgacgccggccaggagtggtgctggggaggatttttttttattttttttaaatttttaatttttaaaaataaaccatttaaaaacttatttttcaagatctaaaccttttggccacgccagccggactgacatagcaaaacaacattatcacgtcggtctggttgacgtgacaatgctatttagcctcatgggtttggctggcgtggcaccgttatttgatctcatcattctcgttgcgtggcaggataaaattatcacgcccgttgtgtgaccaaaaggttcagattctaaaaataagttttagaatgatttatttttaagatgtaaaataaaaaaagttcaaaaatcgctggggaggcaggctaatgaggtgatgagggcggccaggttgatgaacccgatgagccggacgtactgggtgctatggcagtaacacgatggctcatcctccgggcagagagagagagagagagagagagatcagagagagtccaaggggattgatcggtcatcctctcctccgttctgcagctagcgtgagtagacgaccagacaaattaagttacgattgtgaattaatttgtgattaacgagaagcatcgatcgttcccaattgatccaacgcgttcaagatatattaattgccgccgtgacctaggccctttttgaaagattagcacagggctaatattgagagctaatgtttagtcataaattggtaggataaacattattctagggtggtatgtttggatccatgggctaattcaagactaaaaggtagagagagagagctgctttttgatagtccccacacaaaactagccccattagcaccctttggaggagctaatgttttgaggagggctaattcactttagcctcaaattagcccacctgtttgaatccttaagagctaattcagagctaaaaggtgaggactagtaattagcccatagaaccaaacaagatcctagcaacctatccacctcgccgccggctgccgtgaatacgatcgaggtgagagcagcagccaattgatcagcacaccacgttgtctacttgcctttggctaatttgcctgattggattcgtcaggttagcgtagagccttggaggctacgatgaatatcactgaatcgatcatgcaaccaccagcgcctagcgcgtattgccgaaagatttatattagtttcaattattattaatatgatactgttgtacttttataaccaattcataatttatatgaagttaaccattaacgtgttaatcttttcatttatcagttcatcccagataccatgtcatcaagtgatatgtacaagggtatacgatgaaacaacaaataatatatattaattattactttgatattaatgtctctgtcctaaaatatagttatttctaccacagtgccttgttctaaaataaagctattttttcacctacctcttctcaaccaatcacaaccattcttcttgacatgctttctcttttcactcaatcacacacttcctctaattttctcacatattttcttaatatccgtgtcaactttaaaaatagctatattttagaacggagggagtattaagtgtttccacttttagttttgtcctggccactcaaatctctggattgagactgaacggggctacacacgtgagaaaggaggacgagtagagaggtcgctgctactagacagggaggcgagctcgtcgtggtacggtgacagggtcatcgcggcccacgaagatggtgatggcaccagcaagttagcttgggctgatgaatttttattttattttttttgaacttttttaaatttttattttaaaaataaactcttctaaaacttatttttaaaatttaaaccttgtagccaagtcagcccatctggcgaggaaaaattactatcacgctacttgctgcgggtgtgataatttaatcctaccacggcaaccaggatggtgtggtagtattattttgtcacatcagttcaagtttcatatcttaagtattgaaaaggtttatttcaaaaataaaaaaaatatgggtgactagcagacggtcgagtgtggccatgaaaaaggaggtgaggacgacttgacgggttcctttttccttagatgcattttataagaacctttccgtgcaacatcgttcgaccatgtcagccatcatgactactacatcggcgcgaggcatacatcaaacactaataccaaaacgatttttgtttgcagttgaaagggattttcgcgtgcggatctcacgcccgtctacaacagggtgcctgtgaaaatatgaaacttttcgtgcgggtgacgcaccagcacacgaaaaatcagatttttcgtatgcgggtggcttatgtcgcccacacgcaacaaaaaaaaagacccccaaaaaaataaaataaaaaacataaccctagccgccgccctcctcgtggttgccgctgtcgtcgttgtcgtcgttgtcaccgttggtggcggtgccatcgccaccttccaccgctgcccaccgccggatctgggcgggagaggggcgccgcctctagacccggccgggcgggcgaggggcgccgctgccggtcacggccgcacgcaaggacgcgctagctgccgccgcccgccgccgctcccggccgtcgccagccgcctcgcgcctgttgccccgcgcctgtggagaaagagacgagagagagagataagaaataggataaggacaagtaggtggagaggataagatagaaatttttgaagtagttgagaggaaaaaatacctgaggagggaggggattttcgcgtgcggtactcttaagatgctcgggtcttcacgtaaaaattggcttattttttgcgtgcggacctcttaaggaatcttaaggatccgcacctaaaaataggaggacgatttttccaaactcggtcagttatggaccatccggaatctgacgaggagttcgtccaggaaaatcgtttttatatttgtgaaatgcagacttgtcttgtcggagcaacatctgcttattggactggagaatttaaggaagtaactttcgtcattgtcactatcaccttctcaaacgccgtaacttggttgagtttatgttttggatcaaagttgtcaaactgtagcacatcggagagaagaaaattcagcgaatgagttctgtggctaggcttctgcaattcaaatagataaggataacattgatgtaaactctagagtagaggtacaacatccgacatgaaggggtagcatcacataccttgcgcagagcaatttctaacctttttttttatttcccgttgcaacggacaactgtgtctcgcttacttggcctctgtttctaaataatatttgacgccgttgacttttttaaatatataattattaattttttttctatcatttgattcattgttaaatatacttatatgtatatatatagttttacatatattttacaaaagtttttaaataaggtgaacagttaaacatgtgttaaaaggtcaacggtgtcaaatactccgaccacgacatataaaaagttaaacggtgtcaaacacatgttaaaaagttaaacatgtgttaaacatgtgtcaaatacgtatttagaaacggagggagtagtacgtaggatcttatataactgtctctcttgctctcgtcgagaagggaaggatggtgtccgaccacgacgacggcaagctgccggcgcagtggaagaaggtgtgcgtcgtcggcggcgggatggcggggctggcggcggcgcgcgagctgcggcgagagggcctcgacgtgacggtgctcgagcagcgcggcggcgtcggcgggcagtggctgtacgacgcggcgaccgacgccggcgacccgctcggcatggccggcgtgcacagcagcgtgttcgcctcgctccgtctcaatagcccgagggagtccataggcttctccgacttcccgttccgccccaccaacgacgccggcggcgacgcgcggcggtaccccgtccacggcgagctcctcaggtacatcagggacttctgcgacgcgttcggcctcatggacgccgtcaggctcaacaccacggtcacgcgcgt

SEQ ID NO: 19417 - DNA, 17248 bp, Oryza sativa
gagcagtggaagaagaagatctttttctcgtccctctccgacatggtcgacgacatgaagagcttccgcgacggctaccacgacagtgacctcgtccgcgacggcctgcgccggcacggctggactcccgtcgcgccgcggccgcaggaggaggacgacgacgcaaaagcaattggagtggcgaacatataacaaaaattaccgggtgcaatacgtactccctccttccctaaatatttaacgccattgactttttaaaacatgtttgactgttcgtcttattcaaaaacttttgtgaaatgtgtaaaactatatgtatacataaaagtatatttaacaataaatcaaatgataggaaaagaattaataattacttaaattttttaaataagacgaacggtcaaaacatgttttaaaaagtcaacggcgtcaaatattttggaatggagggagtagtaattactctctccgtttcgaaatgtttgacaccattgacattttagcacatgtttgaccgttcgttttatttaaaaattttgtgaaatatataaaattatttgcctacataaaaatgactttttagcacatgtttgaccgttcgtcttatttaaaaattttgtgaaatatataaaattatttgcctacataaaaatatatttaacaataaatcaaatgataggaaaagaattaataattacttaaattttttgaataagacgaatagtcaaacatgtactaaaaagtcaacggcgtcaaacatttcgaaacggagggattatctaattattagttagtatattaattaaaatggcacattttagttatgattggataaaatatctaggatcctgtgattgaacgtggaagcgccactgcttattagactccaataatttctgcttaagcctaaggaaacaaaataaatacacggtaattcgaaaagaagtgctggcctgtctgtatcaagaggattttttttttgacaccaggtaatacaccttcattaaccaggggctctaggcaaatcgccagaatccagctggtggaatacaagctcagggacttggttgacatgcactgtgagagttaacagaactcaccccatacttagctaggcagtcatccactttcttgcaagacctcggacaataccaaatgagacagctaacgaaatgagaggaaacaaagacttttatttggcgaaataagcatccatcttgatgacgatcaaagtccgccgatgtggcgatgtgagagcacgtacgctgcagttctgtggcatccgtctccagtatgattcttgtcatcccaagctgcacaactttctcgatactgtggagcgccgcggtagcctcagcctacaacggtgttcgtacgtactcacatcaaaagatgcatcagtgttgatcttatatgtataaatagcagtgggggtctgagcatactaggtagagttacagtccctcctcccatctgcatatggtaaaaaattttagtggggtcttcgtggggtctctcatagttttcacgtcagtagtgggggctcgaaactccgctgccccatgctggatccgccactgcggccggtggcgattcccatttttcattcatcatcatacgtggagctcgatccaactgcagtttttcaaggtccattgtatggtaaatgatggcatcacacacctctgaacccgtgagcttcttgtcatccgcattggccttattccctgcataccaccactcaagaggatttttcattgtactcaaaactgaacctttttagttttgttcagtttatccaattactgctagtagtttatttctccgagggggtgtaccataatgtaataatctgttcgatcattgaatgcaaactaattaagcatttacaaattagtataactaacttttttatgacataaacgatttacatctgttagtataactgaatatatatcatatttgtagtcgatcgtgtatatgaccatatatatatctaactaaaaaatacggaaggattcggtacttttttggtttgtctttttttcgttggtttctttttgcccgatcgcttccaggttttctgtccatctggtttttctcaaccgatccgttgcacgcacgcatagcgcgcctcccgtcatgggctcatggccacgtcaatatgtcttcacgtgtgttttctcctttaattgactacaaaaatcgattctcactttcccttatcattttcctcatgatttaccctaatagcgatcatagtgcttcactttatcgctaagctcctaccaactattgtatcactgaaaaaatatctttaactgttgcaacgcatgggtatttttttctagtgtatttaaaaggattgtatttgttctttctgaagtatttaaaatggatgatgtaatcttatcttcttcatgtagctggtgttgagtagtttctttgtcgagggataactatgtctagtcaattctaacatttatcttccccgcaaaaaaaaaattctaacatttatcttagcaatatgttattatgatttgtctgtgcagaactgcagatatgggttcatttgcactaaagaaaaattaaaccactcctgcatgacattaggtagcagcatcttcttgttggaagacgactgctaatacagtagtcaagatgcgagtattaagtttatgacctcagaaggtcaagatgcaaatgttactaaacaattaaagaaagcagttgagcaatgggatgttccaagattaaagaaaggtgattactactcctttgaagagcatcttatattaactttgtgttgtaaaaaaatgatgagcaggtaaggcatctctgactctacatgagagcacatactttggtcattaatggtgattataatgatatattctgtatttattgtttgctgcattcagtttgattggttgctttgttcagagctgtttctaccaaatccattcaagttgaaacatctccaaaaaaaaatcaattttaaacggactgggagctgtccatgctgacccatgttgctctgtacaagctttatttaaatgtgctgcaaatttgattgcaattccatcacgatggcatcctgcaagaaggtgtgcgtgatcggcgccggtgtgtctggcctcgccgccgcgcgcgagctgcggcgagagggcctcgacgtgacggtgctcgagcagcgcggcggcgtcggcgggcagtggctgtacgacacggcgaccgacgccggcgacccgctcggcgtggccggcgtgcacagcagcatgtacgcgtcgctccgcctcatcaccccgagggaggtgatgggcttctccgacttcccgttccgcccaggcaaggacggcgactccggcgccggcgaggtcgacgcgcggcggttccccggccacgccgagttcctcaggtacatcagggagttatgcgacgtgttcggcctcatggacgccgttcggctcaacacggcggtcacgcgcgtcgccatggcgccgccgcggcgcgacggctcgctgcggtgggcggtgaggagcaaacaccacggcgaggcggagacggaggaggtgttcgacgccgtcgtcgtggcgtccggccacttctgccagccaaggctcccgaccatcgacgggatggacaggtggaggaggaggcagctgcattcccattcctaccgcgtcccggacgccttccatggcgaggtggtggtgatcgtgggctgcggcatcagcagcaaggacatcgggctagagctccgccgcgtcgccaaggaggtgcacctgagcgcaaagtcgccggaggaggccatgacgccggcgatgtccaagattctcgccaggtacgacaaccttcacctccacccacagatcgaacacctgcgcgaggacgggacggtggtgttcgtcgacggcacatgcgtcgtcgccgacgccgtcgtctactgcaccggcaacacctactcgtacccgttcctggacacggacggcaaggtcaccgtcgacgacaaccgcgtcgggccgctgttcgaccacgtgttcccgccggcgctcgcgccgtcgctgtcgttcgtggggatcccggccatggtggtggtgccgctgttcaacgaggtgcaggcgaggtgggtggcgcaggtgctgtccgggcggagggcgctgccgtcgccggaggagatggcgcgcgccgcggaggagtacaaccgcggcagggaggccgccggcgtggcgaagcggcggacgcacgacatcctggacctggagtactgcgacgactacggcgagcgcaactgcggcttcccgcggctggaggcgtggaagaaggagctcatgtggtcttcctacctcaccatgtgcgacaacctcgagaccttccgcgacgactaccatgacagcgacctcgtcgccgacggcctgaggctgcacggctggatctcaccggcgacgacgctgacgcagcagggcgacgatgacaaacggccccatcttttatgagaaattccggcttattaccaacttaaaataatagtttgcgaataaaatttttatatatgtgtttttagctatttaaaaataaataatataaaataaactataatgaaaaaaaatcataaaatcaacttccacattaaatttgaaattcaaattttgacgtataagtataagcataaactaaatgatggggctcaaagatgttggctaaaagtgaacggaaatgagttgagctgggtgtacgtgagtgtgcgtgtgttatgagcgtctgcgttttttttttaaaaaaagcacaatatttagcaggaaaaggcactcgattctaatcagttcagcttagcattattgaaagaaaaaggagggaatgtataagtatattaaataatgcaacgcaacacataggaagtataagcataaactaaatgatggggctcaaagatgttggctaaaagtgaacggaaatgagttgagctgggtgtacgtgagtgtgcgtgtgttatgagcgtctgcgtttttttttttaaaaaaagcacaatatttagcaggaaaaggcactcgattctaatcagttcagcttagcattattgaaagaaaaaggagggaatgtataagtatattaaataatgcaacgcaacccataggatacagtctcaaaatgttgaaaggttatgtatgatcgatcttttcacaagatcaactttatctcgagatagaacaatacgaaaatttacgcatggttctactattactatatagtactaattcataaccggagtatatgtcagaaactgagacgatttaacaagattcaaatttcaaaatagatcaggttcagtgattcacacaccaacatcaacatacagtgcaaactctggctgcacatacgcacgatgtcgttgttttttatttgtttgttgttcttgtttgtgtactgtactgatgggctggccatctagagataggtctaatcacattggcaccataccaaacctgagctcacgtgctgacaaccagaggtgaaaaaggatcggattcgaatggatagtagtcatactatctcctgaaccattattttgtagtagatttggagcgggtgtggatggtatatggatgtggagagaatcatttcggatttctaaaacaatgcaaagccaatgtaggctcaactcataaatggattaaaatcatcggatatgacgtctatattcaatcaatgtaacattaagtcatcaattcaacaggcaacaatataataacaatatcctaagcatttaataataacatcacacaacatatcgatataggacagctggtatcacattttaggtgtcatggtggatgaacaagaaatcaaattctaacttactattgatatatttttctaaaatgaaatctcgatgtctaatcgctaaacttttaaatcctaaatccaagacttaaaaaaagatccaaatagagtggatgagctaaggaaattatcccaaaatttactgaatgggttgtctgatgtgaaatggaccaaatagagtggttacaagatatgggccaagaaaatcgcattgtttaccaaaccctccaccacataatctgcttagaatatcgaataatctgcatccatcgcatatcatcggtatcacatccggcttcgtatccgcatgctaccattcaaatccaactctatatgcaccaaatatctatgaactcttatcatatccttgcttcgggaggatttggagcgaataatatcgtctctgttttgacctttattgacaactaaaaatgggctctaacaaaatatcagggaaattgtagctacattagcatgatggcacacattcgtgtagaggcatagtttcaatgtccaatgatggcgcatgatatgattaaataatcatcatgtgctaagcttgcccccattaaatagtcacgtcgttccaaggatactttatatatatgcatgtttatttaaataatactatttcttagggcaaaatgagcttttgttagattaaagcaggatttgcaatatttgctttgtatccgcatgctaccattcacatccaactctatatccatcaaatatctatctatgaactcttatcatatccttggttcaggaggattcgtcagttttgacccttactaacaactaaaaatgggctctgacaaaatctcagagaaatggtagctacattagcctgatgacacacgttcgtgtagaggcatagtttcaatgtccaatgatggcgcatgatatgattaaataatcatcatgtgctaagcttgcccccattaaatagtcacgtcgttccaaggatactttatatatctgcatgtttatttaaataatactatttcttagggcaaaatgagcttttgttagattaaagcaggatttgcaatatttgcttcgtatccgcatgctaccattcacatccaactctatatccatcaaatatctatctatgaactcttatcatatccttggttcaggaggattcgtcagttttgacccttactaacaactaaaaatgggctctgacaaaatctcagagaaatggtagctacattagcctgatgacacacgttcgtgtagaggcatagtttcaatgttcaatgatggcgcatgatatgattaaataatcatcatgtgctaatcttgccccgattaaatagtcacgttccgagggtatatacgtgtgatcaggaataatagccagagtcacacccttttgacaatgatcttgcaacaatatatacatttttataatataatagaaataaattacatctccgatatttatcataagacacacggtcataagtttgttaaatatataagatttttttccggtcccacaaaaaatatctcacggtatcaaatcgtttccgattgatggatctaacactgctcatcctgcctagctagatctaacgattaaatacgatttagtaccgtgagggaccagtaactttgagatattttttactggaccgaagtaaatctctaaatatatacatagagatatatagctattctcggctcttttataatgtagagtaaagtataaaaggctattttttgtttacatctgcatgtaaattaggtgaaatatatttgtcacacaataatatattacccctctgctagaattaatatagagtacttttctttatcttatatttcttagggcaaaatgagcttttgttatattaaagcaggattgcaatctttgtgcaaaatctcagctaggtctgatgtgggcttcttgccacacgtacgcacttaataaaacccataatcgaagcagcgatacttgcttgtcacttgtatcatgagttgtcattacgatgatcgacttacgaagttacgttttgtttggcataatttcacattcggtttctgtagttgggtatttttaattgaagaaatccacgtatatggatatgttgataatatttggatggagcactttatttctatttaaggtaaaataaagaattttaagccgctttaatttaaattgcaaagctcaaattgaacgtgggatttgagattaaaaccgtgtcaactaggttgtaatatcaaagatataaaagggccccgttaattaagccccttaatctcagcaacaatggcagatctccgatcttaggccgcttgaggaagcccattagttaactgattatgtttgcggtggctcatgagattgttttcagcctaccacaaggtccacattcatctttcaaaaaaaaaaaaaaacaaggtccacattccacacagtttttgtggctgtcgcatttaaacacaaatctcagcatcaagcatctagaccaagttgttggattcagcttaataaggaagtgttccctcggtccaaaaatatgttttcttttcttttcttaaaacacaatacaaatacagacacccacaacgcacgcatactcaccctgtaacatgttcttttcacattccatacaaattttgtgactgcctcatctttatcacaaaactcaccataaagcgtctaaaccaagttatcggattcaatttagggagttagtactccctctctgtatctctaaatatagtaactttatttaaactagaaatgttgccatattttagaaataaggtagtccattagttagtgaaattaaggtgccatttttcaaaacatgaagaatagattcttctgtagcaccacagaatacgagatatatgcacagagccagtggcggatcttgtcttgtgatggcgttgggatttgggcattggacatttggacattgatttcagatgctaatcatgtgatcactacgttagttggccactaatttaaagatttttggtgagaagatttgttgatcgacctaattgtctaacactaaagcaaaggcacaatcggaccaaaaaaataatagaaataagagcaaacacatctatataatcattgttgcgaaaattatttcactgataaaaatattacatgacaaatttagtactattatagttctccattttatttagtgccatgcatagtaagtacaattgtagtatagtttgtgtatatataaaaaacaattcactaattgaaagtacgtttgtagtatagttttgtacaattcctttcactaattgaaagtacaatactcttcatcccagtaatatataaattcgtcatagctaaattttaatgttaagtctggcactgcacagagacagagctggcaaagttgtcttgacacgttctttccacattccagacaaatttaattaagcatcaaaactctccttaccttaaatatagcaacatttctagtgcaaattaaacatgaaagttaccgtattttggaacgaggacgtctagaccgtcaatgaaattaaggtgacatctttgaaaattgaaaatatgaagaactttgcagcaccacagaatatatgcacagagctgataaaagttgtagtaagaatatatgcacatattatctttttaagagacgatatagtataaatgcagacgcacactacttgaagttagtaccatgcacacgtgagacatgtgggcataatttggctgattgcttcaattactagaacattagcgtgctggttggcacgctttccttatagcccgatacattgttcagtgtgtgtttgaaacatgaaaattttataagatattttagcagttagttcaactttcatgttccattaaatattgtattctcttgcatatcattctgagcataatctcctgtaatgttaatttgggattgtgtgttctctacgtttccggtggacgattaattataaatgttgagtttctaataatttcttgatataattaaatactattaagtattaaaaaagtagaaagtaggtggagttaaatattagacggactctaaaaaaaatattagaagattaataagttttcttaaaaaaggactgattgtaggaaaaaaaaagttatgggaaaattgtaagcttacaaagcttgctctcgatgatctataatactcgatccaactcctaaatgctagaagcagaatttgaaattaagttttggcctatgggcggtctttgtgttcactccacccctcatttttctaggtcactacagtctgctcctttctctttttaagtaaaagcagcaaaaactttgttgggcttgagctacagaaaagctgaaaagccctgccaaattgatcagtacgtgtcgtaacactcacctcttatttaattttcttcatgtcttacttctaaccattctgtcattttccaaccatattttatttaataaggggtattgtagttttttcactccatacttgatctccctaagaaaaagggcaggaatattttatacttttggagaaagtacaattgattcgcaagatatgatgataacaggaaacagaaaaacggaggaattgaaatggtcgattggcttggtgctacacagtgatacggtagccgaggagcatgtagctctttttttttattttccttttttaataactctaagttttcttctatcggatatttgaatgcatctaggagtgatgttgctgcaaagggctataatctagatatataaatttggatctagatactttaactggacttattttaaattatgatttttatttgattggttctagaagtctctatgtttattgcaagtgatgtacagtttagaagctaatctggaagcttgcttaactttttttttctaccgcatttatctgaatatttagctgtgacaagtggaccaataggcacacatggaatgtagattaggcgtacatgggagcttagtactcctaggatttgctctggtccaacaaaaagtatctcgaagtatcggtatctcatgttatcaaatcgtttccgatcgttagatctagctaggttggacaatcagaaacgatttgatatcgtgaggtaccggtacgttgagttacttcctgttggacggaagcaaatctcttatataagctagctactccaactccaagctcattactgtgtctcgcttgctctcgtcgacaaggagaagatggtgtccaaccacgacgacggcaagccaccggcgaagtggaagaaggtgtgcgtcgtcggggcgggcatggccggccttgcggcggcgcgggagctgcgccgggagggccacgccgtgacggtgcttgagcaggccggcgacgtgggcgggcagtggctgtacgacccgcgcaccgacgacccgctcggcgcgtccccggcgccggtgcgcgtgcacagcagcatgtacgcgtcgctccgcctcatcagcccccgcgaggccatgggcttcaccgacttccccttcctccccgtcgacggcgccggcggcggcggccgcgacccgcgccgcttccccggccaccgcgaggtgctcctctacctcaaggacttctgcgacgcgttcggcctcatggacgccgtccgcctcagcctcaacaccagggtcctccgcgtcgccatggcgcctcctcaatgtcgcgcccccgccgtcgccggcggcgagcggaaatgggtggtcaggtccgtacgcgtcggcgagcgcgacgacacgggtgttcaggaagaggtgttcgacgccgtcgtggtcgccaccgggcactactcgcagcccagcgtgccacccatcaaaggaatgtaggcgtggaggcggcggcagctgcacagccactcgtaccggctgccggagccgttccgcgacgaggtgctcacggccacacatttctaatcacattggatgctcgctctgccgccaccaaccatgtcagtaatggtaaccttgtattgtcttgtgtgctccatgtctgcatctgcgtgaaggtggttgtcatggtgggctgcggcgacagcggcaaggacatcgcgctggacctcatcagcgtcgccaaggaggtgcacctcacggacaagtcgacggaggaggccacgacgccggcgatgtccaagctgctcgccaagtacgccaacctccacctgaggccacgggtcgaacacctgtgcgaggacgggacggtggtgttcgtcgacggctcgcgcgtcgtcgccgacaccgtcatgtactgcaccgggtacgtctactcgttcccgttcctggacacggacggggtggtcaccgtcgacgacaaccgcgtcgggccgctgttcgagcacgtgttcccgccggcgctggcgccgtcgctgtcgttcgtcggcgtcccgaggaaggtgccggcgccatggttcttcgaggcgcaggggaagtgggtggcgcaggtgctgtccgggaggaggacgctgccgccggtggaggagatgctgcgcgccgtcgacgagcactaccgcgccagggcggccgccggcgtgccggtcaagtacacgcacgagctcggcggcatcgagcctcaggtacacagaagctaatataaaacggatctcgaattgttcttgatcgatgattaatcttgtttaatttgttgaatgattgatttggcgcgccatggatgagcagaagtacatcgagttcggggagaagtattgcgggttcccgcgctacgaggattggaagagggagatgatcgtgtccaccatcagtaggagggatgacgacgacatggagacatttcgcgaccgcgtcgacgacgacagtgaccatgtccggctctgcctcaagagctggcactgctcatcacctgctcgacatcaagcctctcttgctgtttctgctgctgatggccatcctcctcctcctcgtcttgcacagacggccaaggccatcgctgctgatgctctgtagctctcaagtctaaacgattggggtgtatggttttaatcctaaggttctgtgttcaatcctcaacacgcttacaatttctttttaaaaactctccctctaaatctccttttttttaagtctaaactgaacatgttcaggttcaggttcaggttcaggccatggctgaatttgagtcacccagatgatataaaatatcaggccattaagttttcaggaagaacattggcagaggatatacaagaaattttggcatcccgtcagtcatcactgctgatgaacaaggcagcattgtaaggtttggtctcgcttcttcttaaaacggggcatcttcttcttatatacaaaacgtcggcaacggcctgaccgttcgaaaaaaatgctctctaaaggtaaacagctaaacagacgggaagttgagaaagtattttatgaacctagatgcatggcaagtttgcgttcagagtttcagcattttgctggctttttcatggctgctaatctggtgaaaacattagattaactttgtgcagaaagctcagtgaaaaacctgagcctccagcctatgtcacaaagcttttctgacccaacaaaaatctctaatatactaaaattatacttcattagacagtgtgtgcactgcagtataagacttagcttgtgcagatgtaagacatctggttctgatttccctcactgaacacaaagttggctgctaatataacccaggcacacgtacacaaagaaaataattggaactcaataatttaatccaccctaattatgtcttaaccatataaaaaactttcagaaaccaaaagtatttcttctccaatgcatcagattactcggaagaagaggtagacgacgtcgcgtccggctccggcgcggcgacgacatggacggcgaggcggaaggagaggtaggcgtcgacgcaggcgtactgcacctgctccttgctcagcctgcgcgcgtcccacctgctcgtcccgaccttcctcggcttcgtcgtcaccccgtcccacccgaggtgctcctccgccatgcgctgcatcgacgtgttccccatgccggccagcgaccgcagctccaccgtgcgcgccacctccagcccgtgctgttcctccagcttgcggcagtcggaccgcacgccgtagccgacgaacacgacgcgctcgtcggccaggaaccgccggagcgcggcggggacggcggcgtcggcgtgcgcgagctggaacaccaggcaccggtgccccgcgcacagctgcagcgtgcccggccggatcgtggcgcggcggaacggcggcgtccactgcacccccatgccgacggtggccacgccgtcggcgcggaggcgggggccgaggcgccaccgcgtggcgtgcacccaccggcgcgccgcccgcgtgcgcggtcaccgtggcgaccacctggcggccgccgacgcgcaccacgtactcgtcgtgcgtgcgggtggagcggtggaggcgagtggacacggcggtgaccatgatggcgcgtcgccggcgtgtcgagcagggagacggcagctttcaaagttgaaatcacacaccggattggatccaaaattccgggaaatttacggtttctgtgaaacgtctatataacttgaaatttgcaaagacaattatacattttctcggtgcgtgttaaggcacgattacaaccctatttaattgcgataaaattaaattaattgtgactaactgactatgattatgtgttggtgcaatgtacgaatgtgtaacaaagctaacacttggcactctattttctattttccatatataagacatacttatacatacgattgccttacaaaagtcagttacatactgacattagtactttatacatgacacatttctatgaacttattaaaaattagtaaaaatatggtacattatggtgttcacggactatcattaggatggctatatatgtaggggatatgtagagattgttgcctcaacatcaatactgttgtaccgtttgaaatgctgctttcttcccttaataaaaccggctggcgtttccttttgccgacatggcaaaaaaaattgctatatatttatcgataaattttcttctaaaaatttaaacacagtgtaattacattataatttgcaaataatacaatgtaatttatatgtaactttcacataattttaaaccattcgatttgctttaaaatttttgcaagggagatagaaaaaaaaatcacaacacacacatgtgaggggattcggtcctattacctctgtttcacgaaaataatgtcacctaggaattttaaaagttatatacaagttgcactatatttacatgcaagttacaaatataattgcatcacaattgtaatacatttacatatgtcaaattatttgttaaaatttgatgacaaatctatagctagtcctagaaaaaattacaatttcataataccaagtcattcacaattacatcacattattttcacttacgtttatccaccaatacgaagtgcaatgaattagcacgattaatagataatacaatatacaagcacactgcacaacacaagcgcagacacaaattctcaaacacaaattatcacaggttgggtgtacaaaaattcatctgcaccactgcatctaaataaaaacatcttttcttacatctatccaccaaaagacgcttgtattatagtactccgtacatagtttttaccgaaagcgatcgagtaaatttctcttgtagtaaaagtaaactgcccgtacgtacgtctcaccgtcgtcgccggcgtgggcttcagatgtcgccggcgtcgaggtggacgccgaggtggaaggagaggcatgcgtcgacgcaggcgtactccacctgccccttcgtcaacctccgcgcgtgccacctgctcgtcccgaccctccgcggcttccacaccccgaccaacccgaggtgctcctccgccatgcgcttcatcgacgcgttgcccatgccggccaccagccgccgcagctccaccccgcgcgccacctccagcccgtggtgctcctccagcttgcggcagtcgtggcggacgttgtgggcgacgaaggcggcgcgcgcgtcggccatgaaccgccggagcacggcggggacggcgccggcgcgcgcgagctagaacaccaggcaccggtgcccgacgcacagctgcagcgtgcacggccgccgcgccgccgccgccggcgcgcggaacggcggggtccactgcacgcccatgccgacggtgatcccgtcgccggagcggaggcggcgggcgtggcgccacagcgtggtgtgcacccaccggcgcgccacgcccgggtgcgcggtcacagtggcgagaaggcgacggcggcggcggcggtggctgccgacgcgcaccacgtactcgtcgtgcgcgcgcatgcagcggcggaggcgcgtggacacggtggtggtcttggcggcgaccatggcgcggcggcgccggtgtgcttcttggcttcttcttggggtttcttgggagacgacgtcgtttattttagcaatggaagcagaaaatctttacctttttataactattgattgattgacttgccacttccaattttcaaaacacaaacctaatacaacccaaaattccgtgaaattttttcaagttttctaagaaaggggaatatgaaaacctttcacagcacgcggccttgaatttgcagagtatatgtgttaagccgtgttagtgtgtactgtacgtgtagtattaggtttagccccgtttctcgagaagataagagacatccctatttcagtttatgcatgtactaccacactgttttactttgtgataacttttacttatcacaaaacggatacgatccaaaatcccagaaaaattttcaactttcctcatagaaggggagttttgcatcttttatagagttgtaaactaagtataaataggcttgaattttgcaaagagaataacaactcatcatggtagtatgtgttaaggcacgtatatgaatgcgtaaaacattgtttgcatatgttccagtttttaagtactccctgcatccttttgtttaggaagtttctgacagtgacatgtttgacaaaatgaaagaacatttgaaatgacttttggaaaatgattttcagtgtatataccaacgtcaaatattaaaatatttttttgagttgtatatcagcgtcatacaaaaatggaagaagggagacaatattccccgtgcaaaaggaaaaaaaaaaccttgtaagtatcaaaacacgattccagattatggtgacatcataaatttagaagctggtactctagttactttgatttttatatcaaacgtagttatatacaaataatggtcttactatgatctatcacattatacttaaatcacactccacatttatcaccttaac

SEQ ID NO: 19418 - DNA, 5373 bp, Oryza sativa
aagaaatggttagagacagagtgtgtcacaaactcacaattcacaccaccattataaactccataattacgtgtaaataactggcgataactaccccattaaccccactacgcccagaattatgcggcggtaaatttgttcgccggttgctgcatgcaaaactaccacaaggattatctattaaaaaaaaaaaactaccacaaggatatcaatcaaactggagtggctgccaaagaaaacagggttgccagaacaccagttgcgtctgtgatcactgaatagaaacaagtgaaacaaattgtgctcatcatcacaggttcatagcagttggccaattccaaattagtactatcaagcaagcaatttatatagatattagcagaatcaacatatgttcatccaacaagagtatgaaaatctgggactggcatataaaactcatcatcacaacttcatattaccaccaagcaatccctgcagcagcattgtatgtttttaggcatcatataagaagaaggatctgaaatccagtagtagcatatactacaagaaagattaaagatgacatgaacaaaattcacctaagaagataaccaaattggccaaagccaaaatcacctccatcacaaaacataaggagcagatataaatccttcctaactaaaatcccttgcttatcatcagtatcagcaatgaaatgtgggtagaaaataactagtagaaccctccacttgtatcataatctaaaagctcctcctcatcctcatcgtaccaatcatcttctacatacccgccctcctcgacatcgtcgaacgcctgactgttcccctcaaatgcttcatacccaccaccaccctcatcgacagtgaccgtgccggctccggtgacaatgtcatcttcctccaactcctcaagcgtggccactccatttctgacaaacatttcttcagtgccagccatgtcgtagttctcaacagtcagaattccaatgctgctgtgctcgttgtagctctgaacagtcagaattccgatgctgccagtgttgccattgtagtcatcgtcgtcgtcgatgtcgatgttgagagctcccatccccaggacgaagtcttcatagccatcctcatcgtccgacgagagcagtccatggccgacgagctcgaagtcatctgaagagaagacatggtcatctgaagcatagcttgatgagtggatcatggagaggccatcgtcgtcttcctcctcaatgtccgagtccgacgcggcgacgcgtgggcgcacgttgtccgtgatcttgctgctgtactctgactctgacgcgtcgtcgtccacggcggttgctaccagcgcccagtgcgtctgagcagcagcgggctcggcgcgcgcaaccgcacggtacaccggtggcgccacacgggcgcgcacgggagcgtggcgagcggcccgtggcgcgggggcggcgagcacggcgaccgcgcggaccgagaggcaaagggtggtggtagacgggcgcgcacggagcgggcggcggcgcggcggggcgcggaggacgggctggcgcgcgggcgcggggcagagatggacggcgagaaagaaggcgaggtaggcgtcgacgcaggcgtactcaacctgttcgatggaaaggtagggcgcgtgccaggcgctcatggagacgttcgtgggcttggcgatgccggggtagccgaggaagcgatcggccatggcctccatggaggcgttgcccatggcagccccggcgcgcagctcgcgggcgcacgcgacgtggaggtcgtagtaggcggagagcatccggcggtcgttggaggcgccggagccgacgaaggttatgcgggggtcggcgagcaagcgccggagggcgccgggaatggcgtcggcgtgggcgaggtgtaagacgaggcagcggtggccgacgcagagctggagggtggccggtggcggggaaggggacccccggtggagcgggcgtcgaaggggggtccactggacgccgaggccgacgaggagccgcccggaccgaagaagccggtggtggagccagcgcgtggtgtggacccagcggcgggcgtaggccgggtggccggtgacgagggcgatgacgcggcggtcggcgacgtggacggtgtaggcggcgtgggtctgggtggagcggcgaagcggggtggagacgcgggtgtcgccggcgtccatggcggcggcggcgggaggaggggagatgggcgagggttttgggtgtcgtcttctccgcgtctgcgtggttaagttgcgaaaacctcgtggttaggcggtttcgctaactcgcttcatcatcacatacttggatatgagattttttggttcatttttggcacgcttttagatccaagattcattatggatttagatttaataaagttttactattttttttctctaaatagagacagcatggttcatccaaaacttatgaaagtaattttagatctagttaaattatctttggatttggaaatataccaaatagatacataaaatgatttaaaagatatttatgctactcttaattagagattgtttggttatccagaattaacgtggaagtcattaatacatactatccatgaagcattgagaattttacgatcttcctattggtataattgaggattttgtggtttcacgccttgctggaatataagctagtgtcatatgagacgtaaagtcttaatcatatcggtatcgtataaataacttaattatcaaatagattatcatattctcttatattcagtgacggagctaggtttggaggagaggaggggctcagccttcttcttcctctttcagcccccccctctctctccccctattttcttcatcctctccctctttccccccctcccgcccccacgctggctccgccgctgcttatattaggtcaaaatttaccaaatagacgctaaaaatgatttaaaagatatttacgctactaaatagagattgtttggttatccagatttaaagatatttacgctaatcctaggaagcatggttcataatatcgataaactatttttggttaatttcgaatgaattttgacaagttttaaatgaaattcattaactctcaataatcgagatgcacatttcgagtcggatcaagatgatagtcgaggttgtgaaaggtacaccctagaatggagctagtcattaaaataggttatccacaaaggttgagaatttccgagacatgtttgcaattgaggactcattgagtccttttctcatactccgtataatggccttgttcatacgtggctcttatcccgtaagtcaggtataaattcccagttatcagtttcaccagaaagaaattcaattatcatttgtcaattagattacggaattttcttagtattagctcaatttttcagtgttcatgaaaataataaatcacgttctgatgttcatgtctatcaaaataccggggaaggcgcaaggctcatcgtacgaatgctacgacaacattttaccaaagcacattgcggcttacaactgtaattaatctgctagtctttttttttttgttcttttcttttgaaaactagagcacgtacaccggtacacgtatgcacgacaatacaagtgtattcccttttttatacatcttgacattttagataataatgatatggtgtccaaaatctatttatgactatgtttttaaatatatttttatttttgctatagtactttgtaagacaaatctatataaattgttctagttactttaaactaaacatttttgaaagggagtagctatatttatggcgccatatttttcactaaaaaatagtcggtatgcatttacattgtaagtccataaattacatatgtaattttagtgtatttacaatgtaagttttaaaattacatatgtaagtcaaaaaattacatatgtaattttagtgtatttaccatgtaagtctcaaattacatatgtaagtagatataaatagaagagatgctagtgcaaattcaatgggaaactaatgtataataggagcaacatgttcgtagtacagagagatcaaataactagagacttagcaaatcaaacgttcgttaagtcaagcattaacagtgcaacacgaatctacatgatatccaagggtcaaattaaccgactgtgatcaagctaattttgtgtcgccataaatatagcattgtccattttgaaattattgatagttataagagtttcaccctattttttaaaaaacattgctttttcaccgaaattaaatggagctagctggttagctgcgccctgagtgtcatcttctgtatatgacgaaaaggagtcgggctttttataaggggaactgttttaatccctcgaggggatatcctatcgttctttgcatgtcacttaaatggttatgaaaaaatttgaaaaaaattggaaaggtgtattaacatttgatataacactttacaaacatgcaagttcaaattcaactttacatctcgtaacaaaaaaaaacaaattgaaccggagctagttaacgtatattcagagtcaaatttgttttttttcgttgcaagatgtagaagtagaatttttacttgcatgtttgtaggagtgatatatcacatattaatacatcttcttaatttttttttaatttttttcataaccatttaagtgatatgcaaacaacgaggggattcccctcgagggattaaaatcctcttccttttataaggcctttgtttgtggaggcctcgatcctagaaggaaaaagtacaccgaaggtctctcaacttgtcatcgagttacaaaattgtccttcaaccgcaaaaccagatatcggacatccctcaattaacaaaaccattcgcttgatgtctttcggtggtgttgaccccggttttgtccgacatggcagctgagtcaacagcgggacccacgtgagccccacatgtcatactatccacgtcattcttctcttttcccttcttcagcaggtaggcaacgccgacggggccgagacgggtggcagtgcgaagctaagcagggggcgggcgccaccggagttgggctgcgacggggcaccaacagcagccgccgccgccgcgctcgcctgccacacgctcgcctgctgccaccgcgctcgcctgccagacgctcgcctgctgcgctcgctgccacacggacggcgatagcaggagcggcgagtacgccgccgcggctagcttcttggccccgtccctcggcggcgggatagccttcacgatgagccaagtcggcgtcggcgccttgatctggtggctgtggtggtggtgaagcgccgccatggacatcaatcgatgggg

SEQ ID NO: 19419 - DNA, 13252 bp, Oryza sativa
  unsure (1)..(13252): unsure at all n locations
cccatcgtcaatggggaggcgcgggcgtcaacgggcggcggaaaggcgtgtgcgtcgtgggtggcgcgggcgtcaacggggcgaggtggnagacgatctttttcttctccctgaaggtttgagatcgatctgcgacgaggaggagcgaggaatcgccaactttcttttcgaggaaattgtaagatctcgcgcgacctgttcttcttggtgttctgtcttgtacttggtttacttggtttgttttgtgtttgatctatagtcttagatgatctgtgaagaatagttgttttcggtacagatggtaggaaaggtagaggaggacgatgctgcgatggccggcggtgcggaagcacggcggcatcccggtggagctgcacgtggcgcgggcgtcgacgggcgaggcgggagaggaggaggacggcggcggctgttggcaggcgagcacggtggaggcggctgctgttggcgccccgtcgccgcccaactccggcggcgcccgccccctgctcagcttcgtgccaccgcccgtctcggccccgtcggcgtcgcctacccgctgaagaagagaaaagagaagaaaagggaagaaataggagatgacgtagatagtatgacatgtgaggcccacgtgatcccacgctaactcagccgtcacatcgaataaaatcagggtcaaaaccaacaaagaacttcaagcgaacgcgaacggttttgatagttgaggaacgtctgtatctggttttgtggttgtgggatggttttgtaactcgatgacaagttgagggaccttcggtgtacttttttcatcctagaatatccacgtgactaggctgggccacatctataaagggccgtattagaggcccaacaaaacgaggcctaaaagggcttcacaactgaggaaataggacccatttctcattccggcccaatacattcacaagctaaccgacgcagggatcctacaactgtcggttggtaaccagtaacaaaaattacggctagtttaccattaattcaattgctggtactggtagagcagcagttgtttgatccctgtcactcaccgactacatcctcttaagcttaagcttggttaagtaaaccaaaattagtgtataacacaagctaaccaccattaattagagtaattaaactaggactaatcaataggagtagtaggtaggtaagtttacacaaggtgacagaagatgccaagcaaaatgagcagctgtgaagagagtgaagacatggagtggtggagaagcaaagtgtacaacctcttctttaactgtagcctgcacatggccacatcacatgctgcatcactcactcactcacccactctctcctcttcttttctttttcttttttttgctggcaccaacaatcacatgcacctcaaaataataaaaataaaaaaggggaaaattactcttgctgaactcgtgtgagcttaagaaattactgctccgatatagagggggggggggggggtaaaaaatgtactcttcttaattcacacttgctacctaatggtagatctttgcaacacaaacatctcaaaataattttcgatcgatctctaggagaaagaaaatccaaccggccggacaatgctagagaaatcaagaacaaatgaacttacaaattacaaaccgagcaagaaaggaggcgagcagaggtagatcagatcagatcagaatcagagcatcctgaggaagatgatggcgacggcgaggagggcggcgtaggaggggttggcgagagaggaggcggcggcggaagacttggacttggaagaggcggtgtcggacttggaggaggaggaggagtcgccggagccagaggaggaagaagatgcggagcccttcttggcggtgacggcgagcttcatgcctttgtagcagtagccatagctgcagatgaagtagtagtccttggcctccttgagctggaacgcgtagctgtgccccttgctgtagctgctaatggcgttcgccttgtcgcagttgtcgtacccgacctcgtccacctgcaccacgtccgacctcccgttctggtactcgaacactgcttcccacaccattgcgttgcgtcatcaatggcgatcgatcgagacagatcaagaagagagagatgaatcgatggaggtgcttacggagccagtcgcccttgtagaaggggcggtgcttcttgacccaggcggtgtagtccacgtcggggttccaccccttctcgtcgcccaccgtgtagttggtcgccaccgccgccgccggcagcagcgccaccgccaccaccagcaacggcagcatccggtggcacaccatctccagtggcagatcgatcgatctgagctctgagctgagcttgccttgaagacgaaggggaccttgcctcacctcactctgctctgtcactctggttgtctctgctctgtgtttgtctgcaatgatagcagctgtatgtatatatacctccatatctcttgatatctcatcctcagcttcagtaaaagacagtaaacttcactgtcaaaggttggatgcccagctgcagctggtagatttacagctttgttgttgttgtacattttgtacacatatgcaaacagccatactctgtctcaagaatataatgtgataaattcactgcctttttttctattagggggtaattaactgaagtttggtgatgatgtacagtgagacaaatgcactggctttattagggggctataaattatcttcagtttcatgatgctgctactcatttgtaactgtattagttactcattgctgactaaacttgcgcaattgaactatgcacctttacagtagtataagcagtgctagtgtgcaattgaactatactcaaatcatcattctatgattatcatatatggatactgaataattatgatatcaatggagctagccagggaaagtagtagctgcccagctgtattatttgaagtgatttagaagcaaaagccctttcttattcctcacaaacattcttagtctaccaaaaggattcatagttctccctataagaaaaggcaaaatgccagccgtggtggttgcgaaaatatatattgtcaacttatgcattcaagattgataatataggcaaaacgacaactgttagttgattgtgacaacacgatgatcatatgaaaatccaattcagtggaaagctttctgcaaagttggcctaataaatactatactagttttttttagaacaaatgctatactagtttaggtagctctaatcatacaataaacagaaatggtgaaaagctcaaacagctagctagctgcatataaacaatatgttcaaccattttctattgacaaaaatgaattctagaccttgtgctagcgtttcgtattttccagtacaaaacatgagtaaaaaactaagaacttcctcgcattccagattttactctaactgttgtactagtagccccatttggagaacaaagtttaactaaaaactgtatgaagcaattaaactctcacacaatcaaatcaagatagatatacaattgtaaaaaaaaacatatctttaacctggaagtgaggaggagatccaaggtcaatgaaagaagacaggtagggagggccatgtgaggagatgcctctccatttgcccctttatttccgacaatgccactcaagttgatcagtatcttcttcatggcaccagtagctgtgtactccatgagtgtaattaactttcttcttctctccaactgcttcagctaactttcttattaatgagcaccatttttctgctctcattatatcatgtggtttgcttctgttacctgctgacctgtgtttgtgtgtgatctactatctgcagactgcagctaccacttgggcttgctttgtcacatgcagttttacaccttttatttctccttaatacaaggtaagtgttggatcagtagcttgctcaatgctcactcatcctgccaaagagagactacagacttgttctgaactgtaaagtctgttgtttggatcctctgcatattgttcagtcttgtccttttgctttacagcccttttgcaaatgcaggaaccgtgtgataaaacagtagtagaagtttcatcaggctcatggttgaagtaacagtgaggatggagccagggcgaagccatgattcttcgagtgcatggctagaaaataataaaatgcatttttttcatttagatattcttagcttaaaatcgcttactctgcattggaaaattctgctgccacatgtagtgttactctgcattagccaaaaaaaaagaagcaaaagcaaaaattaacaggtgcctcaagatttgtgttaagtgatatcacagtaatgttaacctatccaatgtagtattagttagtcatattctaactggatgattggattgattatggacagatttaaatttgctcgtatggatgaataaagcaagggacgtgtgaaaattgtacaaaattttgatgggcctgatctgggccactttgggccttgacactctaggcggactagtgcaacatatgccccggcccatttacaccgccccgcgataaaaactgggtgagggcgaccaagaaccctaggctgtcgcggatccatcccatcccatctcttcctcgtctcccactcctccggtgagccttgcctccctttttcctcgattcagttcatcagatctttcggtaaatccaatcgagttgatagggtttgatgtcctaatctatctatctctctctgtgctgctgctgttgttgggggtggcaggattctttctgttcttggttgattgccggagatgtcggattcggaggagcatcacttcgagtccaaggccgacgccggcgcctccaagacctacccacagcaggccggcaccatccggaagaacggatatattgtcattaagaaccgcccctgcaaggttatacacctctgaatcttgttattgggataagacttttcaggacttgcatctaactgtactgtagtgtatggcgacttacatttgtgtatggcgacttacatttactgtattgtattgtattgtatggttgtgttgagtgtatggcgacttacatctaactgtattgtatggttgcgttgggttaatggaatttgtcatggtttatgtctgccgttagcaattaataattgtagatttggatgtgttaaaggtattagatccactactcatagcaaatggactctctgttgtagatgtggatagaacaatagatgtacaataatcttttctttttttttatgagaccccatttgctcacatatttctcctatgcccataaaagttgtcgttggttggtgatgtatgccgttctttagctgatgaaaaaccatctgaatggtctcctgtctcgcgatatgctgcacaattaacttaagaattgttttcaataaatctttctgaggcatagtcctgcatattttttttattgaaaatgcaatgcagagataactctgtatgtttggaaagaattctatttttccttaggctttttaatcgtaaaaattatcatatctatggttcttgttataagttaatgattcactgatacattagtgttgctaagtttgagctatgcccatgtagtagtgccaggttatataccagccaagtgatctctttcactttataacctctgcctttactctgtcttttagacgttttatgcagttttgtcgatgtactgatttattcttgttatgtaccagaatttgaatacgctggtatggttttgcttgtaattttctgacttgattgattacgtgttgcctactgagttaaggtttatttaatttcgaattggacagatgatggcaagaatgatattttcccttatttgtacatcttatggacaaataaactgtcactttttgacccatcattttttgacccatcattccctgcgcttttctgccataagagagccattcgtagtataacatgtattatggtgataagtttggtttaatctatattatatataggtggttgaggtctctacttccaagactgggaagcatggtcacgccaaatgccactttgttggtattgacattttcaatggaaagaagcttgaagatattgtcccctcatcccacaactgtgacgtaacatacatacagatcatgctctacagatcatcccctaatcccacaactgcttgctttaactattttgttatccatgtatcatgcaggttcctcatgttgatcgtactgattaccagctgattgacatttcggaagatggatttgtatgtttgctttcaacctttcccttgctttatttgtttttatgaaaagcctgtacagtttctaacatggtaataaattaaatgaattttacaggtgagccttttgactgagagcggcaacactaaggatgacttgaggcttcccactgatgatactctgactaaccaggtcaatgatttagctaaaactctttatcatcaatgtgtgttatctcttcaactaccatactctgactaaccaggtcaatgatttagctaaaactctttatcatcaatgtgtgttatctcttcaacttccattatatcttagtcgctttcatgtctgaatctcagatcaagaacaatgtgtgttatctcttcaacttccattatatcttagtcgctttcatgtctgaatctcagatcaagaacgggtttggtgaagaaggcaaggatatgatcttgactgtgatgtccgccatgggtgaagaacagatctgtgccgtcaaggagattggggccaaaaactaagcggctttgctcgattgcctgcctgcctacgatactttgctatcttagtgttgagagctgagacacataaatagaagttttttttatgctacctgtggatgaaatgacgatcaaaaccttcatcgattttatgttacactggatggtcatgagatacttgttaatgcttttcattatcagtttcaagtatcctttgaatcgagtggcagctgtaattcgtatagtaaaagtgggaaatccattctgctatgagatgtgccatgggagcagccgtccaagctcaattcatcaaattttatgttacactgaagattaaactgcagcaggtggggcagcccaagctcctaaggaaacattcttgctatcatattctggttttcttctcatagagaattctagctttgatctaccatcagcaagtgtgtattaagaagagtacatagagataaaaagaaaggcaacaacatagatgtgaaataagaacatgaggagagtacataacaggggaaaacaatataccatcctgaaaatactatgcatctatacaatcctacggtgaacaactagccactaaataaaaggtgttgacagcaaaaaaaaaaaaaaaaccataatccagatgctaaaattactccagctgcgttcatcactgttaaagagccactgattttgattctaaaacaaagttaattacgcctgcttgaaagcgtgtgcgttggatatgacttcttaagagagaatttcctgcacataatttcatgcaacattacgcctgtttgaaagcgtgtgagttggatatgacttcttaagagagaatttcctgcacataatttcaaggtttaatccgatgaatgattaggtagaaaaagaaagcaacattagtaaactcctgtaccctgtcttctccatcaaaggtgacgaccctgaacgggttccatcctgaattactgatttcagctttcccgtttgatcagagaagtgcagaaacaacgtcatcttcttcagatagtgtttggttgcaggcattggcgaatgctttgggatcaagctctcccatcctcttgatgccaatgctggctcgatcacttgttaactaactccttcaaaagcctgcacttacaatagatattgatgttgatcatcagacaaagaaatcaagaaaggaaattcgatgaattgagttacatgtacgagttgtttccggacggcctgcaacttgtaattgcttgttcgttcattgatgagcaattgagcagagcttggtttgagcgactccattgctcacacatcaagtgattgatactccttagatagcaaagctcaagataattgactttcttttcctccggacgcgtaaaagtagcacatcaatatattaggataattgactttcttcatgcttaactaaatctatttcttcacgattgtgtgagttcgcaagatatgtatttttttcttcatggtcctgtatcgagtctatgttttatgtctatcaaacatatgtgaccaagtagatttatagttgtaaatctattttagaacggagctagtactcgaggagtataggcagagtcctcatcagttgttagatggtgatcgatctccccatgaaaaaaaaaaactacaactaattagactccaaacccgtgtactccatgctgatgggagtataacttaataataataataataattacgaattttcaaaatatcaaatcatgaaaatatctcataataatgtttttccttaagtatcaaacgatactgtaagcaacaaattgcagcacacacacacgtccatgggagctcaacgcttcctcgtgtgtcctccactgcttaacgacgaactggatggcttcctccaatgtcgccttgcgcttctccttgtagttccacagctccgggaccgggcatcgttcactgggattgtactccttcatctcacgcagtgccgttgctaccaacctgtaaacttcttcaccgtgttcttctttcaactccctgagcttgccatcatccccacagagaatttcctacattggaggatgcagatcacatacacaaccgttaatcctaatctacacaatgaaattggtactgtatgtgctggttcgttaaaaaaaagaaggtaattttaccatccttgaaaagatacttagaggtaccacactttatagactaaaatttgatacctccaggtaaggttggaaatttcggtcattttggacccctccaatacgatattatttcagccgaaatttttcaatttttttattttttttcatgaattttggtaatatttgttcaaattcaactaaattttgttcaaaatttcggacccaaatcggctaaaccaaaaagtttaaccttgcctccaggtactaagtacctcgagttacaaaaaaaaattaatataaaatttaagtattttgagatacttttataaggaccataaaatttctcttgaaaaaaaacatacacaatcgttggtactatgagcttgctgccattctcagagagaatttcctacattgaaggatgcagatcacatacacaactattggtactacattttcatcatccatttgtcatcaagatatggcatgaatcaaactgattgatcatcgtctatatgaatactgactcctgtttgctgcgctcacagcgtttcgggggtggcgtgctcgcttccggcgctatccacgtcgacgcggagcgttagagcggctggttttgctgcgtctctgttcgcctctttctagccgttggatcgtggatggacggcgcctatttgatgtggcgtttggcccttccttttaaccatgttgatgggcttgcaaacaggagatcgacacgttagtctacgcacctatgcgtgcctatgcgtgtgttcgtttctttctggccgttggatcgcggatgggccgtgcttatttgatgtggcgtttgggccttggtttaaccgtgttgaggcgtttgcgaacaggagatcgacacgttggtctacgtgcctatgcgtgtgttcatgcgtggacatctcctatggtccataactctatgccaatgtggctctaactgaatgggtccagtgcactcggtgctggctgttttggccaatcggtgttgtgtgtcagggcggacatgcatgcgaggttggagcagtggagtgtcagggcagacatgcatgcgaggttggagcagtggaccagtagagatggcttttgtgagcatggtgcacatgatctgtgtcaatggcaggcgggccctcaccacagttctttgtgggccgccatcgtgcgctcttcctgccgtaatggtagtggagatacgggatcctagggtaaaacttgtgtatgggatgtgtccatggaccagtgtgcttgctacgggcactgggatgtggggcttggccaatgtgtctgtggtgcgccgggagttttctcgagccgcgtgtgctcctgctatgtacgacggaacgtggcacggtcagtgtgtggtttgttgcgtgcactcgggtgcactcggttcacggatattggctcgctgctgggtgggccatacagctggttggatagcgcttgtggtgtgggcagggtttacacagatacgggtcgaggtacaggctgaactgttcatgtttcacgccggtgaaagaggaacactttccctatgcttgctgcaaggttttctgctccctcgccttctgctcctcggcattcgctgttcctcttctccttcggtgtgttcgtcgatgtgctttgctgagcgataatggcgaacgcgaggtttgtacggatgaattacttaccgatggtttgcttgggtgttgccatagatcctgagcgaattgcatgtattttgtaggtgatttgagaagggctttgctgctgtgattggttgttcttggtttacttcaccctgttgcttcggtggactttctggtgatctaatctagtataatagatctggcaaaagagaggtatttgctgtcgctagcattttgcaggaacttattttccttttttggggttgcctcttgcagttcatctagctgtttggtcttgctggtggtggtgggtgagtgttgggtgcgcaggctctggggtaagaaaagtttctctttgcattttatctgtttggtcattttctttgcatgtggtttggttttcttgtgttggctgttgttgtgtgtgtgctgtcgttttcttacgtggagtcacgtgactgggccgtgccacttttttttattttggcttggtatgcactttgtttggtggctgtatactactacactgtattatattatcctgagtatttattcatatagataccctacggtagtgtgtctgtccatcgttggacacataagagcagagtggtaggtcgagtgtcttctttccttgaatgcttggctctggcctttccccttattaaaatcttctagccgttgaacttgggatgtgcttttctgtagtctcttctctggacaaactgttctcctccacttgcctatcttatcctctcttattttttttccttctcccattggcagtggtgtagccgcgatgttcgccgtgggagtatctcatgtctcgctgctgaatgccgctgctcagcattgcatgatacctagcattgcgtacctgtgggagtttagctccgatggtacgttgttggctggtattgaagtcagtctcccgtcgattggttgtgccagtcatctggacactatgttcttttgggagacggccttagctccacttcagagcgcacatgaaatggttgctgcaagagcactgaggtgtctccaacatcgttatggttttgtagtgcatgactacaattttaactctatgctagcttacagacggctggcacgtgatgctgtgcaggctgcattgtctgcttctggttgtgtggcacatttcagatcttcttatggtgcatttgttccttggtgtgatgatgttcttaggacatgtagctcactgtattttagttttttcgtagaagacatggaacaaatgggttcttttgaaatataggtgtttagaagttcctatctggttttagactgtgtttgtattgctcttggctattcggaattggcagtttgtattgtcagcttttcatgtattgtcagtaaaatgatgtttgtgttgctgatctgtgctgattgtataggcatgttatactgatgttgaaaaggccatgcgatagagtatccagagcacgtgcgagccgtgaaaggcataaagcgcgtgctttgacataggaaatatgcatgaggagcgccctggctttgccaggtgggaccaaaagagctcgctctcttatggattttagccctgcattggcagcttctaatagacaacgacgccgtctgcttcgaataggaaattcttcctttctttcgggtgagggatggcacaaatcgtatattaatctatgtcacactaggtgccttgcttaaaactaatatctgattcactgcagctaatgttgagcttgatagaggtagttcttcacgctctcacaaggatcatgttgaggctttaaagggtttgtgtttatttagatcccctataattgcgacggctggtttagcaatgttatgttagaagtttattgattgatgatcttgcagcatcgtacccggggaggtcgtactatggtgcaccgacgtacgagtgtttgtactgtggtgctgtgttttggttctaggagagggttaaaagtctttctgctatttcaaaacgaaaaatagtttacaatttgtgctgcaaaagtggtaaaatagagttgccgaaactacgtgaacctccagaacctcttaaaccattgttgaaatttaatggagatgcacgttcaaagagatttcttaggcaggtgcgatcttacaactctatgtttgctttcacctctatgggtgcaactgtcgatagaccgataaacaatggaagtgcaccttatgtttttaaaattaatggtgttgttcatcacaaaataggtagcctgctaccagcgcaagggagaaggcctcaatttgcacagctctacatctacgatccagaaaatgagatacaaaatcgaataaatatatttgaaaatgatggcagcaatagtgacaaggctgatcctgctatagttgatgctctgtgcactatgttagattcgcataacactcttgtgcagaaatttcgttatgctagagaatgcttgaacgagcatgggaatcagcatttgacgttacggctgatggggtgcaatgcaaaatctgatgtgcaatataatttaccaactagcggtgaactagcagcgattatagtgggcgattactcagtagctgagtatagttatgatatacttgtccaggaaaaagatgatggtttgcgacgtgtgtcctctttgcacccatggtatatgg

SEQ ID NO: 19420 - DNA, 518 bp, Oryza sativa
attactcgggccgccataaatgcgggtaggtgggcacctggaggcggacacttaacccaccgtacatggtgacctaaagaggatgtcgggggagcccgacccctagtcatgggagggggcgcccgccgcccgacctcgggcccgatcccccctcggggaaggccatgtggcgcctggggcaaccttctccctttagtctcggccagggagtggccgccgccccaccttgggcctgactcccctcaggggagggccacgtggcatcggggggcagcctcctccatctaatctctaggaaggagtggccgccaccccacctcgggcttgattcccccccccgggggagggccacgtggcctcggagggcagccttcttcgactagtctttgggaaggagtgggcgccaccccacctcgggcctaacttcccttcgggaagggccacgtggcatcggggggcagccttctccgactagtctttgggaaggagtggccagcaccccaccttgggccttgact

SEQ ID NO: 19421 - DNA, 16417 bp, Oryza sativa
  unsure (1)..(16417): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgaaatgaaggaagtaacatatgaaaaattttctgcttcctattggccgcattttaactctgaactgacaaagaaacttgatgcgtccactgtcttcactgaaataatttctcatataaagggtggatatcaagcgaacaaaccttttggtggcaaacttgaaaggcttgattatttaaagctttctgagaagagattttcgtctctgaacagtcagatgagagaaagggtatatgatatttttcttgattacgaaagtatgaaatgcacagccagggaatttgacttgtcagattttgttaacagtcttcacagaaaccttctttctgagggctacaatggtgatattgtggattgtatttacatagatgaggtgcaggatcttacaatgacacagatagcactgctcaagtatgtctgcaggaacttcgaggagggctttgtttttgctggtgacacagcacagacgatagcaagaggcattgattttaggtttgaagatattcgctcactcttctatacctatttccttccagaaatggagccatgtggtcaagggattaatcatggaaaacagcttcgtatcacggatatgttccagcttacccaaaattttcgcacacactgtggaatccttcgtttggctcacagtatcatgagtcttctgtactactttttcccgtcatgtgttgacaaacttaacccagagattgggcttgtatatggagaagcacctgtgctgcttgaatctggtaatgatgagaacgcaattatgactatctttggagaaagcaagagtgaccctggtaacttgcaagggtttggtgccgaacaagttatattagttcgtgatgatgcaaccaagaaacaggttgttgaccttgttggtaaacaagctcttgttttgacaattgttgaatgtaagggccttgagttccaggtatgagccttaccacttaaatttcaattgtggttgttgataagcatttttcctgtttactgtaagaagccttttaggactgaattatgttgtattaaataaatttctaggatacttatttatttttaaaatatcattttgtgtaggacgtgctgctgtacaatttctttagctcatcacctttaagaaataaatggagagttgtgtatgactacatgaaaggcaaaaatgttatagaatcatctgaagagatgtcccactcttttttcgacaaaaacaagcattatcttctctgttcagagttgaagcagctctatgttgcaattacacgaactaggcaaaggctgtggatatgtgagaatgcagatgataactgccgaccgatgtttgactactggaagaagttgtgccttgttgaagttagagtacttgattcttcactcattgaagcaatgcaggcaggaagcagcacagaagaagattggaggcaacggggtaccagggttagtgttatactctccgtcaaaaattcaaggcatcatgtatttcaaaacgttgacatttacaacttttgtctaatactcgtttccatcatgttgggcatggtggataccagtacattagtccattcatcatgctatctgttttggcaaggttttagtcatgttgattgtttgccctttcttttagacaattgatatgtggacttatgttttttcagttttagctcttctttccagcaccgttgtgagctacttataacccatgcacattctttccttgtagctattcgctgaggggcaatatgaaatggctacgatgtgctttgaaaaggcaggtgatgcttacagagaaaagttagcaagagctgctggacttctagcaactgctgaccgtgtcatctctacaaactttgagatgggccagtcttcattgcaaaaagcttcagaaatctttgagtctattggcaagcatgagaaagctgctacttgctatatgaaattaggtgactacaaaaaagcaggtatgatgactgtcttaaattgttatatggttgtgtattacattttttatgtcttcacctttccatcttgttttaacaaatggcaagtttctcagaaaggttttccccaaaagtaaatgattcttcctcagcgaatttctgcttccagattttttttgtaacatttttttcctggtagtatcatactccctccattccaaattgatctacatatttcataggtacaccaagaccaagaaaagctaataactctctcatactatatttactatagcaacaaactcgatgcatgttccatccccactatttcctagccaatagcaaatcaagatattgcatgtgggttataaatacttgtgtgcatggatgcatgcatcaatgtccatttactccaatgcacaaataacgaatagacttaataaatgaatacaaatatgatgatcatttaggaataacctcaaaaaaactaaatgtagatcaatttggaatggagggagtatttgcctatattgggttttcacacaagtattaccacataactttcataacattttcaaaacatctaatgtggctttaacttctatcaggaatggtttatatggaaaaatgtggtaattccaggctaaaggatgctggggactgttttgaactgagtgcctgctggtcactggcagctgacgcatactttagagctaaatgttacgccaagtgtttgtccatgtgttctaaaggaaaactgttccaaaagggcctacttctcttgcaacagttggaggaacatttgcttgaaaattccagcctcgtcaaggtggctgctattagaaacacatttctagaagattgtgcgctacactattttgagtgtggagacataaagcacatgatgccatttgttaagtctttcagctctatggatcacattcgtgtattcttaaattctaagaatcttgtggatgaactgctgagtgtagagatggatatgggtaattttgttgaagctgctgggatagcaaagcatacaggaaacatcttattggaggccgatctgcttgaaaaggcaggttttcttgaaaatgctacacaacttatcctccttcaattatttgtgaattctctctgggcttcgcacagtacaggatggcctccaaaaaggtttgcggagaaggagcaattgcttgcaaaagccaaagaaatgtcaaggaatgtatcggagtcattctactgccttgtttgctcagaagcagatgccctttcagatgaacataagtctcttgccagcataacttataacttgattgagggcaataaatgtggaaacttgttagtcgaacttatagcttctcgcttgattcttgatgttcatcttcaggctgaagcctctggatactgttttgaatcagagccagggtctcatgatggacggcattgcaaagatatgctagttcttaatcagatatcacttgaaactctagtatacgattggaattactggagttcaattatagtcaaagtgctcaggcatcttgatcaccctaaggacgcagaatcaaatgatttggcagcaatctgtgaagatctttgtgctaaatactttggatggagaaaagatggtgattatgaccggtatgtggtacttaacacagactctagctggctgtctaacacaggaagaaattatttgcagcaagatggcaggagatgttggctggatactctccattgtcattcttgtgctaaggatttttggatcaatgaactttattctgttggtttgagtgtactcaagaagttggaatctattgtccaaattttgccaacatcatcatgctccctgggtagaactatactcgttatatacgaaattgcaaagtttctaaaggaatcagagtttggcatgccaaaaaataccataaagtactactctattctttgtgaacgtcgcttcttcgagttggttttccttgtctggagggatgaaacaccaaagagcctcttgtgtatacttgactcagcgactacatataacctgctctctgattccatctgttcatatcttggttcaagaaacaataaaatgactcatagtcaagttgggagaataactatgcttcttctccatgcagcaaggttggatgattcgttgatttcacagcttgtggaatatctagacagagggtctgagtgggcaactttttttctatcgttgaagaagtatcttgacaatggtgttagcagagacatcttactcttggacttcaaatttgctcttgattgcacttataaggcaaactggagggctgaacactacatatccccgatatgctatgtagatctcattgagtgccttggctttttggctacaacgcatcttgtactgaatgactatatgttttgcacaaaatctctgttggccaaaatgatgaagtgtcgcactaccaagggttactttgagacatgtatggctcctagcacagatatcgatctgggctatgcaggtcattcagcacggtgtttcatatacctgtcagttaaggatcttttgggaagcaagcgtatgattgtagagtgggttcagaacacctctactccaactagttcttatgttccaatccttctgagattagttatcacactttatcttgtgactgtaaaccaagacgatggagatttgtatgaggttacagctttcctcgagaaaaatcatgtttttacggatttacctcctgagttctctgaaaagattagaaatgctttgaggatgaagtctcgcacagtgaagaacttcatgagggtatttgctgatgcccttgcagcaataggaactcgcatggtagttatgggtgatattaagaaggcaatggcacataaatgccagccagacttgaatgctgatatgattagcagtgtggatttgagtgatgctaagaaggtaatggcacttctttcaacagagaagtcaagtagtttaaagcaggaacctcagctgccagagatcaaatctgtttgtaacaaaatttgcaacgctacttctggtcacttccctttgacaagtgtaggaggtagccagaagagtacaagtaattttaatttgagtgatgtggatcatcctttgttggagaagtttgaggcgtttcaagtcaatatgcctcaaaaggtgagttgataatttggtaaattcgtttggtcatcttcccttttgttcaattgtttaactacggacagcgtttttctgcagaaaaatggaagcttaatttctcaaattcttagaagtcccctttcctggatagagcaaagagctcctcctgtgcaaatgttagagttgagacacatttgcaagcaagtcgaagaacagcatgttaggtaagcaaatatggttgagttgtgtgacctcgtaccatccttgtgctgcttgccaacgtgtataaaatgtggaaacgatcacctgagctcatcatgttctagcagcttaacacagtacttttcttgtcggttaatttcgtgtgttctttaaacttcatctccatttttctgccatcacagggagaagagagctttgtccgtgaaggatctccattcaaaccgggaacatggtgatggtgaaaaaaatattgggaagatcgtcgacgtgcaaggaagccaatctaaccctgacagagctagcgaatggagtggatgctcagatgacgagcaagagacgggaggaagtaatgtggtgcagtcgaccaaagaagcaccagccgctgccagctccggccccagctccaaaaacaagccgcagaaaaagaagaaatctaagaagtccaagcgtagcggcaggaagtagtctctgttttgttttgctcttctgcctgaccaggcgtcggatggccttttttgcttacaccgttgtaagtccagcagcaaggccagctttgcttaactggatgtactccctccatactgaaatcgtttttgacagcgacacggtctccaaaacacaactttaacttcctgtttctataaaaatatttattgaaaagtgatatatgtatacttttataaaattatttttcatgacaaatctatttatataatttttatattttcaatctcaagttgagagatatttataatttatatttctaagttttgacttaaccttatcctaaacgatctcctttacgagtacggagggagtacttgataagaattgtttgcttatacagtgactgtccgtgcattagtggaaaaaaagggaatgctttctcacccccagtctttgtgtttgatttcaaaattaatttttaggggcttttgcccccccttttttttgcacagttctccattcaatgttgctaagaagagttaaaaaaatcaaactaaaattcatccttaattcaagttatgaaattcaaaactgctccgtttcctattatgtctctttttcaaagttagaacttgttaaaagtttgataaagtttatagaaaagtgtaacaacatttataatactaaattagttttattaaaccgatcattgaatgtgttttgatagtttttgttttatgttaaaagtattgatatattttcatacaaacttgatcaaagtttgaaaagaagttaaaggaggttgacttataaaaaaattgaaaagaagcattgtactactccagtagttaaagaggctgtaccgctgtactactaagcaggcggctccgcctggccggtgacggtgagatactccagtaaaccccacgaaaaccctcaccctgaccctgctgctcccccgcggtgggctccccgtaaattctcccccgaaaccgcccgagatggcggctgcggcggcgcggctgttggagagggcgacgagaaccgcggcatcctgctcctccgctcttctccgcagtcctctggattctttctccggacgcttcccaagcttccggtcgcccctcctacggccggctccggcgccgtcgaccgtcttcccccggggcctctccgacacggccttcgacgcgcaggcgctggacacccgcgtacccgccaccgtcatcaccggcttcctcggctccggcaaggtgaccgctgctgtccttccccttgtgcagtcttgctagctttttttagataatggaagctttatttagactcagttaattacatcaagatgatacaatcaaactgagtcacccccggcctctgcataaaatgcacacagccaaaaagcgctggagccatatagacagtgtacttgagaggcgcttgcggcgatccaaacttgacggggtaatttgaactagaatccaagaacttgatatatctgtaaaaatcaaattaaaaccagtctggatttttgcactatatggggcttgcttccatggttccggagtgttaaatagtaacatacatgatgatacagtttataggaaacttatgcttgtgtggtatagttggctaattgtttcgaatttaccttttacagacaaccctcctgaatcacattttaacttcacagcatgggaagagaatcgctgtaattgagaacgaggtaattctaagcagccatatatcttgcggacttgtcaaaattgcattgttcagttatgtgcaacagaatcttcagatcaggctgaccattgtttacttgatattctgttttccaatatatccatatttacattcaattagcttggtgactagtgaccacatactgactcagttatttcttagtttggtgaggtggacattgatagctcactcgttgcaagtcattcatcagttgccgaggacattgtaatggtgaacaatggttgcttgtgttgtactgtccgaggggatcttgtaaagatgcttctgaagttggtaaagcaaaagggggacaagtttgatcatattgttattgaaacaacaggtgggcctcactggattgtattgctaaagtatggaattggaaatgcctccttttcttgaaggtccatgatttttcaatgcctgacagagtcaatgccattaacccaggtcttgcaaagcctggtcctgtcattgagacattctgttctgatgaactggtctctagatatgtgaagcttgatggtgtggttactatggttgattgtaagcatgccatgaaacatttgaatgaagtaaaggccaggtgggttgtaaatgaggctgtagagcaagttgcttatgcagacaggattatattgaacaaggtatttactgcctactaatacatgactcagtagtcagtactataagttcttaaaaaaaggaatacaattttatcttttctgcattcttccggcttaaaaaaaaaacttctcaaaaagtttcttgttttactaatgttccgtaacatacatttctgcagactgatttggttgataatgcagaactggaggtgttaattaacaaaattaaggtaaattgatagagcggattccttaagaaacaaaaatataagctgatggatttttgtacaagctgattcctttttgtgcagctcataaatgggatggcacagatgagaaaaacaaagtttggtgatgttgacatggattttgtgctaggaattgggggctatgatcttgataggttggttatgcatgggaacattttttggagggtattgaagaaaaaaattggttttgaccctgagttagatatatatcttgcttctctaatttgagataggtaatgtacaggattgagtctgaagtccagttgcatgaaagaaaagagacaggtcattgccatgctggagaagaacatggtaaagtttgctttcatatccttgatcaccatgccatggttcccaatcatattagaatcatgtgaattatacctaggagtctaggacaccatgcaagagttaatggcaataaaacattcttattaagaaatgacggtaatacctgaaaaaatgagatagcagccagatccttaccacagatagtctgtgtccatgttttcttttacctgcttctactgtcaattcagtcagattactatttagtttgtactctactgatttgtagggcatcagcaccatcatggacatgtccatgattcagctgtctcaagtgttagcattgtttcggagggagtacttgatcttgatgaggtaaaccaaagcacttggaacatctgtttaaaatatgattattcagcagggatttttgttctttgctgctagaagtatactcagcaaatcaactgatctatcactactgtctttatcaggtgaatgactggcttgagagactcgttgaagagaaaggggaggatctttatagattgaagggtgtaatctccgtaaatgagtcaactggacgtttcgtattccaggttagctgatctaatagcttttgtattccaacattggtgtgatctatcactacctttgtttatccattgttggtacagagagctcttgttttaatgcttttgcaattcaatctactctaattctgtcttcttccattactaaccctttcttaaaatctaaaacttacagggtgtgcactctatgttggagggatgcccagctaaaccatgggagccggatgagaaaagattcaacaaattagtatttattggaaggaatttggatgaagctgcactgcgaaaagccttcaaaggctgcttactgtgaacactctgatcacgtattgagtcctgggaagccatgcatatatcaaactgtacaagatgtttgccttgtgctcgctgataaaatgcttactgtttgtcaccaacgtattaggccaatctaaatgtgttgcatgtcatacgtgggtggtgggtcatggtttacgtttatttgtggtatcctcatctgtgccaggatcatacctgtgtatcatggacaatcagacaacagagtaaacttttttaagggaaaaccaagagttcatgtcccaatggtctgaatttctgaatgcgtggttctgcctcttgattgaatctcgagcataagtttatcttatcgagattgctctggccggaagatcgatttgcttcgatgaacatcggatccgatgcaaacagtgagctgacggttgattagtgaaagaacatcaccttacccaataagataagggttaaaattgataatcggtttcatgatctgctattagcccaatcacaattttgatctagtagcactagatgatgatgatcccagctaattttgctactgctaatactagtgcgattgtgtgtgaactagtgctaaagttgctaaccctaagttgcagctgccacatcccaacggctattttttttctcggacacactgctagccgttgcggccgccgttccgtataaatattttgacggatctaccagtaaccccacaaggatactactccgcgaggcacctctctctctctctctgtgagtttcgtgcgatctcgcgagcgaatccggcgcgcgacccaggctctccaagatccccgcgctctcctcttcggtttactgatctgaaatctctgcgtcgaatcacctgtttgttggcttgaattgcttgtccgcgtcgttgatttcgttgtggtttcttgatcttcggtggaatttctttgcgttggattgtctccacccctgttggtttcttgtcgattcccgatttgagttgttcgttggcgtgaaaaggattctttttttcccctgagatttcttgatttttggtgaaatttctttggtgttgaaatatcatcgccttttggtttcttatcgattccgtcgttccgattggagttgttcgtcggcgtgaatttttttttcctgattcatcgttgcttgttgattggggatcgaatttttcgtctacgatccatcttattcgtggtagcagtatctcttcttgttgctgcgctgtgccctgtttatttgtttctgcttgttgcttctgacccatggatgcaggttcgcactcgatctcatcggagaagagcagccggtacgtggcgccgcgacagccactccaggaggccggatccagaccgtacatgccatcgctgagcacggcgtcccgcaacccgtcagccaagtgctacgtgagttctctgttctaagcgtcgccaaggaacgcacacaagctgttcgacgaaatgactgaacgggtattctccttgtttggcagggtgacaggtttattccggacaggtcggcgatggacatggacatggcgcactacctgctgacggagccgaggaaggacaaggagaacgcggcggcgtccccggccaaggaggcgtaccggaagctgctggccgagaagatcctcaacaaccgcaccaggattctctccttccgcaacaagccgccagagcccgagagcatcctcacggagctccgtgctgatgcggcttccatccaagccaagccggcgaagcagcgccgatacattcctcaggtatgcacacctggttctagtctagtgttcattgctgccatttagctgtaactgtctagtgcctttggattatggttggttgctgattgcctgattggatgtgcgctggttgaaaatcttgtgcagtctgccgagaggactctggatgctccagagcttgttgatgattactacctcaacctactggactggggaagcagcaatgtgctatccattgcgctgggcaactcggtgtacctctgggatgccacgaacagttcaacttctgagcttgttaccgtcgatgaggacaatggccctgtcaccagcgtaagctgggctcctgatggccggcacatcgccgttggtctcaactcctccgatgtccagctctgggacaccagctcaaaccgactggttagtacttagtacctcttggtctgtgtttgaatgttttcattagcattgcatgtgcagttgtgcttagttcctgattgtgattgattctgcagctgaggacgatgcgaggcgtgcacgattcgagggtcggttcgctggcatggaacaacaacatcctcacaactggtggaatggatggcaagattgtgaacaatgatgtgaggatcaggaaccatgttgtgcagacataccaggggcatcagcaggaggtgtgtggcctcaagtggtcaggatcagggcagcagcttgccagtggtggcaatgacaacctcctgcacatatgggatgtgtccatggcatcctctatgccgtctgctggccgcacccagtggttacacaggcttgaggatcacttggctgctgtgaaggctctcgcgtggtgcccattccagagcaacctgctggcatctggtggtggtgggagtgaccggtgcatcaagttctggaacacacataccggcgcatgcctcaactcgatcgacactgggtcacaagtgtgctcgctggtctggaacaagaatgagagagagctgctaagctcacatggattcgctcagaatcagctcactttgtggaagtacccgtcaatggttaagatggctgaactcactggccatacctctcgtgtccttttcacggctcaggttatcttttgctccttgtacctgccgtttaaattgacaaatattgctctgaacagattgctgattacttgtcttgtggtaatcttgcagagccctgatggtctcacagtagcatctgctgcagcagatgagaccctgagattctggaacgtatttggggctcctgaagcacccaagactgcaaccaagggttcccacactgggatgttcaacaattccaaccacattcacatccgttgaggaacacagtaagtactaccttcatctgtatttccctagcgcttctacacattacacagtatcaatgtgatgtccaaaagctgcatgcatatctattaactacaagtagctcattgtgctgttttgctctatgcatctttgcagatacccttggttctgtgatccagtcataacttacaaagaagcagacttggtgtgaagggtcatttgcaggagagatcatcttacattattagcagaagagttagattttgacatgttgtatataaggttttgtgctatgttgataacaattttatgtacatcaagaccggtttgatgtattgattggcgtagaaaaaatgtaaaaaaattgcttttctgccagtaatatacatttttatatacttgccaggcttttcttgtagtaagttcctctcgttgtgtagtaacttgtaatttgattgattttactctcgagccaattgagatgtctggtaaccaggaaattgctgagatgagtcttcctcttactccattggattgctatgatattttacttaatgtcattattagtttaacaagcttctttttcagcatgactgttgtgcttctggggaacagcaaatttgtggtgctgttgggctgttttaacaagtccattcagtatattttaattgcccccattttaattatagcatgcctttacagtttacataaactatttataatattcacctaagcaaccagatttacacacacacacacaaaaaaattagatgatagtttcgggttacctaccattcattttgctgctgtgttttaaaggttgatggatttggattgatcatggtcatttgtacttttgtagtctttatctttagtgcattaacccaacgtcccaacccatgatagagtgcttccgtctttcggcgcaacactgtccatcagatcctgccagcttgatcctggccgtccaacgatgtcatactagtagtacatggtatactagcctagccttcttcaccaaccggccatcgcccaccggcccacgagcaccatctctcctctctgctccgcgagtggccttttgcccacctaagccgcctccccatcctctgcttgctccggcgggcggcgagcgccccgccggaccgacgacgacctcgccgtcgagctggtggccgctcaacctctagcgctcgcagggatcccgggaagcctccctcggccgcgtcaccaccggcatctggtgctttccgctcccaccacagtgtgctgctctcgtcagttgccaccgcccgactcggcgctccggagcccagatcttggttccggaggatcctctccggcgatggatttcgtgaaggttttcgatcaggccgtgcgggagatgtaagttgtgggccgagcccgagatctcgccattgctgttccgatttctcgaggatgtggcgtgttctgagttggatccgtgagatcctgatccgttttctgtgtgtgtgttgctttgcagaaagagggaggtcaatttgaaggtgctcaaggttccagagctcgaacagaaggtgcgattgcgatatcacctttatcttaactctgtgatttttgcaatagagttgtaacagctggattggttcgtatgatgggtgtgggagcttgggttttgcataatcatgtgcttttgatatatttgttgtctgaccccattacacgctgttagaattcatgtaatcatgtcatagtagtactttaaggaaatgaatttcaggagtaccaaaattaagtctgcaatgtgtttactatttaggacttgaggtaaaccagagatctcaagtgctttcaattgaagtatctgtattgccaaatttgtgccgttgaaggctactgtctggagctgatgcgtggatatattgagttcattgtacattttgtagcacgccttgatagttgatagtcatgttgctttgacaatcatgtatcttgtccgtggtgtagatcatggttgtaagggttttcgtctgtaatagtacattcacccttatggtgcatgtttggttattctactgtgggagtatattacagatatgtatatttcttattaacttccacagcaaaaaaatatagatgtatatttttgttcttagctttgaattttaccttcgattctttttcttatgtagtaaacaatatttctttcctttaaaatttcaggtacttgatgcaacaagcgatgaaccttggggccctcatggtactactctttcagagctatcacatgccaccaagaagttgtaagttacaatctcttattaactaggtgaaaccccgcgcgttgctgcgggattttagtatgatagcaataagtagaaataatgtgtaagatagctagacgacataagcttacataatttgatatggtttatgataatttaaatagtatttaaaatgatggagaggtatatttaaatattatgtgaattatgtgagatgatgatttaacatatttgcattttaaaagtcaaaaaattaataaattatagaattatagataatatagcatgcttgcatgatgtttaagatgtaataattattagtggatgatgtgacatctttgtatgttgagctttaggatttagtgggttgtaactttatagtaagataggataggatatgtattttccccttgttttttatgctgaaatggtgctttcaaattttgtagcgctgaatgtcagatggtaatgagtgtcctctggactaggctgtctgagcgaggctcgaaatggcgtcacgtgtataaggtttaactcttgaccattttgtattttctttgtcaagtactggggctttgtactatgagttctacattggtcactatgccaataccaatggtcaaagtgaacagcaaaccttggtatatgcatggttttgtatcagcaatgtaactaaggcatataactattaatgtccaggctttgacaattattgagtacttaatagccaatggttctgagcgggcagttgatgacattcttgatcactattcaaagatctcggtatgtcttgtttatgcttttgtttctgatatatagtatttcttttctcttttttgaagtttatgtcattaaaaactttgttctctgtgctatatttgtcaaggttctttcaagttttgaatatgtggaacctaatggaaaagatgctggaataaatgtgagaaagaaagtcgaaactatattgggactcataaatgacaaggagaaaataaagtctgtaagagagaaagccgccagtaatcgtgacaagtgagttcttaaggaaaagaataagttgtgttatactatcttttttctggctgtttattcatcctgtacaactccaattattaacatatgtttgttgtggatgaaggtatgttgggctatcatcgacagggataacatataagtcaagctctgcttcatttggtagcaactatagttctggtgaacgttatgggagttttagtggtacaagggaaggtgattcatacggtgacagttatagggataaagaacctgttaaatcctctccaagttatactggcagccagaaatctggcagcaggataaaaaaggatgtgaa

SEQ ID NO: 19422 - DNA, 12078 bp, Oryza sativa
atatatcctgattattataactatttggctgaagtgaacaagtatgcaggttttttttttccttttatcgtgaaaagtagtcagtgttatatgatacattttccaaacatgaagataatacaattgtagatgtagttgtgatccttaattctttcaatctctatctacaggtgcagctaatacaaacaccagtggcgtggatctttttgccccaaacttattggatgatttcatcgatgtgcctgcagcagcaactcatgaaacaaacgactctgcagacgctcaggttgatctgtttgctgatgcagatttccaatcagcaataccaagtacagaaacagctgcgggttcagatgtccaggtttgtttatccatgagactacttgaatacttgatacattttttttgcaggcctgatgaatatagagaaaaatgtttatcctagtcctccaatctgggatatgaaatgtgctgaaaacaattgagggtgtttctccttaaatatttagttgtgcttcattaatcttagaaatcatatagttcttcaatccattgatcatgacacagggtgttatatcaaaatgatactgcagggcaatgtagacctttttgcggaacagccagccttcacagcagcctttccaccacagacagggtttattccaccaccaagttctgggacatctgaagcaaatacttccacgtctaagaacacaactcctgaaccttttgatccttttggtgctattcctataaacagctttgatggatctgatccatttggtgccttcaactccgatgttggatcatctagtataccaccacccacgcagagttctgttggaaatatcagcacaccaagtcagaaccctcaagcagcatctgactttggtggctttgtgtcgagcactgtagaaacagcagctaaggacccctttgatttttcaagtagcaatcttgggaaaacacctttggcagatccaaaggctgatgcatccgattttggtgcctttgtatcgcacagtgaggaagtagccaaggatccttttgatctttctttgagtaccagctctggaaggacaaaccaagcacctctggcggctcccaagtcagataccaagaaagaaaattttcaggtcaagtctggcatatgggctgactcattgagccgtggactgattgatctgaacataactggacgtaagttcttccttttctccttgcccttttgacaaggatatcaccttgccatatcttgatggcagaattattaatgatttctcattgttcttcgcaaattacagcaaagaaggtgaacttagccgacgttgggattgtcggtggcctcgatgacgggtctgatgataaagctctgccctcatggaccatgggtgcaggaggttccagcctaggaatgtccggaattccttcatctacacaaagtggtggcattgagagcttagctaactacaacaagtaccagtttggctttaaatgagctttcatgtgaggctttctagtatatgccggttattgtcggaatgtcggcttgtgccttatttattttttgttgattctattctcccctcttttgatgcttacattcctttacaatcgcctccaaggatcgtgatcttggttcgtcttgtcgcgcttgtattgtatttattggatttgcggatgagagactcctacctatatcacaccctgattcaatttaactgtactgttatttcacaatcgtgttaatcctatggctcacctctatattgcgatttatgattcggtacagcaacatgggatcgttccttctgccgcttccttgaactcattgaaatgaattgatgcttgtgcatgtttgggtcagagtgggggatagagagaggtccaacctgacctgcaactttcaggtttcagtactacagtacaactttacggacattcaggaagggaaaagtacaccgaagatccctcaacttgtcatcgagttacaaaatcgtcccccaaccgcaaaaccagatattagagatttttcaactaacaaaaccgttcgcttgagatcctccggttgttttggacccggttttgtatgacgtgatgggtgagtcaccgtgggccccacgtgtgaggctgccacataatctccctccccctccccctctctctcactcttctctctctgccacatctctctctctctcttctctcctctcactcgctgcagggcgggcgcggccaccggggggcgccggcgaggtgggcggtggcggcgacgggggtggggatgagaacggcgggggaaggggaggggagcgagtcaagggcggtggggaagacctcgtcggcggcgaggcggcgaaggggcgacggcgaggataggagggcgtcggcggcccccacacccgcaaccacccagcacgcgccgccgatgcccggcagtccctcgcgcgccgccgttgcggacgacgacgacgaactctcgcgcctcctctccctggccgaggccgacctcgacgccggccacctctgcgccgcgccgcccgcctcgacccggactcctctcgacccgccgcggcggaggggcgacggcgaggagaggagggccggcgccgcgggcgcgtccggcggccatcaggtgaggagggccggcgtggcgggcgcggtcggcggccgacaggagggagcgcggcggagaggagggccggcgcgacggtcggcggccgacgagggaggagcacagctgagaggacgcctctctgctcccgccgcgcccggagccgtcgcgacgatgagggcgagtggcgtggagttgttggcgccgccgctccctatccgccgccgcttctcggccaccgcgcttgcccgccgacgccgccgctccgcttgctctggccgcccctctggtgcggcggcggctccttcggggacgaggccggcaggttcagatcgaacggcagcagcgagcaacgcggggcgggggccttgtcgctggcgcccgaggcgctgtcctcgtagagcacggaggaacaggagctgcgatggggagagcgaggagaccgccgtcgtcatccacggcagcgggtggagaggcgacggagaccggcggagtgggaggcggcgcggccgcagaagaacgaggcgaaggcggacggcgccgatagggagcgtgacgggagagcgaggagcccgccgccatggctacacatctgtcgcccgccccgtcgacggctcgggtgacggcgtgggggccggccctcctactcccacgtcgtcgctgccgctgcgtcgcccgtcgcccatcgccggccgcccgacgtcctcctctcccgcctcgccccgccagccggcttgccgagacagctcgagaacggcgagggcggcgtgaagatggcgcgggggtcgttggctgcgaccccggcgcggcggcctgctcacgcgtcacagctgccgtcgctgcctcgtcggccgccgccctcagccccatcacgccgctcgtggccgaccccttcaaccggtcaccggcgtcggcgtcaacggaggaggaggccgcgaccatcacactcgcgcagagaagagaagagtgagagagagagaggaggaggaagggagagatgacgtggcagcctgacacgtgggatctacgtggggtccacgctgactcacgcaccacgtcagacaaaactaggtagaaaaccaccagagtacctcaagcgaaacggaaggaacctccggggaacgattttgtaactcgatgacaagttgagggacctttggtgtacttttcccattcaggaatgcacttacgggagaagccaaactggttgttcgcaagagccgcttctccctggttgttcggaagagcctttcttgggggccggcccattagtatttgtgtgaaatactttcttggggccgatatagtgaaaatggtactacatttattctaaaatgtaatagcttttagctgcggatctaaatatgtgtttattcaaattcatagataagcttactatattttagaaccaatgatgtaggtaataaccgtgtcatctttagaggcatgacgtaaaatcactactagaaaacaacacaaaagggacggcactatagttgtcagaaatgcaagaaccaatacttataacgtttttcccgcccgagcgcgcacccggcgggcgccatctttgagaactgacacctatgcggcgacataggtgctggtctttaatagaaatcgatactaatatcattagtgtttttttaagagaaccgatatctataatatattataggtgctagttttataatgagccagtacccataaaataagagccgagccggtgtccttatccacccacctgcgcacccacgcctacccatcctttctctcgacagttacgcctctccatccttatctcctcccctttgtcatctctctctctctccctctctctctctttcagctcaactccaacctccacccctcgccaagctccttcctgaccatgcccacctccttctcctcctcctccaccatccatcacggccataatcacctcctccatcagatccaacagcatggatcacgataaccactagagcggccagatctagcggcggcggtggaggagggtagatccccaaagccctcctctcctctttggtcggcgtccctggagcccaaggtgtcaggaatgtgtcagagtccgccagcggggagtcaagtatgagtaatccttatcgtgcccaagtaggctctgcttcacttttcttatctagaacaccttccgtatacaatattttattttgtataagacttggaacatgatgggctctatcaagcctaacacaaaagtattaggtatgtcttatccgtaacactgataaatattgtagcattacttatgataaacaagtccatatattacccaggattgtatctaaaaattagagaagtagagaacctggtgcgaaatgtatttggaccctaaaatttgatagccaaatcccatgatcctgttatcataatcaatgtgatatgacttgtagaacgtgattatatctagttctagtcgatttaactttaggtattaggcatgttgtggccttttacttttagttctgaatcttagatcttagttctgacattctggttctggctttatcattctagttattatatcgctaactaagtatacttagtacttcatataattaaaatttgagtcccctaactttaggggccctaaacaattgtacactttgcacatgccactgtacgatcctgattttactaattactctcttttgatgtaaaaaagtttttagctacgaatttagacatatgctacatccaagcttataactaaaagtccttttcttatatagtgagtactaagggcatgcccaatgcaggatgcaccccaccatccacacgagcaaaagtgaccaagcacctagctagagatatgcctcacacagtgcaagctatactcctatggaatttttatgtttcagcacctgtcagtctgtcacattttgcatttaaacccttggattattattatttgcatatacatccaatatttgcagtataccccctaaaaatcacaaagatatatatacatcaacccctcctcaatcctctcatcaccatctcccctcccaatctctccccgcgtctcctccctctccgactctctcttcgccggcgccgcctctcccctccctggccatctctccccggcgctcccctccccggcgccgccgcctctcttcccgccgctagatcgaggcggaggtggcggatcgagcggcggaggaggcggatcgagcggcggtggcgccggatagaggcgcggcggcaacggatggagccggaggcggcggatcgagcggcgacgggtgcggattagggatggcaattgtgcccgtttgcccgtttacccgcgggtaaaaaccctattagggttgggtttgttctccattttatacccatgggtatcttattgggtcaaaagctatgcccgatgggtaaatgggcatgggtatgggtaatcactacccatgcccgctttgcccgtttacccgcaaaatctaacttacatgtaggttaggagcaaaatccactagaatacataagccacgttctttgttttctacggtttccttttatttcccttattatttctctcctcttactctattgccgccagaggagagacacaacaccgaggcggagaatatttgatgttttaagttcgattcgaacttagtagcttgtagactttttgttccactgcttttgttgtggcgggtaaacgggcacgcccgcgggcataaggtgcccgcgggcaatgggcatgggcaaccatccttacccgtcatgtagtaatgggtatacccgcgggcacaaataatctcaccggcatgggtatgggtaggcactacccgtgcccgtcgcgcccgattgccatccctagtgcggatgaagccgcggtggtggcggatcgaggcgcggaggcgccagatggaggcggaggcggcagatcgagcggcggcgggggcggatcgaggcggggcggcacggattgacgccgcggccacggatcgacgcagcggcggccgggatcgacgcatcttcttcccttctctccagtctaccccctctccatcttcttcccggcgtgggagcagcaacggtttgggggcaacgtctctcccccaacgcggctcctcgcctgttcctcgccgaaaagctaccgaaaccactcgacgctctgcagagggtcgcagcgctaggtgagggtgcggtcccgatcgacgtggcgtgaatattcccctcgggagcagtgagaccactctccagcgtggagcgttgaaaatagcctaaggaaaggaaaatgggcagataaagattagtgaaatacggagcaggcgaaatcggggcttttaactatttgccactcttacggatgttgcttaacgatttgccactaggcccacatgtcatagacacatgagggcccacatgtcattgacagggtgtggcaaatcgttaattgccatgtcacaagagtcgcaaatagttaaatttcccggcgaaatcggccagccgccagtcacaggagcgagaagtcaagaagcaaagctggcgcgaatattcgcgcgacatcaacgccaacatcttccccgtctctctcgctacccatcggctccaccgctaccctctccgccctgccacctggcacccgaatattccttccgcccgaactgttgcgtttacatggccccacatcgctccgcgtcattagatttagcactttatcttcttccacaaagattcgaattttcttttcggtttggatcatcgcaagcgatcttttcactttgagctactgtaccttttttttgtcggcatagttggactaacgatgatgctcgtgccaattgcaacgcagcgctcgtgctacgcatcagtaagctgtagtaaaagtatctagtctagtcgtctaaacaaagcacgtagaaatcaacacggtttgtgcgccgtgctcgtgccaattgggggagcatttttatccatctcgtgtacgtgccggcgccgccgtgttggtggcgagcgcgcggcggccacgcacgtacgtggccccgcgcggttggcgcgggcgtttagccgagagatgctctctggttggtttgttgggttcttttccttttttttgtttcttgcgccgttgcattgcaccccagctcaagcctccctagattccgcgcgcgcacacatggatgctttctccttcctccgcgccaccgtctccgcttccctcgcgtcctcttgtcctcacgcagagagtagacttgcactgctcttttatctctttctctggccaccaagctggttgttgtatattactagtagtaatccgtcgccgatagctgcttcgtgttgctcgatctttgaccagccagtggggttggaggagggagggagctagctatagttgctagcgtgtttacgtttttgccggcgaggcgatcgacggagatgtttgaggggtgctacggcggagtcgggtcggcggcggcggcggcggcgcgggacccgaagccgcggctgcggtggacgccggacctccacgagcgcttcgtcgacgccgtcaccaggctcggcggcccggacagtgagtcctctttgcccatcagtcagttcgtttcctgcttaattttctcttcgcggcacggtgacgacaacttcgtagtcctctagctctgtttcggttggcacttggcaaaggcaaatagtctgctgatttctctaaactgcaatgtttattgcattgttcatccaaatccttttcctctgcgtgactctgcagcttggcacataactatgtagagctgcatggttaattttgggcatgcaaactggttttcaatttcagtgtcaagaatttcattcgaagaatagtacgcaaacatcatttgtcatgctaaataaaaatatcacgcataatccagtttgaacctgcttcctttatcctttatcatagaataattgattgtctccattctgatcgtgcttcctgcaacagaagcaacacccaagtcggtgctcagattaatgggcatgaaaggcctcaccctgtaccatctaaaaagccacctccaggtttgaactcattttcatagataaaacattccatatagctgctcttttattttctgttttttttcgctcagttatattaacacagtgctacttgtattgtaactagaaatatagactgggaaggcaaagcaagaaatcagcaggcctggagctagcagtagcagatagtggtggtatgtgcctaccttgaaatattactgtcatgactcatgagcagaatcaaaagtatcatgccttaaagctaagatttgtccacacttcctacctttattttatcagaatttacagcggaaggcatcagtttttctatcggagcgcctccaaggaatcctgccggaggaaacaacacggggtaactagcaattgcccttctgcttgtcctcataatgcactacaatagaatcatcatagtctattacagctacaatggtatatttgtaatgggatgtaaatcctactgaatgccttttgttatgtgatctttggggatttttaatttccttcagtggaagttctatgagtgtctgactaaccatctttagaacatttctcttgtgaagcagagaaataccgcttgcagatgcgctaaagtatcaagtcgaagtccaaagaaaactgcaagaacaacttgaggttagaccatcgacagcttttgcatcaatccatgagcttctacttgccaatgttttcttccattattgctaaaagtgcttgtctacactcaggttcaaaagaagctgcagatgcgaatagaagcccaagggaggtatttaaaggaaatactagagaaagctcagaaaaacatttccctggatgcaaatgggtctgctaacctctcatcaaccagatcacagattacagacatcaacctagctctttcaggtttcatggacaatgcaacacaagttcaggaggaaaacaatgaactgatgaaacctatatctgatgacaacctaaaagttaataatttgggctttcagctctaccatttaggaagtcaggagagtaaggatgttaagtgcactccaaaaactgaagagttgcttctactagacttgaatattcaaggaggatatgaactctcttctagaggaatgcaagggtgtgagttggatctgaagatcaaccagcagagaagatagagagttgtttcacaaacctaacagttttggaaagttgaccgttcgctattagtttattctttttccatgtgccagtgttgagcatgcttgtgttcacaagtttgttttttctgtctgctaatgttaaatttcctgaaaggaacttctgaataaatatggtattatttagttatttgaagcttcaattgtatatacgagtgaagtgtgcaaaatgagggaacatccaacacagatgtgtatattctatccaagtatcctataaattgatgttttacttttgttcttattatcctataaactgatgttttgtttttgttcttatcaaagcaagcattattaactggtcaaacatgccatccataggtgtattgacttattgaactttgaccttttttttctgtgatcaaacctttggccacaccttatctattcaactattaattattgcaatatgtgcagtaccgggttagcatactaacgctattttttttttagttcagaacacaaatcagatccttagcatatccctcatgtagcttgaccagaactttatattcagccttagcaacaccacaaaaaaatactgataagctgctttcgcaaaactaactagaaacaaaacaaaactattgttacccaactgcataaatgggacaagtaacttttatatcttgtcaattaaccaactgaataatgtttagaaaactaacatcatcttaaagagcatgggaaacagaagattctaataaaactagactaacctagttggatccaatattcataccaatcatgcttgatggccaggattccaacaaatcactttccccatttcgagaggatcaagcatccaaaaattgtgaagcataccgcagccacggagccaaccacgagtgcaaaagcatacatctggcttggaaggttaagtttctcttgaatacccttcaaccctttgtcgatcgccggtgccaaagcagctgcaccagcaactcggaatggcctagtaacattgttaccggtccacattaggataactatctgccacatcagaaaacagatgaaggtcagtctgaggagcctggcagttttgcattttgttttagaattttctcgcaattttgccttgcaacaaagttgcagcactctaaagaactgcgagcaatgtgcagatgagcaatcatttttttttggggtaaatttaaagcaaagccatggaatccatacccccagcaaggccttgagattggccgccgggttcttgccggtgctcttctcgtagccgaggaaggccagcacgaagaacgtcgtgtaggtgacggcgtcgaacagcccgtaggccagcacggcggccaggccgagcttggccaccttggccctcatctccgcgctctccgcctacacgcatccacgcagccaaaaaagaagtccatcaaaatcaaccaaataacgctcaatcccattgattcgacgggtacaaactcaccatccacctggtccagaacccgcccttcggctgcggctccggctcatcctgcaaatcgagcagaaatttgacgagagcttaggtaaggatgggatcccagtcattcagaacctcacagagttcagagttcagagttcagatgtggttgggtaagtgatgagacggtgagagacacctgagggtcgggatgcgggtttgcggcggcggaggcgcgggggatataagcgagcctgctccctgcggtggccgcgctcacggggagcgggcacagtggtgagcggcaccagcggcgcggcggcggcggcgctgggtttccgagcgggtagagggtgaccgcgggacgctgcaggtgtagggtgtacatgtcggcgaaggagaaggcggcggattgggaccggtgagatcgatcgactccatctctgtacgccgtccgcgtcacaacaggcaatttggaagaagacaaacaagatagcatccagcatctaggcaagctgaaatgggaagttggagagaaaattgcatatctaccatcccataagaatggcttcgctagaataccattatgaaaacgggcttcgctggaataccatcctcaaccagagtgtcttcgccaaaatgccatcctggacggaaatgcccctggctcttcttcttcctccatcccgcgcgtgaagagctcgccggcggccatggccatctccaccgccgcgccgatgctgccttgccgacggcgattggggcgctgccctcccctgccatccccacctgcgcctgtgcagctgaggtcg

SEQ ID NO: 19423 - DNA, 58704 bp, Oryza sativa
gtgccagccgccaccgcgccgccctacgccggagcccgcgtctgacgccgtagaccgcgctagccgcaccacgccgccctccgccggagcccgtggccgccgccgtcgaccgcgcctgccgccaccgcgcagccctccgccggagcccgtggcgagctagccatggcaggagggagctagccatggccgccggcgagctcttcacgcgcgagatggaggaagaagaagagccaggggcatttctgtccgggatggcattttggcgaagacactctggttgaggaaggtattccagcgaagcccgttttcataatggtattctagcgaagccattcttatgggatggtagatatgcaattttctcgaagttggaacattaccaccagaattgtgacagacatcaaatggacaaaactatgctctgacctgctttaacaaaagaatggtatgtagtatatataactcagctgccaatagttcaacgaaagaaattcaggtgtcattacatccaagaatttagaaagacacttgccacacataagataggggatggaatatatgtacatgaagcagtgcggcgtacgaaaaacaggcccaattcagatagagttggttcaaaaaatctcctagatttgtacttcaaacaaggagactccttatttttcagtacttagtagttactagtagcaattaccaaatccgatacagctaaagagctctcatttgctttccctgaaaaacgaagtatactcatttgatttgattattagtgatgcaaatcctcggcagtagacaaacatcctcagtgatatccgatcggcgcaggggtctgcttcagctccatgccctggtaatggatgtcctgcacatcacaagccagaccagatcacacgtcagaaccaattcaacatacatccccaaaaggcgagatcaaagagcaagatcgctgatcatgcatgcgtaccgatgcgaagtgattgacgtcgcggtggtgagcctcgtcggcgcgcacgacggtgacgacgtccttgagcgtggcgttggcggggaggcgccagtagtcgatggcgatggccggggcagggacgttgtcgatcttgccggcctcgaggtccttgaggaactcggtgtacgagtggatggcctcctcctcgaggtagccgacgacgcggtgcgcgaacttgggggagaggaggtaacccaggaagtaggcgttgaagaagacgccctggacggtgatgacgagggcgcgctcgtaccactttgggttcgccacctccatgaaggtcatcaggtgcatgcgctcgttctcggcctcttccagcagcgtgcggatccagccgccgctctgctcgaagcgccggagggaccggaggtggagcagcatgccgcccaccatccccggcaccgccgccaccgtctccagcatcatcgcgcggcagccatacctcctctgcacccaacccaatttgcagtgttaaccattgacagttacagcaattagcgaccgactagagatcatttccacatactactagaaatggatatcatgtaatataattgttcttccaaattagtcataagacattagaatcatatatagattaatttgcactaggaaacaattggatcaccagtcattgtagtgcaaacagtaataagcctatgattgatttaatgggcaagagattaacaaatcaaagttgagtccttctcacaatgcgtgtccttttcttagccgttgttatcagatagtatagcggaaaataaaaggacagggattttctacacctaagtgctatgacacccatcatttgcatgcgactcaaatagttatagaaaaaattgaaaaaaaaattagtaacatcgattgtgatgatataagtctatacacaaacatgcatgactaaatttgatctataactagagaaacaaaaataataaaatcagacagtgaatagtacccgaagagcgcatataaaatttattatttttgtttcttcatatgttgatcgaatttagacttacatgtttgtataatgtttgtaaatttttttataacggtttaaattgcatgcatacacataggtgccatgttacctaggtgtagaaaatactttccgaaaataaaatcaatcacacaggtggatcaggtagaacccaggcgtcctaaatacaaatggcatcttcccggaagcaaggaaaccaaaattctcaagtgccctggttgcaatgctactttgcctcttatgacacgccaagagtcacgcggcctctcagtttttcccttcgaaaaaaacgttgaactaaacacacagcgctaatcacccggagaatcaaacggccgtcgggcggtgcatggtgatcgagtaagcacaattatacctggaagaagatatcagtggggaagcgcagcgacttgacggtccagtaggcgatcttgtcgagcagcgtcttgggcacgtggtgcttcgtcagatcgatcgaagtgtccgcggtgtaggtctcccatggctgcggagaaaatcaaaccaaaattacacacggcggcgcgacaagttaaggaccgagcctactatctcggagtatggatacatcgatctggcgatcaatctacgggacaaacagaatcgaaacaggaaaccgatcaggagcaaagcgaagcgcaagtaccctaaagcaagaccacttccactccgtgccgtcctcccgcaccagcttcttcgactgctcgatgccccagtagctgttgaccaccacctccttctccgcgtccgccttcttggcctccgccttggccgccgcctccgtcgacgccacggacgacgtggacatcagccgcaacccccacaccccggggacggcttctccgcctgcaaggaacggcctcgccgccgccgccgccgccgccgccggagaggtcgccgacgcggtgaagaggcggacgccgccgacgtgacggaggatcgccgatccggccatccgggagctcatcgccgccgttgatgtaccccgaaacgcacggcttgacaacaccaaaaagtttgggaggaattcttagaggcgcctttttgttgacgagatggttgcgatttgcaaatggagagggtttttttgggagggttttatatagggaggaagagcgaaaggagaggaaccggtggtggggccacaccgtcagtgacgggggagatgggctttcctcgggctttcccgactctgaggaaatcttttcttcttctccaagttgatcggttagtagtactgtagcagtactactaattcttgtgattttttttttcaaactgcctgtgactaataataaaaggttcacatgtgttttatcgccaaattaaagtatgtgatgtgtcgttggtacacgcatcacatgttgattgagttttttttttcttaggatggtactactgcctaatatcaaaagaggctaatataacaaagtgcacaaagtcaatgtaaaaaaatgcgtcacttgtacaggtggagtacaagtgtacgtactacaagtagaatattccgtttagaaccatttcacaccaaggatagtaatgcgcaagcaatttgcaagtgcccggtagtacaaggaaaacggaacgtacaacaaagccaaagccaaactggaaacgaatcctgattctgttgcttgtcttgtggaccaagaaagactccaaccatccaggatggcagtcaaattaggcaacttctattattagatccttaatctaaccactgacaattccagaacgtgactaaacagctctattgctaattgcgactagtatacgcagctagaaacatctgggatgttgcttttggaaagtgcctccatggcggtgtacgtacgtgcttgccacatgaaccacaatctgaataagcaaacgtgtcaatggtgttatcgctcatgacaactcagtaagtgtttatacgcccgtaatatataacgcacacaagggaaataacaatccagtgcttgtatgcgcataatggacacaaaaggaaatatcaagcgtagcgtgggcgtggattctaaggggacatcccctcgtcggtttaagttctaagtttaacacgggagctcaaatttatttttcagtgataggtgataacatttcacagcgaggtgcctatatggtatctatatggtatataccggtccagtcttcgtctgccaataataatgaatactaaaagaaaagggattaaatgtaacacaccaactttttattactgaagtggagagggaatattgggatgaataaaaaataatcgacatttaaaattatatcaacttatggcacctccttaattaaaaaatgtaaaatggcttaaagaaattatttttctacacttacttccataaaaaaaatcctgactgatttttcaagttaggagttgatttttctaagacagatggtgaattgcaggtgagccattgtgtttgtgcttctttggtgatttttttctgagggcatattgaaatcaagagtccagaaaaagaaaaaagtttagtgtgaatggtatttgaacttgtctaaaagagattccatttgcctttacacatttggactggatgtttggtcttggttgtgtgcacgggtcagccaacggccatgcttcctttgttagcagcagagcatcttgacaagtgttacctgctgcaattctgaacacgtggatacttctactccaaaaaaaatcttactatattgttattcacaatttgcataatctcagcatgcatataggtacaggcataaaacggagtgacaatagcttatttacatatatacacagaacaaagtttatcccaaataggatgtaaaatacgcatgtagtagcagtgatggtgatgaactgagcaggcatcgcccgttgatgaatgatgatcagtgatacccgataggcgcaggcgtatccttcagcttcatcccctgttgctggatgtcctgcacaagtgatgtaccaacacgagaaacgcgatcggttagctcaaacccgttcacacaaaaattaagcaggcgagattggttgttttcaggctggcatatgcgtaccgatgcgaaatggttgaggtcgcggtggtgcgcctcgtcggcgcggatgacggtgacgacgtccttgagcgtggcgtcggcggggaggcgccagtagtcgatggcgatggccggcgccggcgtgttctcgatcttgccggcctcgaggtccttgaggtactcggtgtacgagctcacggcctcctcctcgaggtagccgacgaagcggtgcgcgaacttgggggagacgaggtagccgacgaagtaggcgttgaagaagacgccctgcgcggcgagcacgagggcgcgctcccaccaccgtggctgcatcacctccaggaaggtcatcaggtgcatccgctcgttctcggcctcctccagcagcgcgcggatccagccgccgctctgctcgaagcggcggagggagcgcaggtggagcagcatgccgcccaccatcccgggcaccccggccaccgtctccagcagcagcgcgtggctcgcgtgccgccgctggaagaagaggtccctgggcaccgccagcgacctcaccgtccagtacgccagcttgtccgggaggcccttcggctcgtggtgcttcgtcacgtcgatcgacgtgtccgacgtgtacgtgtcccatggctgtgtcacaatgcaaaagaaacacacatcatgaacacgatcaaatcgagaattcaccgtgcaaaaaaacaaaaaaagaagcgcacacatcaatggttgatgagcgcttaccctaaaactgagccacttccattccgtgccgtcctccttcacgagcttcggcggctggatgccccagtagctcacgacggccttcttgttctgcgggtcggtcgccgccgccgccgccgttgccgccggctccggcagcttctcggctgcgccttctttgacgtccgcgccggcgctgctggtgctggccatccgcgcggggaaaatcctcgcggcggcgggcatgacgcccctggcgctcgcggcgagcccggagtacacaggctcggcggcgaacaggcgggggcccaggtggcgcagcagcgtcgctccggccattcgggagctcatctcggtgactaaactaaactaatcacgacaacaacaaaggcttgacttccgtgtgatgattctcagagcgccaaaaaggcttgagaaaagttaccggaaatgagaattctttgtggttggcttgtgttgctgtgataggtggtgtggcgggtcgatgtgattagcgggtgcgttttatagtggagcatcccgcgccggcgcgttgcttcctggacagagcagggcggctatagttcgatttgcgttgtagaagtaactggtcttcgtcgtcttcccggggagttcgcgagggatcgggagagcaggtcggcctcaggtgatgcactgatgccgtgatgaggattacggttgacctgacctttcaacgggatgtcgtttcttggtttgccgctgaaggattctgctgcgcgatggtggcacgggtgagtgacaacatggcaacgaaagaatcctgcacgtcggtttccttgaagtttggcgaccggtgctagtcaaccggcgaagatggactgacatttcgccgtggctggaaaggagaaaatgtgaacatctagtaaaccagaagatcacttgcatgcgcagcaccggtcctggaaagttcgacccgatatcaaaagggaaggaggatagcagggagaagctgcagcccgcaggcgttgagtccgtcagaaatcaaagagttcctgcggagactagtttccgctccaaaattatttttctataattttttcatgaacgcgaaaaagattatacgtcaatatattactcaatgtaattagctagaccaacttataccaaggagagaaaaaaaacaaccaaggaagaaaaatataactcgtacgacaggtaacgctactccaatcagcgggagagggcaaagccacgctacactttcaacaaatccctaaaggaagcaatgcctgctaacgaccacaaccgatcctccgaaaggatggattatttttcttctataaagaaagcccattctgaaaatagtacgtgtagtaagcgttgttttcctaagaaaaaatcatgataaacacaaaatactatataatttttagaaaccatctaaatgtccatgctcgctacagataaaataatgtattaatgtactttcactttttgctatagagaatattcatcctacttttattttttttaggagctacccatttagattcgatctttttaatattaaaaagttcaggagttaacttgcaaaaatttcaatgcagtaggtgaagtagcaaattcactattaccatcactactttatttctaatttcttttcttttaaagggatatagatttactaggccgtcaattcggcgtattaaactatgataaattttagctaaaaattgtattcttccatattttttcggtcgacggagtactattgcataaaaggtgttacaccatacttttaattgaagatagtcctaaatttcgagcaagtctagaagaacaaggtattataggtgcagttagttcaactattacctgtgcatcgataagagcaagattaatagtatagccaactactagctccaattcatctatagtcaatctaataactcatttatacaatagttacatactatactattaatacatggtcccacctgtcatatacacactgcgtcttagagtccgtactacagctgactacaaatatgtagcccgctgctcttctctccttatttatctccttaaaatatgtttacagctggcttatagcctgctattgtacctgctctaactaatttcaatgcagataattgttccatttaaactcaggattacatgatgatgattaacccagtaaagtgtggaaagtttttagaatattagctgaaaaaaatatctaagtggaacaatcaatcccgcttgtaaactaccagtatatgaactggatagaggttacaacttactagccattgcttctccacaaaaaggattcgacggctcaaaggacttttaagttttaagcccaaaaagggacctcatactccgcaacacgcggcatggttaaggcagcagcatttctggctgcacacatgtaaataaagaaaattttcttccctcaaggaccagaatcggctgatatcatatacagtgccgcaagcgtctatagtttacaagaatctctccatgatttcataatctaacagaagttctttcaatccaatcattttgctgtactgcaaagtaatccagccaacaacggatacatatgctacaagaaggcaggcacgcttaagccgacaggcaaacactctgatgctatgcttgcttacactggacccaacaactgcaaggactagtcctcggagacttctgagtaagatagtgatgagtaaggcactcaaaataccagccacaacccctgccattacgtatccaagcattccaatggaattgaaatcctccaacatataggacttcgataaccttcataatccgacatattggagatacaatgagcatcagaagaacaaaaacattgtaaataaataatgcagatatgcaagcaaattatgtgtctgaaaaggaagatatttagttccaacttccaagtattcaccattctgcagtctgcagattaagcagatctgggttatcatcatctgatggagctaatgttgataaaacaacatgcaatgttgatgcagtccatatatgggaatgaagcgaatatacgtacaatacaaatatcctcttgagcatctcaattgttgaaggttcttcgctggtgcaattgaacagcctatctgaataaatatcagccttgctacttcccaatgtgtatctgcaactatacgattcatttacctacatgaaaaaatggtgatgaaaaggaaatgtcgaaaaggaactagtgcctccaactaaacatgaaatgagtaaaaggcatgaatattcctaaagatccccaaaaccacgaggaaattttaactacaaaagcatcggtaaatattacatctagcagagaacaagatgctaagtagtacactaccttgaacttcaatgttgttgaccatgcaacaccaaagtcaggccggcaattcagcggaagagcctcctttggggcctctgccaccgcataagatgtctgaccagaaaaatattctgtgtattcaacctacagcaacataaaagcagaacaaattgaataaataaaaatatctattaaaatatgtaataaataattgaaaaggtgataaaaaaatattgatactaagctaaacgatggacagacagtaataagcaggctgtgcaacgctgcaagtcgatgcaaatctaaggaagttgtctttgcaaattaatttatgcataaactactaagaactagaaaaaagctataactgtttgtcaataactgggagttgagctattacctataatttgtaagcatcagttaaaaacatataaagttaaatctagaggcattgaacatgatatcagcctcattagtcatactagtaacagttaacgttagactctaaagcattgttgtgcaagcagagtggcagaaaagcagcaggcaaatgaaacatttcatcaatcaagtgcttatagatatgccaatgacaaagtaaattatatttttttaaaaaaaataacaccacaatttctcacctcaaagactgaagcccaatagtagtcatcatggcatcgaaattttctattactcgaggggtaaaatacatgcttagctctatagttcaacagtccgagctcacaaacttttgatgacctaagatcaacacctgaaatgtgccgacaatcacatcaaagctagatcagtccacacatattcaactcaagttggtctagacagaaaaaaagataatccataaacattagtattcaagaacactaactccagtatactagaaaccaatagccaatgaacactctacaatagtacaactaagtttctagaatagtaagtcagcaacatgtcacaataactattacatttgtaagaagcatgctaaaatgtacatcacagaacggaatggagcttagattcgcattaaactcttctctcatacagcctagatagcttatcctcgtcataattcaagaactgtgctgtccgtgcacaaatcagttagctctagaactgtaacgatagaactaaatcaggaaaggactgaagagacaggaacggccactgaccggtggaaaggatccggcaggtggaaggcatggagacggacgcggtggaggagagaccaccaaggacgagacccgcgagcccgacgacgaaggagaagaggaatgacgccgcgaagggggcggccaccccgagggcgccgcggaccgcggcccccggccgccgccgtctcggctccgccccttcggccgcggcgacctgtggcgcgggctcttcctgcgagggatccatcacgtggacggccgatccatcggtcgaggggccggcaagcggcggggtcgccggactccggcgatggggaaggtagtgcacgtggagtcgggtcggactcggagggtgggtgggtggaattgggcgcaagcggttgtggtttttcttgggctaagacaatttgggccgctcgtgtggccgtgtagagaccttcagcgcagtaaactagtacaaattttaccgacgtggcgtttattagtgtggcccatgtacggcccacaggaatttatttttgtgtggaggattgtacagcttgtttggcaacttggactaaggagatcgggaggttataggagagaattgttagtgagatttaatatgaaaatttgatttttaatcccgctattttgttggtagatgtagtggaaaatgataaggagtccaaatgaagatcagatttaaatgaaaacgaatgactgacattatgacatttgtttagacaacgtaaaagagaattcctctcagatttcatagctgagtataaaggaacggagggagaaatccggtaaaggatttgacaagcttacgaataaattgaaccaacgaatatgaagatttgcgttacaagaaaaatttaagcagcaaccaggtgagaacacatcaccacgttatatatgttgtctacacaaagagggacacagcatcaaagatacatttcactcctatccctaccaactttcactattttgttttaccttgcactgtaacaaggataaccgatcagcaactaacagcggtatcacctctccctaatctatctccctttttctcttgatctgctcgactcatgcatagatgcatgccttgttacagatactgtgcttgtattctgtctctgttgtgctcccaccaaaccttcgccctgtcctcaccaaacctctcgcggctgcagaagcagagaatcaattgagtacgattaagcatggatcaatcagaaagtagtccctaggcgagtatatacatgaaattctggttagatttgaaagatttgtgttggtgacatggtaaacctaagatgttttggctatccgtgcgtgattagtgtatacctgaaccggatgcggcggagctcgcgggtgccgtcgccgagctcgcggatagtgaggcagacgcccggctcgtcctgctcgatccactcggtcgcctccatgtcgctcgcgttgctgatggacacggaggcctcgtcgcgggacgaggtggtcccccgcgacgggtcgtacaacgatgggacgccgccgcccgccgcggacgggccggccgcagcggagttgagcatgttgaagtggtgcgcccacacgtggtcggacgggtcgggcactgccaccgatgggtagcacgccgctcttgtggaagccgccgccgcggcgtaattagacgccgaagccgccatcgccttgcacgacatgctccttgcgatcggctctttggccagcgacgacgacgtcgccggcgtcacgaccggactctcccgggtcgatccgcccctggagcagaacgatgattctctctgcattcatgcacggtccagatttttcagtgagttgcattattgatcatgcagatgaaaacaacgtgatgatttcgaagtagcatagaatgcccgtgaaatctttgaagggcgtagtaccgaccagaatagagtcgtcgacggaggacgtgggagtggacacgccttgctgccggccgctgaacgtctgcacgttgtacagctcgacgatgcggtcgtagttctcgccccaccaacgctgcgcctcccacttgttaaaaatctctcggctacacacaccaatacgcacgtgcgtgagagttaactctggacaaatcgctcgcacacaatacgtgcagagaatacaatcaaccgtggaaatggagcagatatgatcagtgtcagaacctgaaccggatgcgcttgaggtcgttgccaccgccggggagcgtgacgaaggtgatctggacgccgggctccacctgcgccgtccactccctcggcacggcatcctccacgacggtgacgtcgtcggcgccggcctcctcctcgatgctctgtatccacgtcgtgccgccggggctcctgccggcatcctgctgccaccctcggttgctcttgctcctggtcatgtcccatgtcgccatcgacgtcgacgcggcccggacgggcggcggcggcgccgctctcgtgtacatgtaggcctcacctccaggcctggtcgtcgtcatgaacgcggagtcatcgatgaagcccgggtacggacggcggtagctcctgctcctgaacgaagggctaccggccgtcgccgccttgtagtgctgatgcttgttggagccggagaacttgagcaccatgtccttgagctggagacaacacattgcatcgtaggagcctagttagctaccactcagtcacgcgagagtcacttcgcgagtgttatgtgcatcagctctcactggaattactggcataagtagctatcacatcgtataatatctgtgatacatttacatgtgtcaatacttagcttgcttggatcaaaagtaaatagttttttaatcatgaacatccataaacatgtgtatccatatgtgtgacctttaaattagggaagagtaccgagaatgatgcctgctgaccgatgacctcatatgacaaacaggtttaaatcaaaagtggccactggctgctagctaggtcacaaaaaaaaaaaaactagtagtaacacacaaatatacttggtacaaattaaggaccacactaactggctagtgacactgcacacgacacaggagggaaatctttacccttttgtctgaatcaaggaaccgtggcatgcatgcctcatggctgcatatctatcgcagcctaagctcaaagcaacatagtaaccggtgcgggcgataatgacagctcgtcgcgcgcaaaggcgcgcgcggcccggccgctcgctggctcgctcgatcgcagcacatgcagcatgacccctccaccgcatggatggcatgcatgcacgcatgatgcgttgcgtgcgccgtgcgcgctcgcttaaaaagacacgagacgcgagcccgcagatgcaagacgcgagccatacgcgagacgagccgcgcgcgcgtttgcgtggcccgcggccggcggccggcaggtgcaggggcccaggctgggcctaattaatccgtgagtgtatagctcgcgtcgcgtgccaatgcaccgtggcccgattcgtatccggctttattccatctccattgcagcaagcaaggcagatcctagttttagactttgtgttttgttcgtggctaactttggcatattcctaaccttaggtaaggcatatggtcaacagaatactgacgacaccaatgaccaaggtagataaggaatcaaatattttgatgttggactatgcggttggaaatataatctgacacaacgaacgaaccaaagaccacctaagaaactagggcggagataaatctaggacaattacggcctgaacctttggtttttgtctccttattaatcctttgtaaatccattcaaatatcatgagaattttgaagatcgaacagttatattggttaaaattcttggctccttctctgtaagaaacaacggcatgcttaagggcttgtttcatattgatgccatttcaaatcgtatcttttttctataaagctgtcaaatatatatatccatttagtttcttactaaactctgataaataaataagaaatcttgccaaaggcaatattgtcaacttgctaaaattttagcgatgctaaaatttagtaccacctccgttttttaatagatgacgccattaactttttcttacatgtttgaccattcgtcttattcaaaaaaattacgtaattataatttattttgttatgagttgttttatcactcatattactttaaatttgatttatatcttatatatttgcataaaatttttgaataagacgaatagtcaaacatgtgagaaaaaatcaacggcgtcatctattaaaaaacagaggtagtaagatttatttgattacaatctgaataggccttgagacgtgccaacccaagacatgtattcaaccaaacacccccttagaaacaccaccaaagcatgcctttctacaagggaaaaagggtggacaccagccaaccatcaggcaggcagccacaggggcactttgtatctaccttatgggcatctctttagggcaaagggaatgaacgaatgagaaaagaaggggaatgtgtgtgcatagcatgggaacaaaatcaagccacgatgtggttggcaaagtggcaaactgtccaaagtttaggagtggtggcgcccggccggccggctgggatggggatccaagcagcaaagacattaaagtggccttaattctttctcccaccacatctactcatcctcccttgaccagctttgtcgaggaatgtcgccagaatttatcgacgttgagtgctaaagggaggcgattgaaccactgtcattcacatcgtacttttgggcatggctcaacatcaacatttcctagctactgtagtcagcagttgtatcactgttgtaaagttggacgacgtaggtataggtttttcagagaaaacacatagtcttagctagggacatcatgctgatctctgctcgttgatttgtactacctctgacaacataccaaactagtttaattgcctatgatcagtactaaaaatggcttttcttaaaacgtaaaatgtcataaagttgcatacttgtatatgcagaaatgaacaatatcaatccattgtaacttgtgagaaggtacggctagaaattaaaagcattttggagtatgtttgcataggacgatcgagagttagatgacctgagtataggtactcaattgattgcgtctgtgtctgcattgcgtggggcggcggaactagtaatcctatgattccgtaaaggggctaagggccaaaataaatggcagtcatggctacagaaacttgctcgtttaatagtacctagtacgtacacggccaccgtaccaggaaatggcgacggacgctttgctagtagtttgtctctatcacacgcacattacttcgtcagttttcaaccaccgtgactttggactctttgccaacgtacaccggctgatcgatctgcgggtgacctaaccaatcggacgaacgaattcaattcagttgcaaggttgcaacacagcgcatacggtcccagatcggccatgcttgggcaattcctgggcattgctggtaagtagagtactgtactctctctctctctctctctctcttttttgtgacatgggtaagcagagacagagcactagtggtatactactgtacagtctcagtggtcgtccatcttggctgccacccctggtctccccctcgtctattaactgctgctactactatctcttcctcatacagacagagctagtagcatgtagtagtacactctatatactgcagtactgatggcaaagtagcaggtgtaaattcgatccaggagtagcatgtacgagaagaagtttagatcaagacgaagaagaagaagggacagacgggtacctgtgaggtgagggacttgacggcatctctgccgtgaggcgtggccgcgccacgggacccgtcctccccgccttccttggaggagcacgcgatgcatgccagcatcttctctgaccccctctccctatctgcctccctctcctcgatcgacgacgacgagacggatcaatcagtagtcaatcgctccccccacaatctcaccttgtgtatcgaactgcaaaagtgtgtgcattagcgttacatatatagtactaccacagtacggctatctatcagaattgaagccgctgtaacgaaagatcaagtttgatcagacatgccgtcatgtagacactacagcccacggctacagttgcatgcatgcatgtgatagaatgtctatccatgagatggtcaaactttgtcgttgttcgcatggcaatagtacacttagtacatgtatagtacacatttccatgataattaaacgagtgcgagatttcgtgtatccacgcacacgtatgtacgaccaaaataaatacacgccgaaagtacgtactcctatcaagtatcaacagtgacactatcagtctagtatcctctagccatagccacaatctacaatgtactgtaataacgtaaagcggtttccaagccggtgtgtgacgccattctagtaccacacaccatttggaccagacgtgccatgccatccttgcatctcacatgtaagcacgcgaacacgacatccggtacactatgcgagcacagagctatccggccggtccgtgaccacgcacacgtgcgcatgcgtgtgcgtcggaggagctgtccttccggctcgttgagcaacagagagcaatgcaagcatgcgtatgtacgagagatagctatagctagggactctggtctctggagcttcaattcgccaccggcgtcaaaacggggcaagctggctggctagctggtgcagtggagcactggagcctgcagcgacaaaaaagtatagcaccagcataacaaagcaagcaagacccatgccaatggcagcatcacagtcgttcacagctactcctgcatgcatggcatgcattcgcaggctgctctaacacagtggaagaaacgctacgcggggcaaagcagatcgatcgacgggcacaggcacagagattctttaatcgccatgccacatgacacacacacatatactactagtaaatcaaaactgaaaagcaggttgtagtagtaaaatacggtcagctacattgcggcagggaagcttctgatgtttacgcgcacatggaaatttattaaccaccagtgtgctatggctagctagctccgcccgtttgtgtatgtgttgtgcacagtgttcatgcagatgaggcgcagctacccacgcgaggtaggcaggggcgtatggggaagactccaaacgacaccaacagcagtagctcggtggacgaggcagggagccgctcagatgtgtatcagctacagtcactgcagctggggccccacgccctcccccagatcaacgtactgcctggactttattttttttttcctcctgctccatccctaccgagaaaaatatgggccccggctaaagcgaccggctatcgagtgactgcattgtggagcccggtagggtttttgctgattatcttttgcgcttttttaatagaaacacgacgtgataaccttaaacacggtattgtgtgtgttttcttttggccggtggtagtaatttcttttgtacagtagtagtatcagctagtaattaattaatgttgctgtagagggagagagaaatgagaggcacagtgagagtgatgagatgatgcttacaggtaactgacggcccccagatagctacgttagccacagctctctctctcctccgagtttgctcgccgtgtaaacagtgtgcgtacccaaaccacctacgcgcgcgctgaccgggttgctccgcctcctcttcctctctctccggcgcctgaaatgatgcagacaaaaatgtgccaaaataaatatgtatacgcctagaagcgagagcgggatgcaaggagaaacggccttttatttttgacaccaagataaacggactttgactttctggtgaacagaacagggtaagaaacggcatgcaagacgagaaaacaaaacatagaaaaagtgtaactcaacacacacacacacaaaaaaaaagcaaagcaaagataagacgaagcatcaagcaagctggttgcgtgcgtcgccgtcaccaccattaccttctcctccacgtcgccggtgagcgaacgagcgcaatttgcagcccgccggtcggcttcaccttcgccgccctttcggtttcgagctctgcctctgaatcgactcagaagcctttggagatagcacagagagaaaggcctcccttgtctggtcgaggagtggatgcggctgcgtcaatggcgccaaacacagcggcggcaaagatatcagaagctacgcagcgacgctgtcgccgcacagaaacaatctgggactgagtgggagattcctctcgcagtcgcaggagagaagagccacgaagcgagagagagagatcgaggtggggagggagagaacactgcgggcgtcgcgctgggccgtcggatccttcccccatatacgacgagagggcgccgagtgcacaggcagtgcaagccgtctcgtttccggcccatatatagtccctcccccacgggacacgcggcggtccccgcgagatcgcggccgtccgatcctgcgcggcgtgtggtcatctccctggtcctgggctgggccccacctacggtgattcgctgcggggcccgcgaaggcccgggccccggcacggaccgtggcgatgacgaacgtgctgccgtggcgcgatcaggaccgtgcgatgtgatgcatatgctgacggggctttgtcatgatcgaggaccgtccgatcttgatggcgcaaagtacgtcagcgtgtgcttgcaagcccaataggcgagtagcccatagcgactgacggagcgtggggctcctcaccgggagaccgcgctggtccccttttgccggttcggccggggaccctgggtgagactctaagctcccaatttgtggaaggttcgcgagacaggaaacacacaagacgccggcgatgtatacaggttcgggccgctgagaagcgtaataccctactcctgtgttttggaggatctgtgtatgaaggagctacaaagtatgagccagcctctctcttgttctgggttcccaatctggaaaagtccaatcatcccccctctaagtgggcaaggtcctccttttatatcttaaggggataccacatgcaccatctccccctctctttcttccaatttgacttctcttcattaacagacggagatttgcatcgccgccgtccgaatgaccttctgatgggacggcccatacctacctccacttccgccggaggcaggcgcgacgtgggaagatggctgtctgctgatgacttgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccagctagggacgagtgcttggaggctctcgtcctgacgggatggggcgaggcgtgcgtcagaccgcctgtcgccacctaacccatgatctgaccggtctgtgactggtcacagaccggataaacgagcgtgctgtactgcgatacaggcggcgtgacgcgctcgtcaaaactgcaataaatgtggttaggtgagccccgccatgctcacctaccccatatacgtggcgcaaaacccacaaggggtcggggcgcttcggccctcggggccgagacgggagcggtccgaccccttggggagacaaagagaagggcagccgtatcaccctcgggcccgacccccccccccccccgagggagttaggccacgtgggtgatcgtgtctgcctcaagtctctaagtcatgatactcccggtaaagaggagggcgaacacatcaccctcgggcccgacgccccctgacggtgccaggtcacgtgggcgattgtgtctgcctcaagcctctagtcatgatactcccggtcccatgtcaccgacagcgacgatgagagagacaatcagagcgacaagtagacaatgccataggctattagtattaggttcacatcaattaataaaccgtacaaattactatagggattaagatcacgagcgtctaaaatgaacctctcaaatgacggattcttcgattaattgcggtggtggaaagccaacgacgattaataggagagcaaaaacatcgccgtccgagaggaaatatacaaatcaacatcacgaaatgtataggtaggtgggaggttggagcagtcaatttttgctggagacagtcacggacatgtgtcatgtgtggataaattttgagattcagacttgtacatttttagataagttcagtttgaattttattagctcctgtaaatatcatttgcaaatatttattatgcagattcatagactatagttgtacaaaaacatggcgacgtgaaaaggatatgagaatttctatattaaaaaacagtatagtagtatatcatacgagtactatacgatcaggttctgtaatcttttagtaggagtactagcactggcacgcatccgagctatgcgcaggcgcgcagccgactagtcctatctccgttcgaaaccattgtgcatctgatgaaaacagttactcagattcccggttaaatgcatgagcctattccatctatctaccgtcctgtacctacacatgcgcttcttctgaacaatttttaaaccagcctccgctgttcactgcttcacgaggcaaatactatagtatttggatgcttcttttctcagcttctgtacgtacggcggcacagaccaccctgcaatcatacatggctgtgcacagcagccaagcgcaccggctagtgtgcttgaccgaaccaaaagagagatcaaaggatatcgaaatgaaatcataaaatactccaaaaatggcgtttctgcctttttcccgttcaaagttcaaacaggagacggggagaaaacggtggcgtttctaccgattgatttgcggctcgttctgattctaatcttatctcgatctgacgatctgcatagtttcttgagaaagcatgaatacggaaagctagctagcagcatagttgctaacgttatgacagagcgaaagcgaaagaggaaaaagcggcaacgtgatcgagtgatcgatcggtacttaatttcttgagatcgatggcaaacgaactaaattaaaggagtttacattagtgtgtggattgattttgagactcgtagtacaactcatctgaagttgccctctctttcggttcgccaagcgtcgcgacggaaagcgtgcggagtgcaagatcgatggcgagggcgagagccccccctcccccccccccccaaaagccccaaccacgcacatctggcaatgtggttttgtgatcccaatgagcatcacatcgcgcagcggcgcaggcgaaagcagattccaccgccagaacgtcgtcgacgaggacgagtgcaactctctcgttctccccgcgccgcgagacggaacggaagcaacgcgcatttgcccgtcccgcattttgatgccgcgcgcattgctggcttgccggccgggcacccaccagcggcgcgcgtcccggcgtcagcgcggtggcgtcgcggtcaaagtggcaaatcaggcacgtcagtgccggtacggggcgcgcagccttagactgatcagcccggccagccagcctcgggcggatcggggaggccttttttttgttcccgtcgagttctctgattctttcgcgttttctcgatcgatctcgcctgcgacgacgacgacgacgggcaaggcgactttggcaatttggcatggatcgtgtcgggcgagcgaagccagccagccagccggccgcccggccaggttcgcagaacgcataggagtaagactacgacgatgatccagtcgggatcgagccagtgatccacctgctgcgccgctgcatgcgtgcatgcgcaaggtcgcaacttttcatggcttaggggcctatcgctagctcactgtgcccgcgactgtggctcgtttgtccccctcggccccaaacgttaattcaaattttttagtactaactgggagttttttggggcagtttgcgagaaacctagagatcattactgtggaagccacgcgttcgagctcgagacaaaagcctaaaccagagagtcatccagcgtccacacgtgtagagtttgccgttgtacaggacgggtactgtggtgtcgtactagctaggccactggtttttgttctctgttttcgcgctggatgcttggccaaagagaggcggaaggggtggaaaatgactagacgaccgatagagatgcgtgtttgtggagcggacaaatcgaggttttttggggtgggtaaagctagcagctggctagccagcgagcgagcaaatctttgatcaggaaaggaggtaaaggcgaggagccagccagcagcaacgcaccaagcctggcctggaggagggacgggtcatgtggtttcgcgttgccgaacgagcagcctttcggaaaaggccactcgagtccacccaaaacccatgcgacgacgagagtgactgattcgagtccaccgagcgcgcgacctggtactccccgtggcacggcccgccccgtcggagccacacgaactcctcgacgcacgacacgcgggcgcgtgaaagggatcgcgattcgccgacgtctcgtcgtcgcgccctcctcgaacgtttcgtgtctataccctcctttctctctagcttcgccgtacgcgagctcgcggcgccagtgcgcgtcacatcggtgtcgcgccattttgaggggctccggcatgaagggacgatcaatcgatcgatatcgagatagagggctagtttagttcccaaaaattttccccttcacctatcacatcgaatctttggacacatgcatggagcattaaatgtagacaaaaagaaaaaccaattgcacagtttagctataaatcgcgagacgaatcttttgagcctaattaggccatgattagccataagtgctacagtaacccacatgtgctaatgacggcttaagtagactcaaaagattcgtctcgcggtttccaggcgagttctgaaattagttttttcattcgtgtccaaaaactccttccgacatccggtcaaacgtctgatgtgacacccaaaaattttcttttccccaactaaacacagccagagatagcgagagcgatttgcgcagcattgaccgtgtcaggcaagcgaggcgcacggccccagcagcgctgcagcagcagcaaccaaaggcgttgtgcgcaccctgcgtctctcatcactccatcgcctgcgctgcgtgcttttgccatctcgctggcaaagcgaagtacgtgcgtacacacacgcgtgcgtcaaagcgagcggccaaagactcacaccgtcgcacgtaccaaaggacacgtacgtgttgcatgcatgcatgcatgcacgcgaccgtgcagcagccacacagcccgcagcatgctgcgtgcgcagcttgggcgtgtacggacgtactcgcgatcgatgggagcaatgttcaggtttgtctctgcggctcgcgatgccggcggccccgggcgtgtctcatgtgtggcaaagctgagcgcatcggccggtcggcactgccgcggcacgggcagcggcgcagcgcggggagacaggcgctagtgcggtccagagccaccacgtactccgtcctgagtccgagtactgtgctacgcgcgcggtgcccggcacgggctttggcggcgtgtttgtacgtacgctctgccaggcatgccgcagttggtgcgcagcgatggaatgcttcggttgtcatgcgcctctggtacaccgtacactggtacttgcttgatcgtctcgccgcggtttgacgggtctataagtggaaactggagacgccccatctttgaatcgtggcagaatccattacgtgcaaaagagatggccgtaagagaacaaattcaagtgctcccgtctttttgggcggtatttttcacaataagaaacaaccaatcgatagcacttgtatgcattgggagaaccggtctttgttttcgtgacttttggctagcagcaggaagcaggaggactccagtggtagcaagcagggacaaactcccacaaacgacagtccatctgcatttcagtctagaagtatgattattgaggcaagggattatgatgaataagacatcatcagtataacaaaattatccaagaaatcacttcaaagtactgcagaagaaacaaactgtcccaaaaaaaactaacatgtgacccctcctagtataacgatttggacaaaagattatccagattcattgtactagttttttttttatgatagagagagtacttttttttttttgatggagagagtactaacgaagagattgctgtcacatgaataatatctaccttttgaagttgggcaaatgttacactacacatgtagtagtaatagccaaaaaagaattgtgggagatacaccgacttcatatcatgctagcaacgctattctcaagctattttacatagtcaatacttcattcctaagaaaggacatcctcttgtcttcaaaaaacaattatcatgtggacacaacattacaaccggccccatttgcagttctgcatcatcacgatgcaaagcattcctaatgacttgcatatggagaaactgtttcaccatgattcaacgtcaggaaacatactccaaaacaaggagacaccttcaagttaactgatgtattatgttctgtaactgtatatggaagtccatggagaaacgacaacctttggaaactggtagaatgaatgggtcaacctgaacaaacaaacacaaatatatcagccaaagtcggatcattcaattagtgcaggaaaaaggagaggcacataccttggacaaagtggttaaaagaacactatgcacaaatggtacaaaagcatcaatcaattgggtgcttgtctgtttgccgggaggtgtattgggcagaaatcagaagcaaggacagaaatgcactagccacaaatatagcatcaaaccagcggtggtaaaagtcaaactggatatcaccacccaaaacatctgtaatgatcaccctgtgcaaacaggcatttaaaacatcaatgtcgacaatagaatgcttttgtgatataaattacaagtactaccaaacacaatgcacagaagattaagttgcatagctccattttcagtcaacagtcactattcattgttatcttcaaaaccttcacataaatatttgtgttttccaattcccaacagaggcagattctaaacaaaggagttatgttccataactttgtgtatacctcagcaactttaggatcatataaacgcaaatggagaataaaaaccatttatatgaacgaacatcagtttggatatagggaaagacaccctcaagcaatagagatatacctatactcatttgccaggcttttccttatgagaagaatagatgatatgaagtacattcccatgatctcagatagaaaaaggacaacattggttgttgaaccactcccaactctagaaacagcaaagaagaactgcatagaaagtgagacaccatagaattgcgttctaatgctctattaacaagggtacagtaacaactaacagctgtatgtatagataactgaaagaaataactcaccttcataacatttgccaagaaacctcgaacagatatgacaaccaacatcccgataaatatgagagatatatactgcaacaaaaagtgaacaggcaggacacatgtaagctatagaacatgaacaaagaagcaaaaaggaaaggaggtaaccaggttgcatgaaagtcaaaccaagccaattcaaagcacctcaaaattaatgtttaatctacatatggtactttatggaaagagccaaaacgcaaaggacatgccaaaaaatatctgtatacctattttatgggaattttgaaaattgcttacaacttacatagcggttccaattaacatcaaatgtacagagaactgcagttcagagtaataatgaatttattctcgattctggaattgttcaccttttaattttagcatgtgtacctgtgataaaagagtgacatcaataccaatgtcaaaatgcctcaagaagatggtaattgtcatggttactggatcaacagaacctgcctggaaaggggggaaatagtatgtaggttaacaatggaaatttccagaattaggaaaaaagaaacaagcaattggtttgagtttgacgaaggaaagaagtgattttacctctttaaagacaacactctgcaaggactgaagcaaaatcaagaaaaagaaatgtaagatactgtccacaaggttgattacaattgagtaaagaatagaacacaatctcacaaaacaaaactgtaacacttggcaaccagcatatggaagccacacaatctttttaatgacatgacgaatgaattgattaatcaactatttctgtagttctagctttgtggtcttgtcagggctacatataggtatgtggaattggtgaaatgcatggaccaaaaaaatatgccacatttagtaataccttgagcatcttataaacacaatacactgacaaagcatatcctagtagattctgagcatggcctctccaagttcgagaaaacgcagcagctatctggaaaaatgaaaagaacggtgtagaaaagtttagctcatatattcaaagaagcatcgagaaattgtgcatatagaaaactctaaagaaagaaaaaaaggagacccattactgcagtaaaatgatgtacaggatataagagtccgcataattaaaatgtatgtaaccaaaaagaaatgcaatcttattgaatgattctcccagaaattataagttctcagatatatgtcagtgccttaatgcgaaaatgaaatgaaaacatcagccaatacatcagaaatcaccataatggaaggaagttatgctaatctatagggagaaatattcacaatattcaattgtaaggtacaataaccaatgaactttagcaagtggtgtaacatttatgcggctgatccgatttgttgggatagagtaacagttctcttactatctaaccaaatcaatgttaagtagccaacaccacaataaagcaatgatggcaaccccatcacaatcatagaactaaacagcacaaggttaagaaagtagaggggtatgtcctgccaatcgttttcgttttcaatcttaacattgtgatgaaaggtgcaaaaagtatacctttgcttgacggagttcatatatctcaagaaatagttgtttggaaagttcttctagtgcctggacctctgcatccaagcttttgatatcttccaagaaacaaatagggcttcatgcatatgactgacaagtgaaatggtgtaccaaacaaaaacagaaagaaaataaatacaacataccctgctcagtttgatcttcttgcacagatcgaacaactgtcccaacgatacgctttagaaatgatctggcttttagcttctgcaagtattaaattttgtattcagtcaagccacaaagggtaaacatcaacataataatagaccattctacttccaagatgacattttgttgagttaatgtgatagtatattttgcattgcttattgatagaacagatccctatcccatcaatctcgccacatgcagacaattctgcatagtacaatcatatgcatttagtacttcttattaattgaacagtgtcttatctattcaatcctactagatgcaagtacaggcaacaaaatatgactgcatagctaaatatctgtacattttgcaatgagagcaaacttccatgcttgcaatccaacagttattttaattcacatccatttgaatagtaagcacacctcttctgatccttgaatcctctccatctccattttggacagaacaattttctttttcttagcgatgcatgtctccatggattgcatgagctgcctttccaatgttttgatgtccttttcatcaatttccctgtaagccaggattggcacgcatagcatagaattaaactgaaatcaaagcacactgtgtggaaatacaacttttgagagagatcagcttataggtatatcaaagttcaaacctgataaacagtgacagatagctgtaaggcagattgacggcaccaaaaccagaaagaacagccatgacacttactccaatcacgccaatcctactaaccaactggggcatcgtgaaaaaccctacaaaatgcgcaagccaatcgaacccaatcacaaggtagtccagtcgtgaagtcaatgagggcctctgaggccaatatcgtaagttactgcggctaagctcaatccgctagtattgagagtagcaaccgtcgccatgattgcaacaccatacctttttccggagaaggcatggggaaatgaatccccatgcgccagaagccatagaggaagaccagcaggaacagcgccgcgacgagcagagcccgctccctccgcacccctgcgaagccccccaaaacgatcagccgatcagaccaaccacggaacgcaaaaaaaaaaaccgatgagccaattgaggagacaggggattcgggatgggcaggcgggcacctgagttgcgcagcagcaggtagcagtggtagtaggggaggacgaagacgaggaggaggatgaggcagaagaggtcgaggtgccagttgaggaagcgggcgtgcttggagaggacggggaggatctcgaagaggacgagctggaagaggttgcaggagaaggcgaagacgaggccgaagaggatctgcaccagcgcccgccgctcctcgtactccttgtacagccgccggttgaggaaccacagccccgcccagccgagccccaccagcgacgcccccaccacgccggccttgtacaccaccgcgccccaacccattcccccctcccccaccccacctccacgcctcgcgcgcgcgccggcgccggagccggagatggatctcgcaaggggaaaaaccgtacgcgaggaggtcgccccttcgcgtgaatctgccgtgccgtctcccccgcaccgccgactcctctgccgcggtgacgcgcagcctcgtaggccgggctggatagcctcgtcgtgcagcccattacagttgggctcaaatggctgttagggcggacgtgcggcccgttttattcgggccgtcacgggattgtggtttatgtgtgggccgttttagttgggccaggaactggattgcggcgaacgtgcgggctgcggcgttgtggttcggcctatctgcagagtcgctctccgtcaggtctggggctatcgcgtttcacgtgcacgactaatcgcctggttcatcgggaccagccaccagaccacacgcaaagtccagaacgcacaaacggatggagagttacaatctgtgccggtgccacgaaacgcaacatgcctttctcctgtagcttcccttcttccgatccggtggtcggcaggaacgcacgcagcacgacgcgccagctagaagcattctagataggcacatatacagtacatggatagctataacacgcctcactcggggggagtcggggaccggccgaagcgcgcactatctatctattcaccaccaaccgaacccccgtacgtccgacgacctaacaactggtccacgactcgtcacgagcgcgcgcgacgctaaacttgcttggcccgcgcggcgcgatcccggccggacggccgcacatgccccgcttgcttctgccgggagatgcgagaccacgcgagccatctccaaaagcctaacgctaacggaatagcatagcatagcacagcacggggcacacacaaagacgagatgctgccgtgtgtgctccgtgcaaagcgtacccccgactacgcctgcttccgagacgggcaacaaagccaaagccagcgagtgcatacgcactttgctacggccccacgtacacagagttacagcctgttgctccaccaactccggaggctttgcggcagatccatcgcagcattattgcgcgcttttccttcctccctctccctctccctccaaaagtctaaacaaaacctctcccgtcttcttcgtgttcgatctcatcatcagtgctcgcccgtgaggcttcctatcgtgtccccttcggtctcaacacgccaaagcaaatcataaagaggcatggagaccggacatggagaaatggtgagcgcgcgcgcggggcaaaagatgtcaatttcgccatgccgcgtttgtgaatttgttagtagttcgaaggattgcacgggaagctgttttgcgagttagctcgcggatcaggggggctttgccgcctcgacaaagcaagggatcactactgtaatactgttccagccatgtgatgaacatcgcatttgcgtgtcgtcgtaaggcaatcaattgtacgattgatagggaaaatgtagaagtccgaaaatcaagtacaggtggttctttgaatctttgtcaacttgggttaacagtgaaaatgagcgagacacggattgatttgatactcaaaatgaggtttcgacatcaagtacaggggattctgatcgacttggacttcatacaattccccaataggataaaacataacaaaaacatagaagagcattgctcgaaaattacataaacatattaatgcggtattgttcttgctttgggaaaactaggcgcagtccaggactccgtacaattcagcaaacggtggtcagcgcttcattgacacgtagggatccagatgatattcactcatctgcaacgatttgaagatgttcagaataaaactgttcttcagaattgatgaatcaaaatggaaaattttcacgcgcatttaccgggagtatataccgttgtgtgatcgtgagctggtggtcgagaagtcagaggttgccattggaatggagatcgagagctgagtggcagagaaggtggcaaggctgttgtcatcagctagatcaggccaggagtcccttgcctttggccactcgtcgaaaaaggggcgcagcgtctggttctcctgcttcccggagtcgacggtcacatagtcgctcccgaagaatgacaatggctccctctccaccttcggcagcgagcagatggtgttctggtccagctcactcagatttccaagcatagggtagctcgaaactgaaaatgtggaggtctgagaaggcagcaagcaccacgaattgtcaatagaggtatccatagctccagtgatgagtgggctgtgctcatctgccaatggtctcactccataagcagaatacctgaatattggaaaggcagaaatcagtatatcagtaatccacagaccaatatgttccaccaacaaccaagcatttacaactgtcatttgaagatgctaaaacagcaatgtagaagaacagtttgtgcaaaatatgatgtgcaaaaatgtataagcaaattagcaagaacttaaaacaagttctgagtgcaacctatatatacacatgagcagtccgggaacatagttcacaagtaacaactgaaaaaggataaaaaaaaaatcaattgcaaacgtttctttgtcaaactcagagaaacaacagatcggttccacatcgatacatgataatataattgtaacaacccctacttgtgaataatcacatagggcatgcattaggcctcatgcctttacttaaagcatgacacgcgactctttgactgagaataacaagtcaagggagacgaaaattgttgcatcacattgcttcgtgacaaaagtgaaaaacaaaacaaaatgggaaactaaccatctaagcaaacatgattggcagcagcaccaatcatgtgccaactgccccgcaggtaaccctacagtgacagagcttcactaaagtggaattgcaaactcgcaaagtagtaggagtactgagggaaaaagattcagattaggtgggcaaaaggagatgggcttccggtatcatgttagcctttttcagatggtttcaggcatagggacgaagcgtttttggtcagaaagtcaggagaagttttacaggtgcagaactacccgtgtttctagttcagcaattcagcctgaaacgagaagcacaagaagaccaacagcagtcagcagaagaataaaagaagcagaataaatgccaggtctgagatcgagcaggtgcagagagcaccagacactagctctgagcatagaacccagacaagttgcaacttttagttgtactcctatgtttgcaatcacacaagaacacagcctgctctcctgctctacccttgtatgattccaccagagcaccaacgccatttccaggaactaatgctacgttcagatttttatcaggcaaaaatctggtcccagaaagcatcgccagagcccagagaaaaggaggagcctaaacacagttaacagcagttcttgtgccagagctgacgacaaacatttgaagtaaacagcgccccatgcacattttcagacgagcacttgaagtgctagtagtgatgctgcactagtagtattcagatttaccactagtgtctgcagatgcaatcaagcacaataatgagaaaacttcaaacactattaggaggcatccagctctgctgcatccatccatctgacatccatcatgcagtagacaacaataaacagtaaagaaagtttgcagaaattttaattgcaccctgtacctgaaatctttgtttccggcaccagcagcaacagtcgagtaagacgcagcattgtccatgtgcagctgagtattagaccccaaggcgaacgagccaggcgcgctgccgccaccgccaccaccaccaccgcctccgttggcgccgccgccattagcaatcgccgggtacagcgagtggttctggaaggcggtggaggtgacggcggcggccggcgccgtggcggggggctgcgagtggggggcgacgagctgcgcttccacaggctttcttgaacggttgcggccgcggtgcatgtgtcgctcacagtacttggagtccggcgcggcctccttggagcaccgccacttcttgccgtccgtacgccggcaccgtccgggctccgggtccagcttcttgccgaagtaggaaccgtatccaactgcagaccaaccaagcacgcaaaaaagaagaagaaaaaaaatcacaagtcaatgatgtgacgtgcgcatctcgaaggcatccaaatccaccaacgaacgcatgtgtcggtgcgcatttggattggagggagcaatcctggaatggaacgctttacagccagatgcaagaatcgaatggcgatgcgatgctaggcgtctgttcattgaaatcaatctggcggcgcggcggccggaccggatggcggccgccgccgtgctccgtagatctactctactcaatcattcacgcccgcaacaatgtacactgcgattaaaaaaaactaggaaaagatagggacttagtactcgtttcttttggttgtttaatcttggggtccatttgatgcagtacagcttgcttaatcgcagcagtaatgaatgcgtgggtaaggctcccaacaaccagacaggaataacccctacgaaaaggaccaataaactaaccacctcttttgcctggggtcaagtcctgtgtgcatccaatcaaccggactcgaataaaaaaaactgcactaacacaggaggctaagctatctctattcctaggagcaaatcttgaacttgagcacaagttagctaatctggaatataaaaacgcaagcttttagggggctaaatccagcagaggattaacaaatgaccagaccaaattaacaaaccggggccaagtacacctgaatccctcgatccgaataaacaagcgagacaatcatgtggatgcatgagtagtactactactagaggagagtgagacggaggcgaagggcggcggggcacgtacggacagggtggtggtagaagcgcgaggcgagtgagtcgaggccacggcggatggggaggaggagatccgccgggacgggcacgccggcgacgaggtacttgtatatgagcgcctgctgctccagctcctcgtactgcgccgccgtgaagggcggcggcctggccaccgccgccgcccacctcgcgcccatcatgtgctgctgcgcctcctccccgaccctgcaaccgcatgacgccaccacccacattagtccaccaccacggcagcaagaacgaagagagagcgaaggcgagagcgaaggcttacgcggagagaggggaggagcggcagaaggggaagatgaaggagggccggtggtcggctgccggcgacagggaggcaaagggcatcgccatatatgctgccgctatctctctctccctcacacacacacacactctctctgtgcgcctctctctctctctctctcctctctgccgcttgcttgcgccctctctcttttaatgtgctgtgcttttgccttttacttggctggtctgtgtctccttccctctgtcccgcctcgctggtggtggcgccgtgggctgtgtgcaagctgatgcgagcgaggctgcaggccggctctgcctgatgaagggagggaggagggggggagacggggacgaataacgatggggctatatagccggccgggtagctaggagcggtgcgcgggggtgggcgaggaggccgacacgggagggttccagctaagggacaagcacctgcgtcttgatcggtttcttacctttgggttcgcgtgctgctcgctttcagtattcggttttgtgggagtggattataaacacttaagaatgtcctctagtatcttatatctcatctgaatagttgttaaaaattttaatatttttaataagataaagtactctagaaagatagaagtctaaatatgatagaagtctaaatatgacttctacatgttgtcgcaaaaagataaattaaactttgattactatgcatatattaatatacaccacatatttgtttttttttcttacaacatagagagttgtattgatcattgcggagtaatacattacatgtcttgttagctttttaacagccggcggtttaagattttattaaaaaaaatgagaagaaaatcaaacaaaaaaattactgaatcaaagacacatcacataatgtacacctatgtataagttttcgatggtgcacttagcatcatcccctaagtcgacgatatagagcctaaggttgcgttcgtttgtgtgatatagggtgagaaagcacctcgttttccgcgcgcacgcttcccaaactagtaaacggtgtgtttttttaaaaaatattctataagaaaattactttaaaaagtcatattaatccatttttgaaatttaaaatatttaatactcaattaatcatgcgctaatggctcacctcgttttacgtatcttcccaacctctccaatctcctcctcaaacacaccctaagttgtgtttcttgtcaccatcaacatacaacccatcggtgtcatatttcgttagcataggattccctgcaaggattgatataaggtgagtcaatgaatcatccaacgattcagataaggccgattttcaacggggacataagcattatgtagattgatgatttcaaactctatgttatcttaagatagaacctaccgtgccgatcgctatgccacggtttatgatatttatgggacatatttggatcagatatggagttaaagatttgaccatacatgtacatgaaactagggtggaggtcatgtttaacacaatattctttgatgagcgtgtgaaatgcttttaacaagttgttcttttattagtcaccaatcttgaaataaaatcatgaaaatctctactcccttggcttcatgtttattagtaggtgatagtgcatgtctgtattggggtggagacttaaatggcctaagttccacacacttagctcgccaatgtccacgcaaaaccctaaccaccaacaaacttattgaaattagaaaaggatctgtgaggatgacaagtaggaccaagggacattaccacatgagtcggtgttgtgttttcgttttcagggcccccacttaatcgttggagtggaaaaacgaaaaaacatgaacaaactaataactctgacggaatgcaagtgcaaaatagatgattacaaaatacataaataacatagaaataaccgtttctttggaacataggaaaaaaacaaatgaattagatgagagtgataaactaaaaaatttcaagaggttgaaactcttactaaatttattcaaaatccatatatgattgttcgttatgtaagaactttaaatgataggatataattctatcattttaaatctttattgaaattctctaaatatttctattttttctataaataaaaaaggtcccgtcagtgagcgtcatattaacacatcagagtaaactgtgtcgttctttttttaaactcttgtgtcgtgggctcgtggctagctgtgttgggttcaagaaggcttgacgttacgttacctgaacatgcatggcgcacgcctattcttcacctgtaaaaggacgttgtcgatgttttcatcaacggttgggcggaactcctcctattattttatctgttcaccgctcggtctttaattttacagacctgtcgagaaagccaaatcggcgcgcgtacgggcttcacgtgcagcggcagcccactcaccgtcaatccggcagtgatcacaagcgcacgactcctaccgttgtttctttcacacacaagctgctgctgctgctgctgctgcgcttgtgcgcgcaggcaacgcaggcggacggtcaggtcatcccagcgacaaaacacccgcaggcgaaggcatgcgagatatcgaccaagcagaggcaggcaggcgagcatgcattgtaactttccgttgccttacggcttatgcaacggctaaagctaagcccttgctttttggtggttccatgctttgcatgctgggaatgaacatgtgcaagaacaggatgctcaccgatcgatacgccaagttctgtcctgccctgtttgatcacattagtacacacggcgccgttggttgaaatacacaggattttctcccgttgtttgatgtacaacaagtgggtagctgtgtctatagtccagtatgtaaagcactgttcatcgcagcatcaaccagacctgaagtacacccgaccagattgaccagactcgattcgcggagctcagctgaggcggtgcagccgaaggggacgaagaaaaaaagaggaataaagccgggaacgaactgcctgccctgcacgcatggcagcgatgggctctttctttctttttccgcagaaattgcgaagaaatatctgcaatgcaagtggataagagaactggactccggcaaatggcttggtagccagctttgggttgggatgaggaggatggtccagtggaggtccacggccacctcgccgcgggaaggaaaggataatactagagatggcaacgggtatggaaccaacaagttttcactccccgtacccacacccgttaaaactaaatctgcccactaaaaacccacacccgctcgcggatgagaaattccctcctacccgcacccgcacccgcacgggtgatgggtacccatttgatacccacacccgttgcaacaatttcaattatgcacaacaataactcaataaggttataggctgcagacaaaattaaaaaactaaggcttaaacaaaccatacatgatacatacagcctgtcacattgcaaaatcaacagcaagccatctctactcatggtcacggccccagccagatccagtgacctacctcattgcacctgtggcagcgctctgaccggcgcgctgcgtccctgcccccaagcagcgaccgacgcggtggctatcccgcccccaggaagcggcgtccctggctccctggaccttgccccaggcagcaactgacacggtggatgtccgcccccacgctggtggctgcccgcacggcggcgccctactccatcggcgcgaccgagaccggctggcggctggtgctgcggccgtgcgcgcctgcgcggtggcgtgccggcgtgtggcgtgcgcccgtgcggtgcggccgtggcttgggcacttgggggatggggggcggcggagaaacggagacatgagggagaggataggaggagaaggggaatagggtttagaggagtgaggaaaagaggatttatacctagggttttgatggttgtgggccttaggccatctgcatattgggctaggcctacgggtattttcaacccacggttaatgggttcgggtgacaggagaacgtacccacacccgcgtacccgatgtgtgaaggttttgcccgttaacgtactcatgggtatgatgtttggaacgtttatacatcctaaaagagtaaaaacccaacggttttcgggtcgcggggcccgttgccatctctagataatactagtagcacatcatgcacgggatcagggcacctgtacgctacgggcccgtgcatgcaccgtgtcgcgcgtacgtctcggctgcccgcgcgtaggtgtccggctacggttggtctttgctggacagctggtgcacgtgatggcccgggagggggcatgcctcctccccatcagtccgtcaccccatagctatagctgtagacattcctttgtctctcaaaaaaataagaatggaaaaagaaaagcgttactcgtatcatccatcatctttttcttcatttttcacgacataaaggatcgagtttgccgtataatttgttttccacgccaagcatgatacgtctcggtgtgcgactataggtgtatatatggacacgttgcatcttgccatgtgtgaggactcgatcccaggtctaacaagtcacaggtccttgtacagtgctcaaacacctccccgtctctcgtacacctaccgcaccatttttccctgattccgtcgacgcgcgccgcggtgttgctttctcgcaactatatttgcatcactagtacatgagctcgaaaagcgaaagtagatagtttgtggcatttgagccgcgcgctctcattttgtggacttgtaggggacacgagaaattacgcagaggcacaagtttccacggacagttggctcgttaaatccggcactgttggagggtagccggaataatctggcctttagcaattgagggctcttgcttgatgtccagctgttctcctccaacgtgggaccgatgcccacaccttgcgcactgtagtcaatatagtccatgggacccatcttgtggtatgccttcttgagacgcgtcttcgatctcttctaggctgcacttggttcaaccgatcggtgcctcggtggccagtgcacacgtcgagtccacgagcaccggcgcatggaatggttagtggcatatgcacgtcttcttcgaccttttcctcggcatctagtagctaggggtagctctcggctggcagtgggcgagcagccggtgaacgccgcgcggccgccgtcaatgccgtgcgtcacgtgccgcacatcgttcgctcgcccagtcagcgtccgcaaaactgtgccgggccagcgatggtgcactgtacgtctacacataatacggcacgcacgccagcggcggcggcggcgttgctgctgttgcatagcagtggcggttgtttgcggcgaggcaagggggaggacgctgtagtgctgcatcagtgcgtcgtggtgcccggccccccatccaaaatcgtcaataatgcagagggggtaaaccaaaccttacccaacccggccgcgcgcgcgcgacgctgcatgccggtgggtgctagcgggcgcggggccaccgcgtcacgtgacgcggatagcgattcgagtgtgtgtttggggttggttgcgttggttggatggggcaccccgggggactcggcgttgtgcctgttggtgcgaggtttacctcgtttggtatgggaggggacgaggctggcgatcggatggaggcgggtgcgtttgtccccgccggccggcccgcgtcgtaccgtgatgagttgcccatgcgccgacgaagagttgtctccacgactccacggtctcggcgggtcagctgattttccagctgatgttatgcgtgtcgtgttaggagtgttttcacttggatccccgggcccctcttaattctaacgtccgagtgaaggtagcacccgagaaaagtatacggaaaaggcatagagagggaaggacgattcgctgcccctttgattcgtagggtaggaaaaacacatgaattaaagtagtatgtttgttaaatcctacaagaataagtaaatacataataggagtcatttaataatgctatgagaaaaacaaaggaaattcacaaagagatcatatcccttgctatttttcctatgaaatgtgaagcataggaatacaatctataggattttgaatcctataaaaatcctttgccaatcctataaatcaaaggggtcttaaggccttattcgatttagattattgatgattgaattgttgtcatgaattactacttaattatatggataaattataaattaaatattttttaaaactaagattaataaatagttcgaaacaagtgccctaaacaattcgatagaagacttctattttggagaacattaaccttttcatttcattaagaaatgggagagtttctcagggaaaaaaaagtgaatcagcaaaaaaaaaaagagggtgcgttctatactacgcatttccagtttgtacacctccttatttttcacgcacatgtttctcaaaatgctaaatgtatgtttttagaatatctgtagaaaaatttatttaagtaattatataaatatattttaaagttttttagttaatatctaattaattattatgtgctaattttatcgctctgttgtgcgtgtcaagaggtaaggtttccaataaaaaaaccaacacaagcatgtacgtctaagatctaaataaagaggaggccagcagcgggaggggatagggatcagctctttggatggtaaagacccagttacctcatgcgtttgcgtcgcgtggtgagaaagctgtccgtctcgagtcgcaactccagtcttgaccggacgccccacgctgcagatctctgcaatggtccaggctccaagtgcaggacaacgtctcgttggcacggcaggcgcccccaatgtcccatggcacacgagcgcgagtcgagccgactgcgaactccccagaccaaactgacgaacagtacgacgcctacgcgcgcagagatctcgtcaaactcgtgcacgagtctagccaaaagcacaaaggctgcacgcgcaaaacgtcacccggccatatgtacgaacgcacgcacgtacaactgtagtaccacgccggtacacgcctgtgatttatctggttcgcgcgactgcgcgtgcagcggaaacacctgaaaaatcccactacacatccgggcgcggtctgcggcatgcatgcaccagcagtccagcaccgcccatgcaatcagcgctgcgacaccctgcatgcctgcctccctgcggcaactgatgacatgaatgaatcgattggttttctttcccgagtcaactaccaaagcggagccaccactgcccatggaggcgtacgtagaagggcaggcaatgatactagtactctctcaatctctgtactcccgtacatacgtgttaagtaatgtagcgtccaagcaagcgccccctttgcgccgtagtacgcacactcaaacgccggtcacatgcagagttcgtggtggaggagatcgatcaatctgaaattttgagctcaggacaagcgaggagcgtccaaagttttcacagtggacactgacccatttttatggaggtgtgtccaaagatctcgagtggtaatagccgctacgtgttcacggggacccgggcagtgatgagacccaaaacgattttgctaaatatttgtcgggtgatttttttcataggatttgacgtttttctagccgcacgatgttttccaagatttgcgcaaaagcagggtcagttgagtccatgaccgagtcaacctgactttgtattgatggatttctgtacatcacgcatatcaatagccatttatttcttcgctctatttctttctttaccaaaatttacagtgcactttgtgcacggtttctcaagcaatgtatttgtactaaaacgacaaatattctagttaacaaaatctacagtgcacttgtactaaaattacagtgtacttacatgtcatatctactgtttttacaaatgtaattttagttataaaacactgtaattttagttataaatgtaacatttgtgttaatctttactaaatactactgtactaacatgcacaatcacaggctatctggacggtttatctgtactgttttttttttaccgttggatgcagatgcgaggggagaaaaaatttggatgatttttttcttaaaaatcacaagacagatgtctagacagtcccgaggcaaaaaacgccgaggagatagcgctgcgagaagcccaggccccaacgagctgactgaccagctcggcccagtccgggaggcccacgcgccccggctttaccagacagcacatgcacgtgacggcacggaggaggcaagcgcttcacggccgctctggccggaggaccagccttgctcgtcacctcttgcactgaccccccgggacccacctgtcagtgggcgtgcccatgaagaatctagctgtagcagcacatcagttggtgattttggtgaacttctcctctattttcctcacttatttgagattcagtttcctagagatgtacatgtagggactaggggaagcagttcgagaggactcaaagaaggcggcgacccaagatggccagctgaaaacggacccaaacaagtcagagagatctgcacccccatactgaggggctgtttagtctgtgaaacaaaaagtttttagtgtcatataggacgtttaaccggatgtcgaaagaggtttcggacacaaatgaaaaaactaatttcataactcgtttagaaaaagcgagacgaatctttgaacctaattaattcatcattagcacatgtaaattactgtaacacttatggctaattatggcttaattatgctcaaaagattcatatcgcgatttacatgtaaactgtacaattagtttttctttttatctatatttaatactctatatacgtatccaacgatttaatgttatgtttttgagaaaagttttttttttaactaaacagaccctgaggaagaaaaactgagtagtagtagtagttcatacataggtttgtccgcctgccgggcacagagagacttgcacccacaaatacagcataaatgctgctagtgccactgtgcgtacaatagagatgtaaacatacaaatgacacagtactacagtacgtgtttaaagtagagtagagtcgtagtggtagtaactgatcgatcagcctctacctgcataagctttgctcatcagtgctactcaaaggcgtacagtcctttgtcacatggtgcattattattctcttgatgcgacttgggaaaccatccatcagcatcgcagcaccaacaggcaacagtaatggttcccaacgacttattgttatccctttcttacgcgcgcccagctacagctagcaagttccctccagatctcccctctcggtggcaaggcgtgtatcgacacctatcacaccctatgccgcttggcccatgcttccgttccatcagctgccacagcacctgagcctcgttgataaagctattagcacatcttctagtagtagtacattactagtggctggtagtgttatcaacaacctttctttcccttttttcacatcaagaacttggacaagaactaaagcaacatgataccctacttgggcaataaacgaagtggcacagcacacacaatgacaggttggagactaatggcaagtccaatcaaatcatcaagctacggcaacatgggctgggcgctccaacgggggccacccacgtggtgcaaagcgagcacacactgcaacgcccggggaggcgtacgcgacgcgagcgcgaaaaggaggcaaaagttagttggaatcgctcgctcgcctcctcggctcggagcggcaggtacgcgtgccgccgatgcgccgacaggcttggcctgtttgcacttggctcccgatcgatcggtttttgatgaactattgagctgtactatctgtgtgtacccaccaggcccggccgggtgttagctaggtctacatgcttaggaattaagatactcctgctgaaactgttgattggtgtaaatggtccacgcatcatccatgtacatccacagaggtaatgtgccacgcctcacgcgtcatgatccaatgtagcgtgccttttacattccgtgttttgaaaaggaaaaaaaagttttatgcatggagagctaatgaaatattttcactaaaatatggcaccatatttacgtactccaattaacatggtactatatttagtaggatttggcaccgtaaacagtgtcatgttacgaatatatagctccgaatgtaaatggcgccttataaattaagggccaatctctgtaagaacgtacattagtgatttatcttgtggaaaatgcttcagaacgtggaaagcttctgtatagcacagctagcagatcttatttgacggaccactaattcgtgtggactgcggagattactcttgtttgagatgtgcaagacaaaatgatgtggatgaacagtttcgtacactgtgtcgcatttacgtgtaccccacagtcccatacgcgtacggtatgtccatcgcgtattttctgttttcatcagttggtcatgttctattttgtttctccaactgcaaacatataaaatgggcttttccccaggccccatttgggtctctcttgattaagttagcaggccttggctagctaggcttagatagaagtaaaacaactaatgaaaagtctatatcatctaagcccttatacctccaagtctccaactataacctgagtctaaattatacacctcaaccccaacatggcaccttttatcaactgttgctagtaagtatgttacctagatatggggatacggatacggatacgcgatatgtggatacgggcatacgtcattttttgaaaactaaggatacggggatacgttaatatatgtatatataaaataaaaatatagaaattaaagaacttttgtagtaagaaattgtaagtcgattccattaccatatatcaatgttttcaagttctcttattctctctcctagataattcaagttggcgaagcaattaagcttgcctactgccaggccagtagtttagagaaaaatcaccacatacaagtttattatcatgttggttataaactgataaatcaactacacaagtagcagcacgccagcactaagccaccaaccaaccaccggatttcacttatggtagttcaaccgacacccaaacacaaacatgcagtgatttactcacagcctcacaggggaacaaaggaaaaactgcttagtggtcttgtgcctgctgctctgcttggtgagttggtggtcttgtgcctgctcctcggaggtggaggcgctactctgttgctggccgcggaccgcatagacggctgcgcgcggaggcgttgttctggggacggcggccagcagcccctagcccctgacgtcggcggcggaggaggatatgcgccggttgcaccgcgggacggtggggctggaggcgcagtgcccgccggcgaaggaggcgctgcggctgcgcagacggcggtgctgcacccgacgatggcgacggcaaagacgatgtggggagaccgggagtgagtcgtgggaaagtatgggcgtatcaatacgtatcagcaaagtatccgtaattctttcatttgtttgaaaatcgagaaaatgtcagatacgtatgggatatgtatcggagcgtatccgtatccgtcggcgtatccgatacggatacgcgagctcagcgacgtatcggggtaacgtacttgttaccatttcttttactcacttaagaccgcattaggcagcaacgcgaagagaggaaaactgtagcgcccgttccgtcgtggcgcatagcgggaaaattatctcttaaaaaccctaattgcgaaatttgtttctttgattgttgtctagtgtccgtgccatctcaagatctcaatccccgatctatcgtcgagttcaactccgaatccaattccttccaaatcgaatccctccgcaaaagtctagtttgcctccccaggttcgatgggccgaatctcgctcggcccatcttcccctcttccccggcccatctctccctctccccccgggcgctctcccgctctctctctctctctctctctcgcgcgctctcccatctctcccccccgctcggcctcgcccgtacgctgctcgcgcgtgcgagagccgtcccgagcgcctctctacccgctcccccgctcagcctcgcccgcacgccgcgcgcgcgtgcgcgtaagccggcgcgccgagcgcccccttcctttcccctcgctctgccgcgcctgcagccgcgcagccgctcgtcctcgcgagccagcgtgtgcgcgcccgcgcggacgccgcccgttgcttcccgcgcgcgcgtgccgtggtggccgaccgcccggtcgccgccgtccgtcagccctctgcacgcgcctgtcgccagtgtcgccggtccgctccaaaccgccccgccgtcatcgccgtcgtcatcgcccggcccccgcccctccgcgcgcaagccgccaagggacggagccgcgcccctcctccctctgccgcgatgctcccgttcccctccacctttttcccgaatcggcaaaggggcaagccccctttcttcccctccttttcccctttttcctcctcgccggcgtcatcctccctgtcgccgctttggccgcgaccgccgagcgccagctcgcgcccttgaccgccctaagtcggttcccaaaccgacattgccatcctataaacccaagcctccccctttcccttcctctcccattcgcctcctcaccgttgccgccgcccccgtgctctgtctcgcctctgccgtccttcgccaagcgccgggagagccggtgcgttcgaggacgcggaaggggacttcggccgcgccctctccttcctcttccccggcccgaggccggagagattactcccgcgccgccggcctctcgtcacagcgcccctcctcttctcggtgatgtctctctccgttcttcctcctcgctccatctcctccccctagctttcggtagtagcttaagtagactccccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagctcccgaagccgcatagatgctctcaccgccgggaatcgacctctcgtgacctcgtcgccgtttccctcttcttccgccgccggttgccgccgccgcaatccgccgccgtcgagcaacctccggcgaatccgagccgatggctcgccttcccttgtcacgtgcaaccgcccggtgtgcacgcttttgcccgtatcaccgtggttcgctctgccgctcgccgccgccgcccgccgtccattcgcggccgggtcgtcgtctacctcccgccagcccacgtggccgccacgtaggcgccacgtcggcgccagctcagcctagaccggatcgagccaaccccggtcagtccctccccgtgcgcgcgttccaccgcgagccgtgaggctgcgcgtgggcccgccgcacctgcgtccaccgcggaccgcgcgcatgcaccgcgtctcgtccccgcccgcgcgcgtgcgtcgcatgctccctccgcacggtgagccgagccgctgacaagcgggtcccacccgggaccgcgcgtggtgagcccggtccaccggactctctctccttcctccgcgcgcgcgcttcttgggccactctgggccgccttcttgggccagccggcccatttagctcggccggaccgctccatttctcttgggccgcgccctagccgcccgagaaaagtctataatccctccctcttttcttttctttatcttttccaaaaaaggatttaattaaatccttttcctttagatcaaaaattcaataatcttagaaattcaatatcttcccaaccgtaaatccgtttgactccattcaacttccaaaattcctcaaatctcgagatctatctaatggcacgcttagaggtcgttaatagggctttattttcgccgtttgttgagttgtcccgtttcgcgtgtagtttcagagcccgaagacccgcagtgcgaggattttgaggatcaagctccagatctcgagcaaggcaagccacctttgaacatcttgagcctatatttgaaatttaattatgttgcttgcaaaatattatgcattgataggatcgcacttaatctgtttgtcccgtctgcaaggcagattggcggacctacctaatttgtcgcatttgatccttcctttgttaattgctataccatgttgacggagctcgtggctcctcatcgggagaccgcgcaggcccccctttgccagttcggccgggggcttagggtgagatctcaagctctctctgtgtgtggaaagatcacgtgcccagaagaaacgcgagacacggacgatgtatacaggttcgggccgctgggaagcgtaataccctactcctgtgtttttggtggatctgtgtaagagcaagttacaaaatatcaactagccctctcctcttcccggaaaaaatccagcccccttctctgtgggcatggtcctccttttatatcttaaggggataccacatgtacccttccctttccaaactggacttttcttctctttatggacggagattggtatggttgccgtccgaatgacacttcgataggacagcccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctagaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgcttgaccagacgcaataaatgcggttaggtgagccctatcgtgttcacccaacctatgtacatagtgcaaaccccacagggggtcggggcacctcggccctcggggtcggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcaatcatccttctcaagggaagcggtcgggcataacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgtagattcgtttcgtctggagatatggtaacgtcgcttcggttggcgagcataattaacgcacacacgatacgatctatctcgactaccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttcctttcgccactattcccctttccttcgccgtttgcgccctaaactctctctttgctgcgcctcaccttcgccacacacactcgttctcaaccctctctttctccggcgacatggcacggggctccgctctgctcgacggtagcgtactaccgccttcccgcattgtgagcgagaggcaggctgggctgccgcgccgcttcatgccggaatccgccaccggccgggagatagtgatgctgggcgaggcacgcccagcaccagattacccggggcggtccatcttcttcctccccttcgcaatggccgggttggttcctcccttttcttctttctttatggatgttctggagttctacgatctccagatggcgcacctcactcccaacgcagtgatgactttggccatcttcgcgcacctgtgcgagatgttcattggggtgcgcccatctcttcggcttgttccggtggttcttcaccgtgcagtcggtgtcgccgccgtcggtggtcggcggctgctatttcctgccgcgggggccggtgttgaaccgctacatcccctgcgccctccgcaaaaagtgggatgactggaagagcgactggttctacacccccctcgccgacgaagcgcatctccgacttccgagccagcccccggtgcaggcttccagctggcgggcgccggtagatctgggggatggctatgacgccgtcctcgaccgcctcgcgggcctgcgatcccaggggctcaccggggccatggtgtacggcgactacctccgtcgtcggattgcgccgctccagcggcgcgctcgggccgcctgggagtacatcgggcccgaagactatatacggacccaccagggggtcagatgggattgggcccccgaggacttcaagatactgatccaacgggtgctaaatctcaactccgtggaggcgtccctcatcccccacggtatcctccccctctgcagcgacccggatcgcgtctccatcttgaccattatgacgacggtcggggcctcagaggagcaggctcctaagggccatggcggcgcaggtgggagccgccggggggatcaatctacccccggagggggtcgtgcttctgggccccgcgtcgggggctcggggagcaaccgccctaccgacgcccgggggaagaggaaactgggaggaacacctcccccatctcctccccgagggggcggggcggcgcgtgccagcagcaggcgcccggagggggccgcgccaacatcgcagcccgagggggagcgcaagaagaaacggctgcgcaagatgggggggacagaaccatcccagggaaacctaatttcccctccaaggtggtcatttaaccgaccccctcgcaggttcgtcccgctctctttgcgaccgtcttttcttccatcccaaaagcaagttttaccttacccattttgtttgccttctggttttttcttctgcttcagcgatgtcccgtcgcgtccctcccgccatcccaagtccggccaatccgaggccgaagatccggcggccgcagaggaacggaggcgagaatctgaccggcgagaggccgcagatcgccttcgggaagctgaagaggccgcccgggaggccgctcgggctcggcaggcggaggataccgctcgggaggaggccgcccgggcccgccaagccgaggaagccgctcgggaggaggccgcccgggcccgccaagccgaggaagccgctcgggaggaggccgcccgggcccgccaaactgaggcgatggcgtctttcgaggcagcccacgacaaagctgctggcgcgtcgcttgggcctactccctcgggcgacgctcaggcgacagcctccggggcggctcgcgacgaggccgcgggcggatcgcctgggcccgctccctcgggcgacgcccaggaccaaacgggtccgggggacatccccgagctcagtgcgtcttctggcgggccgagccgcgtcgcattttctccaaggcggctcttctcctcatcttctgccgccccgctgagtgccgagccccttctgcaagccttggccgccgcaaacaccgcggtgctagatggattcagcgcccaggtggaggccttgcgagcggaacgagcggagctcgaggccgcatgggcgcgtgttgaggaggggcggcgctcggtggacgccatggtggaggtgggccgtaaggctcaccgccgccacatctcggagcttgaagcccgcaaggcggcgttggcggagatcgcccgagaggtggaggaggagcgagaggccgccctcatcgccaccaccgcgatgattgaggcgcaggactccctccgccttcaacacggacgctgggaggcggagctaaagaaaaagctcgacgccgcccagggggtccttgacgccgccgctgcccgagagcagcgagtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcaacggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattgaatctccactgatcaacgctacaccacgttgaacaggcccaaccaacccacctgggctacggtgcattgggtcgatttattagggtgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgattcattacccaaggttgacaaagattagatatcaagtaaacatggcacaagcgagcagataggtaatacctggatcccatgtaattagcaaaacatgcatatttatttgtaaacggtaaaacatttataaattgagatcaacatgctcaaggggaatgtgtgacttgccttgcttcttcacttggatcttctgaactcttatccttgcgaacgcgatcttccgaaacgacgggaactacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctatagttaaactcgatttattgcgcaattattatttatttttacaaaggaaatggcatttgctgacgtcagcaaggggaaccagcgccgacaggcgggccccgcacgtcagcggcacaaaggggcggcgcatggtggaccaagtccacacgtggcctcgggtgcgcgtccaccacatggacggcccagatcggcccgaagccgatcggacggccacgaggcggcgcggctagggcacgggcacggcacaaggccggcctggctgagccatggcgcggcggcggcgcacgagagaaagcggcgacgcggcgcggcaagggggggggggggtccgggcggcccaggcgagcggagcggcggcaagccggccggccgacctaacagtggcggcgcacggcccggtggtcgcaggcggcggccaccggcgcggcagcgcgcacgggagacagaggagggaggcaaggtgggagaggaggagctcaccaaggacgcggcgacgagggatggggaaaggcggggaagctcggcgtcggcgctcctcggggcgaaggcggaacggcggcccggcggcgttccgcgagcgagaaccggcggacggcggccggagggaccggcgcgaggggaaccgtgttccggcgggatcccggccgtgaaaagcggcggccgaggtgctcctcggcgctgcgaagcgagcggcggcgacggcgcgaattggggtgattaggagcggcgccaagcggcggctggaagtggtaaaggcggtggagagaggtggtgcgcgtggcgacggtgcctcggaagcggggaggggaaaaggagcggatgccggggtagagcttggcatggcgttgccgacgacgcaaacggcgaggtgcggcgacgactaacgcggcagcagcggccggctgaaggcggcggcagcggggaagagaggtggtgctcgaggcggcagtgttccagaggcggagaggggaaatggagtggaggccgggctgcggcacggcgccgcgaagccgacagaggtggcggattggcgcggcggtgggtggagcggctgaatcgaccggccggagctcgccggaaagcggcggtgcgcgggagcagcgtggggagggcggtagggtggcgcggggagctcgggaaaacgggaaaaaaggaagaggagtccacggggattgattttatagctcaagggggcgaggagagggccggggaacggcggatttcgaggggaagtggggcggcgtcgtgggggagagagagacgcgggaggcggcgacgtggccggattttgcggggagagtggggggaaacggcgcggacgtgggcggcgaggtcccacggacaaacgcgcgcgcgcggggtggaggaggtgggcggaaacggcggcgacgttggacggctcgggcggccatggcggttgctggcccgggctggaggttgggggtgaccccgacaggtggggcccacctgtcggcggctcgggggaaaggagagaggaggagaaggttgggggggacgatgacaggtggggcctcgggtcccacctgtcggagagagagggagggagaggccggctggggaggcaaagcagacttgagggagagagagagccgagcggcgagctgggccgagggagagagagagcccgagagggggagggggaggaatttgggccgagcccgaaagcaaggaaggggaaaattattttcttttctttttattctaattggttaaatgaactttgtgctattaaattttcttcttgagctccgaaaattcacgaaaaattccggagagtattttagggcacaaagaatattgcaaaatattcccggccaatgatttttttaagggaaaattttaattctcccattacttcacttgattaaattgatttaacttttatttaatttctagaaaatgcattatttaatgatttttaatcccgaacgaaaatcggggcgttacaaatctaccccccttacaggaatctcgtcccgagattctgggatggctagaaagaaagctggtgctggtgggcggtttgactgatctgcacattgaactgccacattctgcttcaaactgattgattgactggttgatcaaacctgcacgattgaactggctggattcgacctttctgttcctttgctttgcgaaaactagaccggctagttctgcttgaactgacccagaccagaactgtggctgctcacgaaacttacttatcttgatctgaactgttgacactggcagtttgataacctgacaattcaccaagctggctagagaagggtgaagctgttcctaagacttgcatctggcatttgtaactcattgatcctacgtccgcttgaacgggtcctggctcgaatgacaagtaattccaggaaaacctgcttaacctatctttcgtctgaactgcaaccatctgcttgacctgtctaagctaagcggttgaactggcctcatgggtgtaccttagaattcaatcggttgctcggggatcggcttaattcttctgataccttgcaacttgcttcttcaagtgctaccctgattgcggcactggttgaaccttcaactgaaacggcaacgaggttagccaaaactcatatgtgagacctaccccccttacagtgggtagtctttctttcgcctgactgagaacctttgaactgttgtccttgaaaaataaccaacatttctcggatttacagatgccttgactttgaatactgaaacttcatcggtccatcaaattgaagcaatggcgatgcaccttcatcccgacaagatttggaacttaacccttagttgatgataggaaattccacataaaagtgactctcatttagctcatgaacacactgactcttgactaactttcccataagtaataactactggcatgactgtccttcttctgacctgacttcggtgtcgtccacctaaatgggttgtgtagttgatatctcaaaactaaactgaccgactcgcattggaattgacacaacttgaggaactggggtgctgcgaatagagctgttgtcttgatgacgctaacgccttgccgttgaacaaccttgcaagaactgaccttgtaaaccataaccactataggtagcacttgttgcctctgggattggtggtgacttagctgtgctggtctgctgaagacttggtggcgtactgtctgaggttgcaggtgcttgctcttggaaaacaaactgactttcgctctgatcctgattccggcttgcatctgagcttgtacttgttgtcggagacattgtcgttgcatctgctgctttggactctacggttgcggtatcaacatctgacacatccatcattagatcttggctagccaggatctgaccggagcgaggtgctccgactcagctggtagcttgttgtcttgaactgatccactgactctgactgcaacacactactgctagagttgcttccgctacattcgaccttgcatcgagctttgcatctcctgcatcaatacacccatcttctgatcctggataccaaatgttgatcacgagcagggattcttctagcattgggagtaccttgtagctttcgactgatccattgttctgtgactttcatacaccgttgttgttgctcttctctctgatactgaccatctgttaccagaacggaagagaggtggaagagaggggttgctaaagataaggtactaaccacttgcctactgatatgttgtgagtacacttttattgttcaagttgcttaagcaaacaacctagtatggtcgcatccccaccaatgatgcaaaccatacccctgcacacaagcaaacaacacacgatctagaaagctaacggaactactcttctcggaaggattgggtttgggtcagcttcggggaaactt

SEQ ID NO: 19424 - DNA, 29092 bp, Oryza sativa
  unsure (1)..(29092): unsure at all n locations
ctttgtgctattaaattttcttcttgagctccgaaaattcacgaaaaattccggagagtattttagggcacaaagaatattgcaaaatattcccggccaatgatttttttaagggaaaattttaattctcccattacttcacttgattaaattgatttaacttttatttaatttctagaaaatgcattatttaatgatttttaatcccgaacgaaaatcggggcgttacagcgagcaacggaggctgaagcggcgtcccggcggcgcgaagaggcccttgaagcccgtgccatggcgctggaagatcatgccggcgccgtggagaccagcttggcggaccgcgaggccgcccccgctatccgggaggcgacgctggcggcgcacgaggccgcctgcgccgaagaggagtccgcgctccggctccgcgaggacgcgcttgctgagcgggagcgagctcttgaggagtccgaggccgcgacacaacggctggcggacagcctgtccctccgcgaggcagcgcaggaggagcaggcgcaccgcaatctggaatgcgtccgcgccgagagagccgcgctggagcagcgggctgcctacctcgaggcccgagaaaaggagctggacgcgagggagcgcaacggcggggcggctacgggcgaaagcgacttagtcgcccgcctcgcagctgccgaacacaccgttgcggacatgcagtgcgccctggactcatccaccggggaagccgaagccctccgcttgtcgggtgagatagggcccggcatgctttgggatgcagtcttccggctggatcgcgccggtcgggaagcgggcctctggaaaagccagacaatttcgcgctccaccaatctggaaggcctcgccccgcaccttaggaggatggcctgggctgtccaacaactccccgaggagctcgagaagaccatcaagtcatcctcgagggacctcgcccaaggagcggtggaactcgtgctagcgagttaccaggccagggaccccggcttctccccatggatggcgctggaggagttccctcccgggaccgaggacgatgcacgcgcgcgggtccgggatgccgccaaccacgtcgtccaaagcttcgaggggtcggcccctcggctcgcgttcgcccccagctccgacgaggagggcgacgccagcggcgaggacgacggtggcgacgaggccagcgacccgggcgcattggaatgagcccccaggcccccgccaatctccaattttttctttttctttcttctttttgtatagatcaacttaatctgcaatcaaaaatgatgaaaaatttctatgttaactttgttttgttatgcatatgagttgaggatgatttgtgccgtggtccttttgcattttagcttgatttaagggctcgtgttcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattctttagaaggaaaaacggcacagacacaacctctaggaaattgaaactgcttttactgaaatgctgaaataagaaaagtaaggctgtgcatgtgtggtagcccccggctaaccctgcacacccgaggggggtgcggggttagcccgagcccgaaacctgacacccgacccccccctcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgagatcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacaatggtatgatctgcagggcctgggccggttgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcagttcaggaggattccgttagccgcgcgccgatagagggtcccttctaccagcacatagcgtttggaaatgcgttgtacgcgttcactcccttcgcggtcttcaggtagagtcttatctgtgaggtatgtttggatctcagagatccaagcgatcaatctaagggagcttggagcgctcccttcgggtcccgaggcctggactccgacgggcctcgggggtcggtcaggcgcatccgtctcccctaaggggtcgggtcgcgccgacggccgggtaaggctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcacctaacaccaggagacggcggatccccagtccggctgccaccctgagtccggcaaggagtccctcgtactctgccatattattggtcgctcgaaagtcgaggcggaccagatatctaaggacgtctctggtcggggaggtcaacgtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaattcagaaagctcgattgcccattttaccacccgtcctgtaccctctcgattatgcaagatttgaccgagggggtaagacgtaaccactgtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctctgctaggggccgtatccccggggcgttcttcgttcaagtggcctttcggggcgcacttgtcttctgtgccgatgacctcggggtcggaggatgaaaggggcggccttcccttagtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcgcagggttagcctcggggtcagagggcgttaagtgcggccttcccgcagtggccttggggccctcctgagggtcgggggcacctagcaccgtctgacaagcgggcagagggccgactccggtcgtcaggggccgtaggccaccgtccgactcgggggcttctcctccccgctcgctcccgggccaagttagcacagaatgggggtgcacgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcaacataagcctcaacattacgtcctatttggctacccaaagaaattcgagtagttcgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccagcctccagaagtctcgccacttcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccagggcccggcatcttcatcaggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccaatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgcgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcaacggcgggggccttctgtctggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggactcatcatcccctcgttgtactgcgtgcaagtccgcttcttcacctgggcgtggataggtgccttgaaagttcatggtgaactgctggcacagatcctcccaggagtggaccgacgcgggtggcaggttcattagccaaccccgcgcctgccccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacgccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggtggtggcggcgccggaggtcctggtagcggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcactccctggggcgtgctgccgtcgccgtagacgaggaggcgtcgctccccatctcgccgttctcctgcaccacccgcgactggcgatgctgcggatttttcgactctctcgagcgcctccccccgcttgggactttggcgcggaggaggtgggggagtacgagctcgatggcgcgggtttggctccccgtcgtcgccgctcgcactcggagagaggtcgtgcgcctttgcttgctcggccattaggctgaacaagggaaacttgacccacacggaagagtatgagagctcagaaaacacacgctgagccccctacctggcgcgccagatgacggagctcgtggctcctcaccgggagaccgcgcaggccccccttttgccagttcggccgggggcttagggtgagatctcaagctctctctgtgtgtggaaagatcacgtgcccagaagaaacgcgagacacggacgatgtatacaggttcgggccgctgggaagcgtaataccctactcctgtgtttttggtggatctgtgtaagagcaagttacaaaatatcaactagccctctcctcttcccggaaaaaatccagcccccttctctgtgggcatggtcctccttttatatcttaaggggataccacatgtacccttccctttccaaactggacttttcttctctttatggacggagattggtatggttgccgtccgaatgacacttcgataggacagcccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctagaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgcttgaccagacgcaataaatgcggttaggtgagccctatcgtgttcacccaacctatgtacatagtgcaaaccccacagggggtcggggcacctcggccctcggggtcggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacacatgtccccttgtaaccacccagttgcgcctcgatactcgtgcactctgtgcatgtatcgacggtcgccttcaaacttaaaatctgagtaacaacttgggtaaaactggagttttacaaaagacttggaaaacccgacacctgggtcggtgcttgcgaactaaatggattttccaaaaccgcggaccggggaacgtaccgggtgtacggtttcccgctcttgcacctaaggaccgtttccttggaatttcatccgaacataagacaagtacgaccacacgggtggaatgggacacccctggctgagtaactagcttatcaggggagccttgatgccgagagacatgtggattcgccggggtggtgttggggatgacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaactgggttcgatgtttgaaaaatcagcagctgacgggatcagctaggcccgggtggccgtttgaaatgttgttggcccgggtggccgtttgaaaagctgttggccgggtgccaaccctgtttcaagatctaaagactgatacattgcacatactccgaccggacgagacgcactgtcccatctgtgtcgtttgagaagcactcacctagtcgttttagaaaaagagttcaaataaaaccaattgaaaaaacaacagcctttccttgaagcctgcattaaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgcgcctgtgatgaatggtccaagtcctggcttccgctttccttttgtaatgcagttgtgagctcgggatctgtccgcagcccaacatgactgtacatctactctataataaagagacctctgttgctgtgatattctgtctccctgtgatactagtactgtttcctgggactggtatcgattaacaggttaatttggagcgtcacgggctagttccggtcgggactagttcggggcgtgacaaaaactcacatatttttcgcgcacatatttcttaaactattaaatggtacttttttaaaaaagaattatagaaaagttgtttcaaaaatcatattaatttatttttcaagtttaaaataatcaatacttaattaatcatatactaatggctcacctcattttatgcacatcttctaaatttttactttccacctctcaaacacacccttagaaaagttcactgggtttaatctaacgtaacacttattggcatctaatcggcgaaacaacttaaaaaaaataattatggagcccaggtgagctgacatgccattctatctccttttcttcttcctcctgactttcccatatctttctccaccattctgttaactagtgctcagtgggtggtagccaccagcctcattgcgtgcaattggtgagctccatttctcctatcccatgtagtacgtcgtggagcttgagctggagtagcattggcaatgggtgcggagcttgaactcaatgacgtagcagagagccgacacaatggtgcaaccccatatatcacccaccgcctagctattggattgccgctagctcttctttactttgggacactagctatttttgagcaaaatctactcttatactcttgatcaataatagaaattattggtgggctaaattccctcctcatagacctttattctcaacccattacaatctactcttgatttaatcatgatcaatggtgcagattgcatcatccttttgtgttgggaagaaaagcctagccttcattaagaaggagagagagtgagtatcatcagccattggagagaataagcaacaggcgaaacataagagggagaggagagtggaaaataacagttgcagtttgttcagtttggtggctcttacccgattttcattaaattagtgattagaggtttaaacatggttggattggcatcaaaattggtgagttcattcctcgcttagagcacttcaatatggtcagtttgtgtgaggattggttgagtggagcaccggatttgagcagtggtttgtcagctcgagtgactacaatttcagcttgtgcaatatttggtagaatgttggtttgaggggtcacacaatgtctaattaggctgtttttttggacagcttgctcatagaccatcacttctgccaagttttgtgcaatttgcttctgtagtttgggatatctcagctgagaaccaaaggggacataatccgctatttgttatattgttgttgttataactcttgttagttgttacggttgataccgataatgccaagtatgtaacttgatgatatagctgttgtttgtaatgtgtctttaaatgttctagaaaagactccatttgtacccatttttattgtaatggaagtttggagtggaccgttcgttccagggttttttactcctcacaccgagaagttttttttacgtaaatcaccgtcttttgtgtgtatgcgtttattgttatttcattgctgatttgctagttaactatccttaaaaaatcactcgcttgtgcgagatatatttactagttggtgaattgttgcttgcacattgaagtagatttggtttagcccaaacaattatgttgcaagaacaagtttttccatcacttgttatgtcacaagaatatacactagctacttttctattaccggctctaaaatacgagatttggaggatgagatgtccctccaaaaggaaaaaattataagcgtgttggagattgaacacgagacatcccaattgaaaccacacaaccctttactactgcactaagtgcatccctctattactggctctgttgaaagaaagaaaataaatctatgtttcggaaaacatcggcatggtaaatatacaggagctccctataccaacattgataatgctgttctctcaactgcaatggttgggaacattctatttgtcatggtagactttactgtattgtaatgggcttcatacaggtaagacagactttttaatcttttcagcctacatgggccggcatgaagaaaatgtgttaaggggaagccggcatgaagaaaatgtgttaaggggaagctcgatcaagaagaggaatcatatcaacggcccaaataaagaactttcgggaagaaagcaaagtgatgataagagaaggtctgatcatccatcttttttctccttttgaaaacttcgaattgcaagaaagcaacgaggacgcgacgactttattggcccccgatttgctattgatggcagcacgaatgcaaagcacaggctagtagcaccaagaacgaccagagagattactgccaaaaaaaaagcgagagattacatgcgaaaattttaaaacaattttaaaacaactcccattaaagcgtcaaacaaaatagtaacaaatcaaagcagcagcagcagcatctatccctgctgcctagtgcagcatttacacgttacgatcatacgacgtcgtcggttcgatcgagctcgcgagctctgaatctcgcaggctcgaatcggatggccgtctactcgacgccctcggtggatttctgggccatgacgacgccgagggtgatgacggaggcgtagatggagttgggcaccttgcgcaccaccctgccgacgccgggcacgccctccgtcgccctcttggtcgccagcgccagcgccggcgccgccaccagcgtcaccagcagcttgaagctgatcgcgcacagcgactccgccgtcagcttccggatgaactccgcgaactcctcccggtccaggagcccgtccaggttgatgtcgtactcctgttgcatcactgtatcatcagccgtgacaaatccttgggacaatcggacaaaggctaccaacctaccactatcagaattagagtcccaaagaaacgaggaacgcaacgaggaaaaaagtctgatttgattgtactcctttacctcactgagcaggagaattatgttagtactacttttagagtgtaaccttcgtcttaaaataagttccagaaatacaaatgaaaaaaaatatcaaattatcataatactctcatttctcagatcctaatgtaattatttctttttatctatacctaatgtatttattctctaattttacaaactttgagataattattacttaaataaacttattttagaataaatgggaaaaagttaaaaatgaactaattctagtatatgctatctccaacttcagagtttatagacaaagtgattccactgtaaataaggtgaaatagaatcattcacacctaccgagaaacagagagcagaaaccgagattactttgcttttcgtacaaggaaaagctgcaatatggaagaacgccaaagggaactactcctatctaattgaccaaactgattaaaaaaattaaacgaatgggatgtgaggtactagtggtttacattcatcatggccttgagcttctccttggagggcggatcatagtgcggccctggtaagtacttgttgatgtcgctgccacaacagccaccaagaatcaatcagggaaaacagatacggataacaagaactcatcaggaatttggaatggatttggttgctcctacttgtagacgcagaggacggcgatgtagacctcctcgaaggtgagggcctcctgctcgcgcttcttggtgtcctcggtgaggcggtcgaacaccttgtccgtgatcttcctcacctgcttctccttccattgcctccctgcaccaaccaattcgatccatatttcattcaccgcacaaacccgctactttcggatcgagcgatgcaggacaggaggacgcgagtcgattggtgatgggaggcaaggttttaccttggagtttatcctggagagacgcccaggcttgccccatggcgacgtcggcggaggagacgccggagtgggatgagatgggggttttggaagggaagaagataggagatggaagtatctccctctgtggtttgtgattctgatttactttagcctaatctaatcatgtgaacaatctctctctctctctctctctctctctctctctctctctctctctctctctctccaccgttgattttgggggtttgttggaggcctatgctaggggtactcgtgaagtgtacccagagatattcctctcctcacaacacgggtagaaatgcaaaaagtcgatctataatgattttttttaaaaaataaatctatagtgatattcatttgtatgaaaagctagtgatgcacactaatttcttttccatcctctagttagctttcttcttctgatggaacttgccatccatatttaagttatacacttacacatatactcgtatttacatcgaattattgtttcggtagtagttaatgtattttaaaaatagtgactttgttaatcttaagaatgtgttggaagaatgtacgtgcatgcttttatatcagtaagtacatgcgcgtttgcataagcatatgcatcgggaacttaatctatatacacaagtcttcccgtgtacataccgtacataccaacttaaaaacatatcataaaatattctatacagaattgtacaggtacttttagtagtattatatctatgagcaaagtttcattttcaaattcattgtatatagggagcaacaaaatagataaaattcagggaatttatattcttaaattgtcaaaaaaaattatactttttaagactaaaatataatgaatttgatgttaagattttatacataagtataattgacggagctggtggctcctcaccgggagaccgcacaggcccccctttgccggttcggccgggggctcagggtgaaatccccagctctctctgtatgtaaaaagatcgcgacctatcgaaagagcaagagacacaggcgatgtatacaggttcgggccgctgggaagcgtaataccctactcctgtgttttggtggatctgtgtatgaacaagttacaaagtatgaaccaacccccaatcgttctgggatcggatccccccctccaaaaaatcctcctctctaagtgggcaaggtcctccttttatatctcaaggggataccacatgcccctctctccttccaaactggacttttcctctcttcataaatggacggaaatcggtatggttgctgtcctagtgcgccagatgacgggacggcccatacctaccccctcttccgccggaagcaggtgcgacgtgggattatggctgtccgttgctgacgcgaccagtgtcagaccggtcacagatcggtcattcttgtcctccacgcgtcagtttagcaatctgcatgttcgtccttcttcatgtaacatcttgcctgtaatggttgggatgaagcctggtatatatctgaccggggctaacgtgccatctctaagaggcaacacgctagctccggttagagacgagtgcctagaggctctcgtcttgacgggatggggcgaggtgtgcgtcagaccgccaatcgccacctaacccgtgatctgaccggtctgtgaccggtcacagaccggataaaggaacgcgctgcactgcgctgcatgcagcgtgacacgcttgaccagacctcaataaacgcggttaggtgagccctgccgtgttcacctaacccatacatgtgacgaaaaaacccacaaggggccggggcgcctcggccctcggggccggggcaggagtaacccgacccccctcggggaaatcaggaggagggcggacacctcaccctcgggcccgacgtccccgaaggtgccaggccacgtgggcgattgtgtctgcctcaagcctctggtcacgatactcccggtcccatatcaccgacaataatattattggaagtacttataccttttttttagatttttaaggtgaaatttgttatttggtgtacatagttaccttggagtttatcctggagagatatgttcccacaaaatatatgcaaaacatatactactattgtaaacatattacttagcggtcctccaagcatgcaagtccgacccagttgcatccttaaaaagtagcgtaggataggcagatcatggtgtatgctgttccttcttgttgtggcatcagaccaatttttttctctctcgtcagccgtgagtgaatttcttgtgtatcatgcaacgaaatatcctgagagcccaaagaaagtttttagtagagttaagttattgatcgccagttgccttggtaacgctactgattcaattttctcgctataatgccagcatttcaattgcagatcaggcctgcgaaactactctcttgcgttactttacaaatagttccttctgatttagcatttttcatgcctgaaattcaaaggcctctctaacttgataatacactgtcatatgtactacatcagttaacgtgagtattatagagcgttaactgatgcaagtctgcaacccaaatgatggattaagctggtgtgtgtttttactcagtcactgcttgcccgcccggatgtcctgcaggaacatgaggccgacggagaagacggtgaagagcagcggcgtgggcaccttctccacggcgggcccgaccctcggcacctgcctgccggcgctcttggtcgtgacggcgagcagcggcgccgccatgatcgccaccgccgccttgttcgccaggacgagccgcaggtccttgcggacccactccatgatcagcctccggaactcttccagtgttatcccctcgggagtttccttcttgtattgctacaacgtgttgcagagccaaaacgaaaagttatataagccgtaacatttattagtgataaaaaaatctgtatatataatttttatatgtatattcttagcgacttaaaaatcaaatgatgaaaaaacagtaaaatcaaattaagttctaaaattcaaattatggttacgtagcaagctagagagcaaataatgtagctgaaaagatgtcaccgttacaacattatttaaacagcaagaaattgaggttgctggtactttgaacattgaggagcctcttccatttttcttttcagaaaagaggaggtaaagtaagttcgatccgtacctccatctgcttggcgacaacattcatgcatggaggatccttatgtggaccagctaactgcttgttaatcgagctgtaagaaattttcgacgaaaatggagaacaattagagaacatttcaggaatgacagagtgatcgatacctacgagtgatttgatcgatctcacttgtaaaccatgagggtggcaacatggagggagctgatgtccaggagctgcgtgttcttgtcggacagctcggtgaacaccttgtcgcaaatcctcaccacatacagcttgcctataatcaaagacaagtaggtaacacgaaacaaaacattaacatttgttactagttgtaaccactgcatgcatggacaagaagaaaaagaagaacgagatcgattaccttgtgctctgtcccacatacggcagaagaactgagccatcatcctcctctcttcgtcggagatgaactcaagaactcgtaaagtggagtctacatctaggatggcatatttatgcgaggaaatctgtttttggttctggatagatgccccagagtcgcttgcagggaaggcacttctttccttgcccctacagcaatctgaaaagggaaaaaaagaagtaagaaaagtcttcgttgtgtgggcctccggattggcggcccaagtggcccagtgtccactctactcgtgtcggattagcaaaaactgacacatcaatttacagccgtaatgatgaatagacgccagttaactgcctggcaaccgctcatcaggggacaaatcctcattcatcacaccataaatcactatttaaccatctactgcatctcattatcgcattcgctcaatcctagttccaagtcacaactcatttctgtttccactttccaaacgccgccagttgctccgccgaggcaagcgcccagagcacgaaccggcgatgatgccgctgaagaagaagatggatccatcggcgtcgaattcgatctccggtatgttcctttttatggcacattttccaattttccttattgattcaattgtggaaaacagcatcttttcttcatggcaatctgataatctgaggatgactgtaacctctatcatctcttcttcagcacctccctctgaagaaatgggagagccagagaaaatggatgagatggagcaagtttcgtctgatctaaagtcgttgaagacgctatatgggctgcttcacaggggtccgacggatgaaactgtgagtttttctaagaaccagactgaacatgtcgtattattatctatcttaatcttaatcttaactcttaactaattaaaagattagtatttttcctttcatcacaatccgtttcttccgtccgttcgtccgtccgcgcgatttttcttcgcccaagcgttcgtccgtccgcgcgatttgagattaaaatcgaaaccgatacaaaatccaatcggataatcctacttagagaacccaaatagaaggggaaaaaaggaaaaaagaaaattttacgcttcacagagaatgaaacaaaaaaaggggcgaaaattcctaacctccccacagccggttgtcgcagacaccacgcgggagtccgccgccgccgccggccgtcgctgacgcgcgcgggaagatctaccgccgccgcaggcacccgccgacgcgcgcgggagtccaccgccgtcgccgacgagcgcgggagtccatcgccgccgccggccgtcgccgacgcacgcgggaatatctactgccgccgccgacgcgagcgggcagtactctgccgccgccggccgtagccgatgccgctgaggggagacaacgggggaggggcgccgaggcaagggcactcgacgggggcgcactccccctcgggcgagtgcgcgcaccggcaagggggcatgcgccggcgccgccgatgagcgccacagctccgccgtgagagagggaagggaggagaaaacctatgcaatgttcggctaattggaaatgaaaatgatttcccacccaacaaaagacatctttaaatcctaaccattcattctccctctttcatttaatcctaactcttcattcatttcccaatcccaatcacaatccccatttcccattatccaaacacccctagggttttcgtcagcggccggggtgggggggggggggggttgtccctccgatctcaatgtccggccgtccgatcgaagccctagagatcagacgaccggtgttggctgggccgaattcggcccaagagggtggcgcgcggcacccactttcccggcccaggcccaagttgaggcgtgggaaagggggaggtggtgcgcccgcgcgcacttagaggctgtgggccggccgaaggaagtccagtttagatccctcggggggggccgaagaaaataagtttatttctaacaaaatgtccgtgcttcgctacggtgtatcaaaactaaaaatatttgtttttaaccaagttattttcacactgttttgttacttttgctatcggagagagggtgtcgtcgttgccgccgtcgcagggacgccggtccgccgctggctcccctcccgctggatccggcggaggggaggccgtgccgccatcgcctccctcccctcccgctaggtcgccgccccctcccctcccactagatctggcagaggggagggcaccgccgccgctgggcggccaggccgccaccgcctcccctcctctcccactagatccggtggaggggagggcatcgcccctacatgccacctcccgccgctggtcgttgctgacaggcaggggtagtccaccgccgccgccgtctccgacgccatgcggaagacgaggtcacgagggggagacgatggggaggggcgccggggcaaggccacttgacggcgccacactcacccacggacgagtatgcacaccggcgagagggcatgcgtcggcgtcgtcggtttccgcttttccagcgatgtggcgagggggtgagaaggctagggtcccgatcgtccgatcgaaaccctaagatcggacggccggcattggctggactgaatccaacccaagtggaggcgcgcgtggggctgcttccccggcccaggcccaggttgcagcctggggaggtgggaagcgctcgcacgtgtacataaaaggccgtgggccgaccggctaggccgggaaaaagtttgttctaggtccctcagcaacacttttttggtactgtacacactccgtaatcatcaggtgcaacgtaagggcacttttccttgttatattattaaaggaatagaaaaaggagcctccgcgttcactctcatggcctagaaattctcacattaatcggagaaaaggaaaaaagcagagcccatatagaaatacaatttagaaatagttaaaattcggaattaaaaaaataaggaatattagaagaggagactagagtccatatagaaatacaatttagaaatagttgaaattcagaattaaaaaataaggaatattagaagaggagactagagtccatatagaaatacaattaggaaaaaactgaaatttggaattaaaaaataaggaatattagaagtagagtatagagtccgtatagaaatacaattaggaaataatagaaattcagaattaaaaataaggaatattagaagtagagtatagagtccatatagaaacataattaagaaaaaaaatagaaatccagaattagaaaataaggaatattagaagtagagtatagagtccatataggaatttaaaactaactaaaattcggaataaacataataaaattaaaagtagagtttagagtccgtataaagacacaatttacaaataactaaaattcaaaattaataaaaacatgggaagaagagtttaaagtcaatataggaatacaatttagaagtaactgaaatttgaaattaaaaattaaagaatattgaaagatgaatttagagtccatatagaaatacaattagaaataataaaaattcagaattaaaaaaaaagaaatattaaaagacgatactagagtccatataggaatatatataatttacaaataactaaaatttgatattaaaaataattaataactaacacgtatataaaatacaatatgaatattacacattagtagtttcgtaaagttattgcaaaatttaaaattatgttgtcattgtaatatattttaataatactagaaaaaatgccagtgcgttgcgacgggtaaagtctattttaatcttattattgttatatgctttagttaagatgaaattcactgtgggagtttgcttgcatatataatttttttagaaaatcatgagatgcagttaggagttcgatcgtttcaagttagcatgtaagtttttttaaatagatttcttatatgattccttctatattaccaaaagtgaacgatcttaaaaaccgactcaaatacagatatgtatttccaaaagcaaaggaacttaaaaaccgactcatgcatagatgacgtaccaaaatactagcaaaaacacggatgaccgaccgcggaaacatcttcaatttttataaccgactcaaacacggatgatcgaccacggaaacatctataatttttataatattagagaagagatatagattaaaatcaaatcataaaattaaaaccgacttaaacacggatgacggaccgtggaaacgttttcattttttataatagtagagataatgagaaaacatatatgctattatatgagagaaaatataatgatgctaaccgcgcaatatgcgcgggccaccatgctagtttttctgaagtgaacaagaataggagaaagcataaatatgtttccatttttctaaaccgttttggtcaggcgtttctgaatagcagagcagggatttatttttcagtacctgctagatgctcgtgtttagtgcatattcttattctccttggggaaaatctgaagaaagaaaatgcacgtttagagttgctagtatcaattcatgctcatattatctcgacgttttacagttggatgaaacatcaagagccttcatgacgaagatgttagatgacattactcgtcagacactcctcaggcaggcaaaggtgatacattttcggaccatctggtcatatttcatttagacattgtttgcaagattgcatcactccaccttcatctccgttttaaattttcccggcaaatgctgatccaaaagaaacaccgcacgtttgcagatgctgtctcctgtgctggagaggaagctatctatccagtccgatcatcgccggacgcgcgacgacgccgtgccggtgccggtgccggtgccggtcgtgaagccgatagcctcgttcagccccagcctccatgccagtgagaaatcaagccggctgaggacgcaaggcgcgacgagaaggcgagacggtcgccatggccaggacaactaccgtctccttgctcgcgtcgcctcgaaccgctcggcaagaaccacagtgccgccgccggcgccgcgccaccgtcagagtccggagcgacgccttgaccgcctcgcctcgcgccgttcgtccagagccgtgacgccgcggcgcggcacggtggacggtgggaatccgctctccgacatgaggtgtccgcgccgtggcgacgactcgtcgatggagcgcggcggcggcagcagcagcagcagccgctccctctcccgcgaaccgtcgtcagctgtgcaggagcggggacgggggctgcatcgcggcgcctcgccggcggcggcaccgcgcgtgggagcggagggcggctcctcgacgcgccgtctcgggaggctggactccggattgtccgtaaacttggtgccgccgccactggcgcggcgacatggctctcagcgaggcggacgcggcgcggcaacaacgacgaagctgtcctcgtcgacggacgtggctgccacgatacgcagcagcatcaggccgagctcccgagaattcatggagcgctccccgcgtcgagctggtgaagctgaaaacgataggaaggaaggtgccgatgctgccagcgtcagcaaagggcggccaagccgtggcgaactctcatcgatgaagcgcggaagcagcagtggccgatcactctcccgcgaaccgtcgtcagctgtgcaggagcgtggacgggggctgcatcgcggcgcctcgccgccggccgcagtgcgcgtgggagcggagggctcctcgacgcgccgcctcgagaggctggactccgggttgtctgcgagcatggtgtcgcgccgtggcactccgcgagccggacgcggcgcgtcaacgccgaagctatcctcgtcgaccgacgcggctgccatgacacgcagccgcatcaggccgaaccgtgacctcacggagcgctcgctacgccgagctggtgaagctgatgaagacgagagcctgcggcggtgccgggggaaggggaaggggaaggagaagggcgatgatgatgctgccagcgtcagcatgggccggccaagccggccgccgcggcgagctctgaaccggatcaactccagtagcacgtacagtagcagcagctgcccaccagagccgacttcgagcacttcaggttccacttcgtcgtgggtgccaccgcgagacaatgcatcgtcgtgggcgccaccgccaccgcgaggcaatccgccgtcttgggtgccactgccaccgccaccggggggcaatgcgccgtcgtgggtgccaccgccaccgcaaccgcggggcattgcgccgccggagtacgggtttcaagtgtcaggcgcgtcgagggtcagtcgccaccttcgccggcaggagcgcctggagaggagagtggagcggatgaggaggttcaaggagaagctcggcacggtgttccaccaccaccacttcggtccctcgggcagcaacgagggggcgcccccgctgttcagccgtgacgtccacgacaacggttatcaccgcccgtcgccgtggaaggttctcggcggtgtcctccaccgcacgacacgccgtggggagaagaacaacgagggggcgcccccgctgttcagccgtgacgtccacggcaacggacatcaccgcccgtcgccgtggaaggctctcggcggtgtcctccatcgtgcgacacgccgtggggagaagaagaccaggagcgtgccggcagatcatcgtggcggcgtcggcggcggcggtggcgtcgggcacgcgctgttacacatgtggaacaaacggcgggcgatggcgaagcaacgtggcggcgtcgggcgcgcgctgttccaaatgtggggcaagcggcgggcggcggcgaaacagcgtggcggcggcgtcaggcgcgcgcttttccaaatgtgggtccaacggcgggcgacgacggcgaagcggcgtggtggcggcggcgtcgcgcacgcgctgttccacatgtgggggaaacggcgggctaccgcaagcgctgggatgtgcggtacgggaagccggtggaaggccaagaagttgcactggtggcagcgggtgaggccgcggcaccgttctggacatggaaaggcatttcggtaactggtagcagcttatctgtgtctctattactactagtagcttctttgtgtggagatgtggctatactattttgaaacaaattttgaattgtagaagttgctataatttaagacgaatggagtagcttatttgtaatttgtttcacagcttattgctctaagtaacaatgcattatcttttcattagaagcaaatattcctctctcaatagagggtgcaaagttagtccattctcatcgtgtggaacctaaaagaaattcattatcatcactagacgaaggggtacagcataatcatcaaagctaaccatcctagtatggaaatttcagctgccgcataaataagaaaaaaaaattgccgatagtaaaggcaaaatttaaagacaagggagattttgagaataaacaaaaagaatctcccattattttattcaaatgatacatgaaaggataatatttaccagacaggaaccgaggttttcaaagtacgaaacatggctgctgatgaacagaagcagtttattccgttattcggaacacggaattacagctagaagagacgaagttattcttaccaccctctcaaaaaataaacagtacaagtttgccatcagatgtatggcaaatcgcctagcagcaagccatcaacccttagttcttcacagtggtgacatgcctcagaagcatctgaatcacttcaggggagatacttgcagcctgctgcttgagttgtgcgattttttccgctgtctcctgctcaagacgcttgacatttgcaccagagtcaccgctactctggaaataacaaataggaccattagatgaatatgggaattgggaatgtatcctatacacacaagccttctacacaaatatgttcccgatgaacatacctctgcaaccttcctctgaaattcagcctccatctgggcacggtattcagctatttccctctcagcctcctcttttgcttgcctaagccttgccgattttgctgccaaacaaataaaaaatctcttacatcgcaggttatattgaaagggagaaagtttactctttttttttagatcaagatagtatcaaaaatctatagaagctcaaggtcatatttctatggttttatatccaatttttgctatgggataaaacatgttttgctaactaaaaaaaaaagcactttcacccttatcattttgtggctaagcctgatatctgcaatttcatacgatattcaaaattaatattcaagtgcaaagagttcagagtagattaagattcttcctactaaaattgatgtgtatatgaaaaaaaattatcattgcattcaatagagcagacatgttcacctagtacatctacatactactctctctctaatgttatgcttattcataacatttacggagagggacagagagttaccagccctagcagcatttactatttgctgagcctcttgctctgcagccaacaattgctggattccactttggcgtctgtttgcgtccatctttgtgctgctgaaggaagaatcagaatcaattaaaaagaactcagaaaaaaagaacttgatcagaaggccaggtaaaaccatcaaaagtccaaaaatatatggcacatctcaatactaacagtaaacaaacaggaagcaaatatgatcatactacattcaacaagaaagatctgatgctactgttgtttacaacacaaaaatataatggtccacacataaagctggaaatctaccatggacctaacctttgttcatatatattctgtttcaacctgctgaactacaacagtaatagcgcgtattgcctgttcctcagttctaattactttggattaatgaattaactatggactctcgtgtatagtatgaatagacctacccagctatcttataaaaaacaataatatcatgtaaagatccaccaacagaagttagcaggggcgatcacaagctggggcatagaggtcaagttaaaccccaaaatacaaactgctattagcaccctactgcacattaaaaaaatgtacaacaagctggatagatcatactattacacgcatagagataaagatttggattatatcaaccaggggcggaactaacgtggggaattgctaccgatcttttcttggaatcaaattgctataagtactaaggttaaggttaagggaaagagaaaagcttccagatctagaagacaagctgaaggctaaggcgaagagataaggcgtcggtggagaagagaatgagaatgtcagtacgggtgctcaccggcgaggatgcggtggaagcagaaagacgccggcgccgctgctagccggaggcggcgggcgaactctctacgatgaggaaatcgaggccgatggaacagccagatcgactagggaacaaggaatcggaggccaattaagctatggccgggaacggtgaaatcgaccagggagcaaggatcgagcaagatccagcaacagaggctagcgaatcaacaaatttactcaatctgctactatcacccaatcggatcaaacgagcaggatcaaaatcgagaaaacgtattagggtcagcaccgaacgcagtcgattcctaccagatccggtcaaattgatagcaacacgaacacaaatcgagagagagagatcgcggggagagggatcgagttcaccatacctgcgagagagaagactcgaatcgaacccgggggaagcgacgagatttcgatggggaaaatctatcttccttcgtgctgctcgcccatgggttccaagcttatttattcatgacgatgattaattaatcccgtttcgtcatatcgttggcgggccgtaatgggaagcccaagtgtaatcggattaggaagcccgctagtatcaaagcccaagcccaacacgacagcaaatatctctctcatctcatctcttctccaaacccaatcaaaaccccatccgattcctctccatttcaccaccaccaccaccaccacctccgcctcctctcctccccttctcttcgccggcagccatggccaccgccgcagcagcagcgcgcgccgtcgcggccgccgggcgcccggcgcagggggttccgttgtcgcggcgcctcacgacggcgtcgtcctcctccgctcgcccgctgcggcctcgcggcggccgcgctgccgggtccgtccgctgcatggcgcggcggccggagtcgtcgtactcgccgctgcggtcggggcagggaggggaccgcgcgcccacggagatggcgccgctcttccccgggtgcgactacgagcactggctcatcgtcatggacaagcccggcggcgagggcgccaccaagcagcagatgatcgactgctacatccagaccctcgccaaggtcgtgggaaggtaattgcaacaccgtgtaactcaattgaaccacccaatgcatttgtgcatcatagaacgatgctaattttggatgactggtgggtggtggcatgtagtgaggaggaggcgaagaagaagatatacaacgtgtcatgcgaacggtactttgggttcggttgcgagattgacgaggaaacatccaacaagctggaaggtacaccgtgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19425 - DNA, 1366 bp, Oryza sativa
  unsure (1)..(1366): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaagagagacagagaggatgataatggtttttctggacaacctattcagatcaattcctcacatgatagggggtggggtctggtgggaaaaagaagcaaaggaataatggaaagtagtgaatcctggagagcttttgaggagcaacgagagagacaagaacagagactaattgaagctaggatatatgatgcaaggagagaggatgagctccagaaggcaaagaagaaaaacaagaaaaagaaaaaacatgaatttcgagatgatgacctacttgatcctaggccatacaaaaatgacagaagggtacctgaaagaggtcgagcggcaaagagacgtaccccagctgatatgacagaatacacaccaccagctaagcggcacagaggaggagaggtacttgttctcaaccctgttttaataggattatgcattgttttagcaatgttggtatgttagacctttttgtaattccgccaccagagatacctgtttctgcaacttattgtttgtagaaattgagaaagggcaaaataattgtatgatagcctttcaaccagcgtcgtgcttggttttgttattcacctttagagagttgggactagtttttctcaactaaactgtcccattgtgttgtgcgttctcaacaaaatagtttgttttgatcaatattcagtttgatcatccccgtcaacatcatcatctttattaattctcttttggcacgttcatctttagttttttaacatatagacacccgcattttgctacaagggatgtgatacccatttgtgagatataggtcggataatgcagataatccattgttgttttttttgcaagactatgaatttaaacttaatttatttgtttgcatactgatgcaggttgagctctccaacatattggaaaaaatagttgaccacttgcggacaatgagctgttcattccttttccgtaaaccggtgacgaagaaagaggctcctgattactttgacataattgagcgtccaatggatcttggtactataagggacaaggtgcgaaagatggagtataaaaatagggaggattttaggcatgatgtggctcagatagcactgaatgcacatacatacaatcttaaccgccatccccacatccctccgcttgctgatgagctcttggagttgtgtgattatcttcttgaggaaagcgcga

SEQ ID NO: 19426 - DNA, 19836 bp, Oryza sativa
  unsure (1)..(19836): unsure at all n locations
gactagtgcacactaaccagatatgggatttagatcttgctatattctaacttagatgctgtaatgctgacctgtaggaggggggaagagcacctgtagaatttttcattttaggctctggctatggtatacctgggatccccaattccaactattttgcctcttgttggtattgggagttgggagttggaatgtacacaaactctaggttagacattgagggcccactgtaactattggcctcttgctgtaaaaatgtagcgatgtaattttttgtccatatccatggccttgggtgtctcaaattctgatgttgtagcattacatcctatgtgaatggcatctaaccatgagtcaaaggtgcaacacgtcaaagcatgtgctaaaggttgtacccggtctaacctgattggtgaaggtcccttcaaatcctgcatgattagaggcttaccatgcaactatgcgaagtcaaaacctgtaattgtaactgtaacgtgagagatggtgtaccggcagtacaagttgtttgagttgctgccagatgatgatgtatttgatgttgcatgctttgaatgagtattcaccgctcaacgatatcattggatggtgcagttcatagtttcatacctttggtttttggtttgtgatgttgtagcaacagaacaacaagtaatcatccattaaacaatcaagtccctttctcctacttgctgaatgtactgatggctcaagaggagttgagtttagagtatagaatttttaagatgctgacctgccaagtaaactatacaacaattccctagctctgaagcacctgctccagatgctcttagctgaaagaaaatctttgaagtgtacgagggctgtctggaccgtccgatcatgacaacgaacgacggcttagtccaagccaatttcataatggcccagatactcaatttttgcatggtcagatcacatctaatataatagtacaaaaaacaactaaaacgtgtactagcatctagcagtacgaaccagcaaactggcatgcatttgtctactccaaaagagcaccgcttaacgcgggacgcggctgctcacgactaaaccatttttataattttattctcttgcttttagtaaaaaaataatggcagtagtagacgaagacctggcaagtccttgggcttaaatctcacgagcatatgaccaattgaccatatctatgcacgcgacaaccaaaacattacaattccacgagtccgcgacctgttctactcacgtcaccccgcatccctgatcaaacaaagcatttgctcgggagcttgagctcgagctccgtaggccggagcagccatggtgtcgtcgtcgtcgtcgtcgcctcgccggcgagctctcctcctgctgttcgtcttcgcgtcgtcgttctttgccagcgctgcaggtgagagggttcttgagtagttttgtttctttgatgaaatggaaggcgtggagattgatcgatcgatcgatggtggcgtgccgtgtttgcagcggcggtgtcgcggacgaactcgtcgtcggcgttcgtgctggcggcggcgcaaacgcggcggaaggatccactccgcgggctgaggtactacaccggcggctggaacatcagcgacaagcactacctcgccgtgagctcctcatttccgtgataaatttcagctcgcaatgcgatcaccttggtgttctactgttcttcctgcctggttcttgatgctgacgccgtcgagttttgctatgcttgtcgccgcgcgcgcgcagtcggtcgggttcagcgcggcgccggtgttcgttgtcgcggccgtctggttcgcctccctcgcgctcgccgcgttcgtcgcctgctgctgccgctgctgctgctctggcgccggcggcggcaacggcaacggcggttactcctactcccgcgccatcttcgccgtctccctcgcgctcctcctcgtcttcaccgccgtcgccatgtaaaaccatttctcctctccaagccatttcatattacaaagtacaaaactgttcagattttttttctagtataagtttgatcaaatttatacaaaaagtttagcaacatctgcttcattaaaactagcattaaatatatttgttttgcattagaaatgatactatatctctttataaatttagtcaaatctaaatatattttgataatatatttgtttgtggaaatgctactatatctttttataaatttagttaaatttaaataagtttgataaataaaatcaaaacgacctataatacgaaacggacggagtaatttctaattttggacgccgccgccgtcgctgtgggtgcagaatcgggtgcatcgtgctgtacgacgggcaggggaagttccacgggagcacgacggcgacgctgcggttcgtcgtcaaccagtcggacggcgcggtggcgagcctgcgcggcttcagcggtttcatcgaggcggcgaaggcggccgccgtggagaaggccaccctccccgccgacctccaggggaaggtcgacgacgtcgtgcgccgggtggacgcctccgccgacgacctcgccgcgcgcaccaccactaactcccgcaagatccgcaccgcgctggagaccatgtatgtgtgagattttcttggtggacgccatgacctcgtcacttccatcatcaagaagatctcgtttgacattctgtttgccttcttctcgtgatcgcagaaggacaatcctcatcgttgttgccgccgtgatgctggccttggcgtttcttgggcttggtgagcataaagatttctttgctggttttggtgaattttgtcaaattcgtttgtttctgtattcgagtaaataattgacaaattcttgttcgattttggtgcagtgttctccctgtgcgggctgaaatcactagtatacacgtaagtacaacatcacagaacgtacatagacttgtatatagtacaaaatttttttttactgcaagtttgtaaccttcagttcttctgcagcttggtgatttttggatggattctagttactgcaacattcatactgtccggcacttttcttctcttgcacaagtaagttgttctcccttgttactgtcttgttaaatatattgcttgattaaatataatttgaaaaaaaggtgagattttgatattctaaaatggattgagtaaatttagtcggcaaaaaaaaacaaatttactgaagtggaatattctgcttctgaaaagttaaaatttttttgtatgaaccagacgtactggaacactttgcatctcagtctttacattgactagttacatgcttgtatgttataatgggtcaaccccatataattaggggtagattaggagtcggtatgtcggtgtgttaataggctaggtctatataattagagataaatgatactctttcggttctaaaatatagtaacttttagtttttagaattcgtttcaaaatataacaacttcttcattaacattctcttctcaaccaatcacaatactccaccgttcaattttcccacataccttcatttcttctccaatcacaacacttctccatttagttctatcaactttcttaataactacgtctaacttttaaaatatttatattctgaaacgtagggggagtattacttttcacgtacgcactgaacacgttaggacggtgggatgagaggagaacgactatattttaagatagcagatatcagttaaatctgaatcattaagacactaacacgagctctgctctgcttcgtcgtgctcgcagcgcggtgggcgacacgtgcgtggccatggacgagtgggtgctccacccgcagggccacacggggctcgacgacatcctcccctgcgtcgacgccgccgcgacgtcggacgcgctccgccggagcaaggaggtcaactaccagatcgtctncgtgctcaacaacctnctcgccaccgtcgccaacgccaacgtncccgcgtngtcgccgccgtcgccgccggccagctaccgncagtccgggacccccgtgccgctnctnttgcacccctacaacggggacctntncgaccgcgcctgcgccgncggngaggtcgccgccgccgacgctccgcgggcgtggcggggctacgtgtgccgcgccacggggctggcgccgtcgtcgaaggtgtgcgccaccacgggccgcctcacgccgacgatgtacgaccagatggtcgccgccgccaacgccagcgccgggctgacccagtacggccccgtcctcgccgacctcgccgactgctcgtacgtgcggcgcgcgttccaggcggtgacggcggcgcactgcccggggctgcggcggcacagcggcagggtgtaccaggcgctgctcgccgtgtccgtcgccgtggcggccgccgtggccgcgtgggtggcgcactcacaggagcggcggcggcggagcgagacgaggcggttccaggtgtcgccgtacaggttccccatcgaggagaagtcgctgctcaagagcccccggcggccgtaccggcgaggcgacagcggcaggatggcgaggtagaagaagacatcgccatggatggatggatggatggtacagtgtcgaacaccttgggacgctgccacgcgtgttgagcagtttaggatgtgtttagtgcttcgatgattattatattgtactgattaatgatctccatcgaccatacaggttatacattgtacagcttgaaatgatttcgtgaaagaagtgtgtagtttgagaaaatgcaatatcgtgctcgcccacgtcgagaagcactgcctctttggtttctaacatttcgccgatcctattcattagccctagacaacaaaacacaacagggtatccgattgatctggcgcccattgcgatgatcggaaagcagcacaccatggatcacacgtagaattgaatcattagcccaaaacatcgcaaaaactacgggaatcagcaacaaaaaataaaaagaatgcagacgtgaactatggatagtggcaaatgatctccacctaaaaaataaaaaataaaaaataaaggcgtcctctcctcgcagtcgtgccgcggaagattggaccggatcatggcggcggcggccgccggagacggcctcagaaactgcaggacccacacatcaaaaccctatcgccggcagcaggggacaccacgcgtcgagatcgatcgagaccaactcgcacccgaaaaatggcgaaagagaatcaaacagaagcagagagctcaaaatcgaacgcacatggcgacggcacttcgccgatcgccaccgccgcgcggtcctatacggagagcccgctcgatcggccgccggaaacctaaccccgcccccgttcgcgcgctcccatggagatggcggaggagaaggggaaagcttctccagatcgaggaaggcggcggtggaggtgcgaaaatttggactcgactgacttgtgggcctcgagcttttcggcgttctcgccaaatggcgtgggctctattgctttggatcaatctagacgtgggccgtagctggcaggacttggcccttttcgcgttcgtgtgatcacgggacaacgctgggctcgttgacgaaagacgggaaacccgtgacattcgggcctgttttttaagagctccaactcctaaattttgtttcaggagagttgggttttggagtgaaattgtggagcaggtctatactctactctatctctctagcttattttatgataacactctacccagtttcgcttagaaaaggtgggagctagagctggagttgtgctaaatagacccttcccatgtcagactcttagcaactcctctctttgtcttcgaatataacaacataatttgttccaaaatataataacttctccgtcaacatttttttctcaaccaattataacacttcaccattcaatttttcacctacatccacttcttaatcaatcataatcttttatcatttaactctaactactttcttaatgaccgtttcgaactttaaaaattcttacattcttggacggggtaataccgttttttttcagtagctttctctttacataatataataatgatagatataacgatttctttatccttttaattaatggtatgcctgaaaatgcgtagcaaccgtagcattttataagaagaaaaaaatgcattgctttttagggggaagggaaacgaacattcgtggtaatgtacgctcaacacgcatgtaaactggacggcaggatgcatcatagcggcaaaggcggcatgcagcagcagcagctagggccctttgtggatgaaagaaatgaaaaccccaacccccacccatatccaggagatgtagcgagcatggataatctgataatgctagaggccagattagggaccttaattagggacgggccttccaccataaattaatacatgtgtcgctcaatagttgacggaaatgcagctgtacgttaggagtatatataacatatccacaaccacagacaccataacactccatatttctccatctcatgagacaagaccggccacttgtactagtaaccaggttccataattcttcttgacgctttaaatagtaacacgatcttcgaaatatgtgtttaaatatatttttctattataatatatatataataaattaatacgtttttatttttattataatactcataagataaagagtgaattgtactttaagccacttttgtttacctaagtttcatttaatttggatcaccctctatctaatcttctcactttgaactagttttattttttttaccatttttcattttggactgtgcaaactctcttcgcgagcacaacaacagaatcaaacacactctcatggcaacaatattccctatttacgtgcaattcacatctttattaaatgagaggtttgatgttgctatacaaaagtgttagggtggtctaccgtaaaaaaaaaataaccattcaaaaaaaaatggtggtctaaagcacaacaaaggtaaaataaccaagcctaatgtgaaaagattggatagagggtaatccaaaataaaacttaggtaataaaaggtgattcaaaatgcagtttaccctaagatgataaatctatatatgatattggtttagtgcctttaataaactaaactagctgtgtggcccgcgcaattgcgcggctagcacctaaacaaaatcatatatttttagtatgattttacttaaaatttattaaatagctatctcattgtcttaagagtttgaaagaccaaaccttatcattcccgtgtttctaattatatagttttttaaaagtcacaccagttgctaccccttatgacatctccttctttatttgcttgttcgatctaccactatttctattcattcttcttggaacctttaaaaattggatcttatagtttttagagttttttttgtcacgttgggtttcgtttttataatttttaggcgtcccgtcaaacgttgctattatactcctctatggtccgtccactatctcttctctttattgtcattgagattttaaaaatcgaacataattattgtttgggttcatttttactttctagaagtcccgccaaaccgtcagcggctttgccattgtatttctctacggctcgcccgctgtctcccttctttattatcattgagattttaaaatcaaacatgattatcattgttttttttactttttagaagttccgaacctttaaaaattgaaccttgtagtttttagagtatattgtcttgttgggttttattttttataatttttagaagtctcgtcacacgatgccactatgctcctctatggcccgtatgccgcctactctttattgtcattgtgattttaaaaattgaacataactatcgttggaattcattttttatttcctagaagtcccgtcaaccgttggcggctctgcaactatactcctgtacaccccgcccactgcttctcctttttattatcattgagattttaaaaatcgaatatgattatcattggggtttttttttttactttttagaagtcccagcaatcaccttgttcgtttgcttcacggcctttctaccgtcccttgttttaatcgttattagtattctatttggtgttttattaacagtttttatatgttgtatcaaccgccaccactctactctattataggcctgttacttaatttatctcgtcatgtcttttagatggtcttttctttcaatagtctttatttttatcataaactttagctatttataaattgtattccaaattgaaaacttatttttcattttgtaattttagaatttttttttcaaattttaattaatatcgtattgtgttcttttaatatttttattttttattttcaagagaaaagcccgtgcgctgcaacgggtgacaactattttagtcttaattcactgtgagaattcgcttggatctatatatttctataaaatcataagctgtggttaggagtctgtttgtctaaagtcagcatgcgaatttttttatacgactcctatatttccaaaagcggacgaacttaaaaatcaactcaaaggatatatattttttcaaaagcgaacaaatttataaaccgactcatacacggatgacataccaaaataccgacaaaagaacatcttaaattttttataatagtagaggtttcttttaaaaaaatagtagaagtagaagagaagagaagattacggacaaaaagtcctttttcgaggcaatcgtacaggaatcggacctttttatttttttatacggtagaagtttttttttctcttttttttattttttcttgcctttttttctccacagatagtcggactttttttatggagtcggacgtttttttttacatagaagttctttttctcctttttttctgtttttttataccggcaaaaacatcttcaatttttaatagtacagatttcagttgtttcaaaattgtattcctacttgaactctcttttaatttttctaattttggatattatttattttttattctgaattttaattaatcacatattgggttcttatgtggattcttctttcaatattattttttttaattccgaatttcagctaattttaaattgtactcctatttgaactcttttttttttttgctaatttcggattttatttttatttttattcccaattttaattaatctcgtattgtgttcttatatggactcttcttttaatatttcatatttttaattccgaattttagctattttaaaattgtattcctacttggactatccttttttttttaattttagattttattttatttttatttcgaattttgattaatctctcgtattgggtttcttatatggaaacttcttttaatattgcttatttttaatttcgaatttcagctatttttaaactgtatttctacttggactctatttttttttctaatttcggattttattttattttttattttgaattttgattaatctcgtattgggttcttatatggactcttatttaaatattgcttatttttaattttgaatttcagctatttttagattgtatttctacttggtctttccttttcttttttttttctttttcttcgattaatgtaggaatttctagcccctacagcgaacgtggtgcctcctttcaaagttgttttaataatataatagatagatagatagatagatagatatagatatagatagatagatagttattgatagttgaaattataaaaaggtatcttaactttatttaaatcgtaaacaattatggaaccggaggaagtacgtccggtgggctagccgtgtgggccggggccgggccgccggccagcgttcgcgacagcaagtgcgcgggcgcaatgatcctctgggaagccaccgcgcgcgacgcccccgccttaattttgacgcgcctacgcacaatacaacacgtacgccgccgaagccgtacgtcgcgcgactctcgcggcacgcaagtctcgctcgcgcgcgggttgttggtagatgcgcatgggtggcaggatttggcgctgatcgatcactcgaaacacgggggctcacggtgcgcgacgcgtacctgcagctataagctagccacgggcacggaccttaggtgtgtgggtgggagacgacaggacaggcacgctagtaggcttaattcatctcacgcgtcatcgcttgactgcatgcgccaagtgaggggccttcagagcttgtactgctatcatgaaaaattctaaggaaaaattagaccgtctttagttcacccccaactacctaaaactttcaacttttcatcacatcacatcacatccaaaactttcctacacacataaatttccaacttttttttttaaactttcaactttccccaaacttctaacttttttcaggaactaaacacagccttaataacattcatacaaaatgtacatatcagttcgtagcattttagtacaaactcaactcacacgttgagatacacagattttttttatttcttaatgtgtaggtcaaatttaaacttgatttttagtggagtgctaaatacaactatactctatattatcttcttttaaaaaaattaagtttgtaacattatttacattggatttaaaagaagaaaaatacatgaatgacggaatccactatttttttttgcggggaaaagggaatatattactcctcacaatcaatgtgtgagatgaaattacaactattcttaggccaaaatttagacatagactcacatcgtgccttatttgctaaggtatggcttacacgattttggttacgatggcccttgacaattctaatctccctatttccagctaacaagtctttcacctctcggacaagaaaagccaggtctgatttatccttttcctgtgatttgatcatgtgaatagccaccaggcaataagtttctacgatcaacggccaaagagtccattgcaaagccagagctattccactaccctttaatatacgatcatacaaaagtcgcaacctatatgtgttgttaacatttactaacactagtacgtagcactagggtgctgtttgactctcgaattctactagtatcttttattattctgtttagagtatatatagcctcgagaaaatagtacaaagtactacgcaattttcagaattatgaaactcagaaaggtaagatctttttcagacatcacgcatacaaaaacaagcttgcagtagagcggtagtagcatttgtttgacgcagctaggatcaccctaagattccaaccactccctgtttaccaccacacacaaactttgtttactgcacacttaattgcccttttacccatgcctaatgacctaatcttgtgacctttttgaacgctcatagccgagctatagctacaagacagacaagaaaaaggtccacatggagagattccaaagacttgctcagtttaaatttctccccctatacatgctactccataaatcccaaaatataaaaaaattaagttgaatttgacaaatcctaaaaccatgagtctatacagtctcttgagatatactccctccggactgataatacttgtcgttttgaataagggtgaggtcaaactttagaatatttgattatcaatcatttttaaaatatttatctttcaaatatggtgactacatgtatagattagtcttaaaatgtattttaataagatcatatatttgttaatatttttatacatattataatagaaaataatggccgaagttttttttttttgagactatgccattgtccaaaacgataattattatcaacccggagggagtagtactaggatggtataataatactgtagtagtatcagcaaataatactacatcctttcatgtaatttatggcctctctctgtgattttattactgccaatccgacgtgaacgtgtagtaacagcaacagtagtaacaaacatgcagtccctaccatcttctgaacctgccacactttgtcaccgctttattcgcgtcctttcagcatttacgtatgctacctgaccataccatgccatgcgtggtccacataacacatcggccatcatcctgcctccatatcgactctcaagtagtgacattattacaaccaaaaagaaaagaaaagaaaatctcaactgaatagatgagattaatttaggtcttaaatgaaaccatcacgaacttgaaccataaaggccaatgcaactaatgcaagtgctcatttaattaacaaatactcctactaacaaacatctctgcactgatacgcggtagaagcgaaagccatcagatatcgtatagtactcccctttttgcaggggcatgcatgtgatgagcgatttgcatcggatcaggctgacagctttggcgtttttgtgtctccttttggcttaagatctactacttctacacctcgatcgatcgctgctgtccagtgtaccagagttcaaatggcctatttgagaaaggttacagtgtaacaaagtttaaatgacctatttaagatagtctaaaattctgagaagttgcttgttagtaactactccctccgtttcacaatgtaagtcattctagcatttcccacattcatattaatgttagtaaatctatatagatttatacgtttagattcattaatgtcaatatgaatgtgaaaaatgctagaataacttacattgtgaaacggagtaagtagttctttttgtcaaaatctgcgtgaaaagttagattgtttggtgaagtttctgattatgtaagaagccgcaggcctgcacctaacagaggctccccgaaaccggtccaaagacccaaacggttgtgttggatcttgtagtcttgtcaagaaaccggccaagccccatgaaactccaaatagtataaaaaaaaagtcaagatttgccttaaagatataaatacgagcccaatttatttagtagctgccattgcaacgatgtgcagtaataaactagtaatagtagtatagcatgtgagccgagccgtgcagctgcagctgcatgcttcttcctccttcgctatatatgcagctgagctgcacacacgatgagcagtagtagtagtagtataatttggtagtagtgagcaagtgaaactgcaagtgagctaaggtgcaagaagagagaggtggagatggattggtacgcgtggctggcgaagaccgggttggcgccggcgctggcgtacgagtacggccgcctcttcaaccagaacgagctggagcgcggcgacgccgcgcacttcgaccacgacctcctcaagagcatgggcatcgccgtcgccaagcaccgcctcgagatcctcaagctcgccaagaaggactcctcctccgccgccgacgcaggcggtggcgactcctcgtcgtcgtcgtacgcgcagctgatcgcgcgcaaggccgggaggtgcatcgcgcggtgcgcgcggcggctggcgcgaccgcggggtgtcggtggagggagggggtcgtcggtgaccgtggtgccgaggatatgcagcggcgacgacgccgtccgcgtgggggcagtgcaggcggcggcgacgaggaggaggaggagcgtcaagaagatggtgctcatgatcaccgacggcggcgccaccgccgcgaggggcggcgtcggcttcgccgccggccggttctcggggtcgcagaaggcgagcctgatgttccacgactgctacgaggaggaggacgacgactacgaccacgaggaggaagcgcggtgcggcgacggagccgagggcggcgacgaggatgccgaggaggaacggtgctccgacggcggcggcggcggcggcaccgacgtcgagatcaagtgggactccatgttccaggacctgaagccgacgtgattgagttgaggcaatttgattaattcgcgagtttgtgtgtagctttttgtgagagaatttttacatctctctttgtggtgcgagagcttaattaggatggtaatgtgtacgtgtctatttgccatgagtttagacgataataatatcgagcgcaaatgttttgagtgagattaattgaaggtcaaaggaatttagtgtacgcgattgatcgaatacccactgcataactatgaattattttttcaattttttttagcacaaggcaggatctctgtcgatcaagtaaagttaacaactgatgaattctctctcgttcccggcaattggctgcaagcctgcaatgtgctacatgcatgatttattacgttacatattcatggctgttaacgtttgttcatcgcaagattatgcgaaaagtaaccgctgaattacaaggacttgtctaacaaacattcgcatgatttgtgttcctcatgagcttaaatagaacttcaggatgaccgacaaaggcataagcttgtcccctcttaaccagttaacattgcacagcagacatcgttagtactcctatataatgatgtccgtcgatgtaaaggcgctattattttagactaaaaagggaaaatgccatggcatggacttggatgacaccaatctgttggaagaaaatagtatagctcgaaatatagcagcagttgggggtacaatcgttgggtgaccactgaccattgcctacttggtcaggctctctagccagcgcatgttcaaatggcaggccagtatcactggcaaagctactgaaaatgacggttatgaattatgatgctgtccaacagaacggccagtcacgtcaatgcttgacagagagaagggccccacgagggtacgaggatatatccagcttggtaacaacagacaggcatagacggcacaggattcccttcaaagaatgacataaaacggaggtgaaatagtttggacaagttcgatgaatttctccaaaatattcccacttcacacacgtcaactcatattggtgtagtaaagacaattaactgaatgctttaaccgctattggcacaattaaataatcggtgtgtagccacatgaacacgggtgtatcagtattcagtacagcatacacgagttttcgattagaccattcaatatgatagtacccctttcattctttcatggcagatgaaaccacatacattgctttgtgggcacaaatagaatagggcccggggtaaaatgattgcagtaaaaaaaaagataaatcactcaaaattgggatgcttgaaagaaaaatcaagaacgagtagccaggtagaaatctcctgtactaagaaaaacatgttttcccagctggagatcaattggtgggaagccttcaatgaaatccaccgtaatctgtaagaacaaaggcaatttaaggcatgaagaacaagtattctgaaaaaagttcagtagaagttgtagatttaccttgccattcccagcctggaattcattcttcaatctggaaatagaccttgacagtaaatatacttttaatgcatcaaaatgctcacggttgcctgttccatcaaagtagacacttatgttaccatgcagaatataacaaagagaatgccaagacattaacaacgaaaatagacaagtacaccctatcagataaggttgtatttaccagcggcatggacaaggagatcatctgtgaccactggagaaacccttgcaatgtaaatgacaaacgacatgtcttgtacattgtgagactcctcacagatcattacctgccaaaccagacaaatgacaatgagattaaatgttttatatccatttcaactcgtgtcaacaccaattggtggtgatgatagtgcatataacttggtgttcatgtaagaaaaatcaaatcctccaattgatagagataaaagtcagttaacagtaaactgaaacagggagaatatccaaactcactgcatctggtggcgccgccatctttggaattagtggattgccaagagcatcccttatatactgatcctgaacagaattacagtagctttcattaaggatgttctgatttatgaaacaagaaccaattacttatgccaatttagctgacctgtgactgcacaatctctactagagtattcttgccatcgtccataggtttgtaatatacatcaactaagtctgtcggctcaagttgcgctgtctttcgtaacttctggattctgttcacaacctggacagaaatgctcaagaattattagcccagatcatgaacatcaaacttatgactgacaacagagaaaacgtatgcaatcaaacagccgctggaagttcatagcaacatgaagtcagacatgacataggtcaggtaaagattaccaaattcaggcatcaaccagtgcaaaaatactactaacacataattctcagtactccagggtgtcatacccaggagtacacaaatcatatagttaattacctctcgagcaactccagcttcaaacaatgattgatcagctcgaagatccaaaacgactaacacatcacctacatgaaaaaaaaagtaatgataatatgacaaaatagacagatagcatacaaactactcatatggaaacatatttgacataccatctcccgcagcatcaatttcattctctgccacatttgcaggacgtttaaattgccggatcacctagagggtaaaatgtttcagagaattaaagatgcagcaggttggaaaaataagtccactaaatgcaaacctgtgcaaactaaagtgtagcatcatgtcattcatcatgatgatcagaaataatgcccccaaaataaaacaaatgtcaaatctaatttttagaataggtgtgcttgcaaaccatttgctagacagatatgatctggaaatgccaaagcagaacttggaaatgatgtgtttgtattttacaatatatgtaaaaagcaaatcaatataatcttactaacatatcattctgagaacatatactagcacaattaccaaatattaatcttcaaaactgacatgcaagcaatcatttaaacctttaaattaacatccatcagaagcatggaatgttaccttaatatcgtctaacttcaagcaatgaccaaagaatgaaatttctccactttgttcaaaggctaagatctgttcctgtgtcattttcttcacttcatttgacactttgcccatgtcctttcccagtctttttcctagcacactaagaaaataacacaagtgctgagcagtagataaaaaaaaatgcaaagtttctcacgctattaggtacacatacctaaaattgggttctgcccggagagaagcatacaacatgggatcattacatggagtgacagtcttaacattcatttcttccatgacatactgtatattggaaagtaaagtatgtcaagactcaacactgaagaaacatgtccatttataaaataaacactaagtggcaaatattgaagatgaattgatcaatctcgtattctcattgctcaataatcaagattatcaactcctagaaatatgggcaagcagattccttggcaaatattgatctcaggaagggacatgccaacagtgagaaagcaatgaatatggaacataaaagtgtacaggagactttggttacaactaattgcaaatgcagtcatataattccataacagatgacttataggcactgctgacaagtacttataaacaaacctcttttagctttcccgttatgtcttcaagaaattcattgtcaggatgaacaatcaccatctccctgaaactcagattggttaagccatatggcaaaattgaagataatatacagaacaagcttttatatcatgaagcaaaaggaataccagaaacaacacatataaaaatataaagaccatctggttttcaacttcaaccatcttaaaaacataattattgaaaatagcatacgtacttttacgcccatatacacaaaaagatgaagaaagaatgtaaaaccgaactaaacacctaaaacacttcgatgttatgacaaccaaaaagattcctaaaatttcatggccatcgattatcatttcattacaacaaaatgtgtatcacatgtcaatatattatacaacgtgaaattttcaatttcctaaacgaaatatctctagattaaatcattaggaaacaaatcatgagactatgaacatacttcagtggtgttttcaaggctttgttatgccgttcacgaatattgcgggcaagatcaatgatggtcatcattctgtttacactttgctcaacacgctcatctctctgatcatgaagcaaaaaaaatcaacatgaagtcacaagtaatacgggtggaataaagcatagtacaggtttagataagaattacctccccagttgtggaagggaaactgcagaaatgaatactatcctctggtttagttgacacctttcgtaggttttgatagagagtttcagtaaagaagggtgtaaatggagccatcgccacacaagttgttacaagtgcctgcattcatgattaacaaaatgtctttgtgaaatactacaaagtaccagcaaaacatacaatctaattaggatttttttaatgcatagagtacccccaaaatattacgtaatagatgctaaggagcaagaaaagatcatttcaggaggagttgggaacttctccgccccgcgtggataccaaggcgacgcattagcgcatgattaattaggtattagctaaaaaacttgaaaatagacttatatgatttttttaaagcaacttccctataaaaaatatttgaaaaaaacgcaccgtttaacagttcgggaattgtgcacgtgaaaaaaaagggagtagaagttgggaaagggtagcgtccaactcagcctgaagctatttcacttatcaaaattaagaaaaaaaaaagagaagtttaatagcaacaagattatctgccaactggataagcattatacgtccagaaataaaggggaggtacataaaagatgatgaagactccttttggagttctcagaggcaggaagacatgaaaatgtgaacatgagatattgagatacatacagcattgatatttttattctcatcaatccataaaacaaacttaagtagaaacagtgcactgcacaatatatacttacatggtagagcgtcgaaagagatactctgcagtcttcttccccagtacgtccttttaaccgtttacggttgaaacgcacatatatattagtaagattgtcgatgtatttaaccaaatatggcacaacctgcagaggtaaataagataaaactttacatcaagtaaccataacatgaaaataaaaattgatacatctagcaaacaaatattctaagagatctgttaaacattcaaccgtgtaaagccgatatgcgtccatctcctggtgaacaaaactgactagactttcagttgcagagtttatccagtgatctagaacatttgatgacttcagaagtgaggcttgatctattggagaaaatgctgagaatccctcaatttcaagtctcttggcattttgtacaagaaatctatacgcattataccacggcaggaagacatctttcacctgttcaattttaaacaacacaaatttgaagcaatgttattttcctcagaaagacagatagtatccaatatactgagaaaggacacttacaacaccaaaaacaccactccttttgaaccgtagagactccgctcgtacaactggagaatttatcaaatacagtctcaaagcatcctggaaataaaagaaaacaataaatta

SEQ ID NO: 19427 - DNA, 846 bp, Oryza sativa
  unsure (1)..(846): unsure at all n locations
agagactccgctcgtacaactggagaatttatcaaatacagtctcaaagcatcctggaaataaaagaaaacaataaattaaattgcaaattctaactcagacataccatgcaattgcaagcctcaagtcattgcatgtgtcttcagacagaaaatgatacagaatatacaataaagcattcatatctttaaaaatatgccacataccgctccgtattcatcgatgacttctacaggtgaagggtaattctttttactcttgctcattttcttaccatcctcagctaatacaagaccattgcatatcagatttttaaatgcaggtttcccaaataaagctgttgataacaccatcaaagtatagaacctgcaggatgacatcaaaccataaatatgatagatataattaatgaatatgcatataacaaagcatcatacacattttagaacacaatacacaaggattccactaatatcattagcaggaactgaatttagtttttgcccaccaaaatctcataaagtaaacgtgataaaagcacaagcattacagaattcttttaatcaacaccagatcattgctaccagttaacccagataaaacataaaatagcataggatactgttttttctcccaaaaagtgtaaaatattattgaagaaagaaaaaactgctatcaaaactactacagacaatccatggtcaaccataataattcatgaataacatcacatgccttctgaacaagcaaaaatgaattcaaggtaagtgtaactaattnnnnnnnnnnnnnnnnnnnnnnnnnnnnnnnnnnnnnnnnnnnnnnnnnnnnnnnnnnnnnnnnnnn

SEQ ID NO: 19428 - DNA, 11426 bp, Oryza sativa
atatacacaagcattcatatctatagcagttcagacttcagaggcaaaaacgttcacatacatcacatgtataacaatgcaactaaacaagcagaaatagcgagtgaccttatggcattcagcagttagctactccctttgtttccatttacttggtcattatagcattctttttttttttgtcaaaatacttgtcgttctcacattccaaagcatttttagatacgtctttcccttcctacctttcatcaatgcagtcatactagtactagcactcctcacaaggaattttaatgcttgctttgggaaagatgattaggatgtaagaattaacgatggtagcaatgtaatatgctacagcttctagtttagtgtgagatttgctagagcgacaagtaaattgaaatggagggactatttgtacataaactcaaagacttctaaatgaacttgagtcctacagagtagaaacaacctaagcaaaaacaaggtactatttaatgctacatcaatttattagccaataataagacaaattggtgcaatcagacacaaggatttctcaccaaaacagtttcactgatcctaaaaagaaaaggtaattcaaggaattaactggtacaaacataactaaagaatattggtgacaaaaactgtgatatatttcaaatttcactcatattagagatcactaacagtgacgcaggagtagcactcacatgccatcaggtctattatctcaaatgggcaacaattagacaaatgtgtgcactgccacaagccctaaaaaatatttcaaggacttcgaccaatatggtttaatcctatttcataagaaaaatcaagaatagtactaaaacataactgccaaattgcatccatatttagaggtcactagaaacgatatttactgcaatagtaggaatcctagttgtaggtataaaatacaaagcaatgacttacatcctcaactcgtttgagcaccccatactccggacctctgctagagggaatcgtgataccatcaacatagtgtcggtgaagatcattaacctggtcatataatttcagaaaataatttgttcaggacatgcagaaatagcaattgattattgaagggaccaaaagcaatgttgaccaagcaaaagagaaccatatgagaatataattactgttttctaaaaaaaatatttgcaagagtggatcatagcatagtagagatatcaaccttgacaccagataaccgttcaagtttctcaatggaatccataacaacaatttcttcaccatcttggctgatccacagcggtagtggagtcccccagaatctacttctgctaacagcccaatccctagcaccttctagccaattatggaaccgcttttcctgcatacatttgttgttaacaaatatatcaagttaaatataccagctgataacgtaaactcaacgctcgcaacagctgctaacgtaaactctgcaagtttcatattaccagttcaattatagacattcgatgcaaatattgcaaacaataaatggtaagacatgaaacagaactatcatagaaaataagctatcaatgtcattgatggcaaatctaggtgatatgcaacaaaaaccagtgcaaaccttatccaattttgtaatagagcattagctaattactttgtgtgacaaacaagaaaagatagagtaccttaacataatctggaacccaataggtctgcttgttacattccagcaactggtccctaatcttttcaaccttcacaaacctacagaaaagctctttcaggcatacatttctcaaataaaaacaggtaatggaacaggaaaacaacaatgaccataaaagacagatgaacaaaaccaacaaataggaaccacaaagattcaaaagaaagccacattcgttcatctagatggaattaaaacatgatgaagttaaattgaagtaacttctactatctccgtcccaaaatatgagttttggggttgtacacgggtattaagaaagcaggtgaaattaaatggagagaaggttgtgattggttgaaaaaaaggaagtaggtggagaaattaaaaggtggaaggttgtgattgatttaaaaagataatgtaggtgcaaaagttgttatattttgggacaaattttgaatgttagaagttgttatatgttggggcggagggtacatcatgtacatgtgttacaagtataagatggactgcattaccatttgtgctaaacaaccagatggatagagaattatatataactcaaagggtaaagaagacaccgactaacaaatttgcatggtagcagcagtagatgcttaccagcttgggacagcccggtaaataagaggagtgcccgagcgccagcaaaatggataagagtgttcaatgctccctttactgacaagtcttcctttatcctgttcacaaagtttataatcttcagaatgacatcctcagggatataaaactatccaacatatgcaataaatatgctgctataatatcaaccaaaactgcttatgagttatgatttacgaaggtgcaatccacagagtgcagacatacattgagaaactttatgctatacatctgatttccttttgtgtgcacccacttcaaggtcatccagacaattaacatgataatgcataaaatgcacatacaggtcctgacattattccggtacatactagcatgagaatctatataatgcaatgtcctacggcactaatttattaatcaaatccaaaatctatagataatagtccacataaacaagtaggcaactaaaatgtaaatgtgttacatacagtaaatggtccaaggaatactgaaacaacagcttaccttaacagagttgatgatatccctgtcagcctctttgacatatcgcccactgaactcagatatcttttcaatgaagcagccatcatcatcaacggcgacaacaagcccactggcctggatatgaaacagacatcaggaaaaaaactggagtaaataaaaacaaatccgcatgactaacccaccataaactccctcctctaaactcacactccctttcccaattgttgccaaaaaagcccttagataatttaataaagcttgacacagaaaatatataaaagtacatattctagactacaacacaaagtaatggaaatatggagaatatgcatatttagtagattgataggtcaactgtctcaacctccaaggtcttggcagcatgatagttagtttaaatacccaaacagtaaaggagaatttttccaacctcaatgataccagcagcaagacaaacacggtggtcatcttcaccaaaagcaggagcacaatggacaacaccagttccactatcatcagttacgtagttatccgctatcaccctaaaggcagtctcttggagctccaagaaaaaatcgaacagaggtttgtatctgcaagtaggaaaagtaacagttaaaaacaggaagcgccccagatatatactccaaatttggctatggcagtatggcatgttccgtattgttctattaacatctagaaaacaagtatcaggagtaatcaactaagcttttttttaaaactgaaaaacagcaggggagggcccgtggttaagattttattaatataacaacagacaaaagccaaaaaaaaaaagaaggaaaattgcagattttggatccaatcctctagtgtataccaactaagcattactgatattaccgcacaaaacaaagttcaccaattataaaactaaactacacaagtggtacacattgtttgagtagcaaccaaaatgatctctccaaaagcatagagatatataaacgttgcatgaaaaattcaaataacaagtgatgtggattattcagccctgcccagaaaaaagcaagtccaacaaaaccaaacatggttaacaacttaaggaaaagcatcatctcacacacataactccgatatctactttcagaaactgttcactagttcagtgaaatgcttcctagcacagatagtgttaacatgcatttaactttcataatgtcatgggaaactaataataaactatgaaagtattatatgattaggaagacagagcactcactttaggcctactaaggatgatcctggaaactttgccaataattcatatgcttcagtatccaatccaccctgaacaacttcagcagtgcctcccttagaaggtgcttgcttctttccagatgatttagccttggctggcaattgcccaagcctagattcagcaacaacatacactgctccagttgacttgtccttaacctgttcgcaacacagtacacatcctcaacagaagaaaacatcaacttacaagcagagaagggtgacagttgtatagtttttttctgactaaatgaatggggtggtctagacatggagcagaataggaaacaatagtcgataatgtctttcttctacaatcaatttgatcgatttatcacaaaaaaagaaataagtaatgcaagaatgcatcattaagttaaacaaaaagggtctaaaatgttttttcgcaaacagtaagaacagggcagttgcagctgctagattgactggtacatggttctctatactgataaatatggattaaccggatgcagcaattaaattatttgcgggaactgggaaactactataagatcccaggagatatccactaaaataaggacaagcatcatgtatgtgcagcaaaatgattataggataaacaagacagccacttaatgcaatataacacagaaaccaatgatctattgtgtatagcattatgtatgcattagtttacataacatccagagttcaaaacttctgcacattttggatttactagcgagaagattcctcaagagtatttcactggtttttttgcttaatatatcatcagtgaaagttctgttccttgtaaaatcaagttttgtatgtatgatgttaacagtgggtaaacttgacagctatagtctaaagttaaagaatggaaaaatagcccaaggaaataaaggagaagtactaaccttgacatacacaagattggcattgacacacaaggctaagttgcttggaagtgtccagggagttgtagtccatgcaacaagtgctgcattgtccgcatcaccgataatagggaaagacaccatgattgctggatctgggacagtctatggcatcataaaaagaagttactacaaattgcatagaaaatttatgagctacgacatgaacaaagtcaataaccaaccctatagtcaagtgcggcctcaaagtttgatagtgcagtcttgcatcctgtactgtaaggcatcacctgggacaagaacaagagcccaggacactttaactttcaagaaattcctcataaaaataaatccattaacagaaacaacagataaaaaccaatcaattatttcatgtaatcacaatagcattatctacaaaatgaaaagccacttccatgtaacctaaactctgctattcattcttctcattgagacataccagaacaattccattctccacacatataaattccaaattctaataaaaaatacagttaaccattgcatacttctgaataccataaaatttcaggttccctaccgcctcagcttgtccactttgtagcaactaaatcataataaatatgcaaagcaaaccccgagactcaaaacctaatcaggcgtgagatcagaaatttaaccttgaaacccttgtagacgaggtctttctcccagagctgcgagaaaacccaccaaacggactccatgaaatttatgtccatggttttgtagtcgtctttgaagtcgatccacctccccgtgcgcgtgacgacggcctcccattcggcgacatacttggtgacgatgccgcggcaggtctcgttgtacttgccgataccgaggtcgaacacctgctgccggttggtgatgccgagctgcttgtcgatctcgaactcgacggggaggccatggcagtcccacccgaagcggcgggagacgtggcggccgcgcatcgactggtggcgggtgaccacgtccttgattgtgcccgcgaggatgtggccatagtgcgggaggccggtggcgaacgggggcccgtcgtagaagatgaactcctcgccgcccttcgtgcggcggagctgctcgtggaaggcgtcgagctccgaccacagcttgagcacgcgctcctcctccgcggggaaggagaagtccttcccctcgcagacgtcctccatggcctccgctcctgaggccgcgaccccggcggcgaatggggctagggtttcgggtgaggcggcgaccgcggcgaatggggctagggtttcgggtgatgaggcggcggcggcggcggcggcgggggggtaaggggaggaggggcttggaacaagagagggggaagggtttagagctggaagttcacgtgctgcgtgcgtgcttctccttctcttcgctagaagggaaattttcatttcgacacctctatttgtcgcatttgtacaaattgctctatttttatcgtgttcagtttttgctaactcaaacatgccgtggcattgacgagaaaatggatatttggccacgttcaaaaagcggcttagttggaatgccatcctaaaaacgtgtttcactaaaatgctaatatgaaacacgcaatcatagccactttgtcattttctctattttcgtcattttcaattccattttcgctagaattcagcttgatgagaccaaattgcccctgctcgtcggctgaaaggggatcgagatcgagcgcggcgaggtggtcttcgttgctgacaagggcgtcgacgatggtgtgggacggggcgaggccgagcttggcggcgagtgcgtgcagctggcggccctcgaggagagccgagaggaaggccgctgcaggagcgcccggtgtacgaggtccacgcggcgggatcgcgcgagtgagcgttggaggcggacgaacgaggagtgcgaggtggcgtcccgatggtgggtccacgtggccggagcagaggaggcggcgagcgagagcatggcggcggcggcggcgacgacgcgcagcataggcatggcaaggtccaccgccacttgcaactcaccggagctcgacaagattggggccgcgggcggtggcagtgggcaacgtaacggtggcgccgcatggtggaggcggtcggtggggacggcttgaagggagcggagcaggtggaggtagtgggagattgggccggtggtgacgacttcgtcggtggagccagtgagaaaggccgccgctgagagccaccacggccttgggcagccgcatccacagccggacggcggcgccctctaccaaccacttcttcgacgatgggcacgggcaacggcgcgacctccggtgcccaccgccgccaccttccccgacaatgacgagcttcgactgagttgataaggggcaattttatctcatcacctagtagatgagagaaaatcttttcgaaaatgaataaaatggcaaaaatgccaaagtggcggtagacgcacgcttcatattggcattttatcgaatcgcattttcgggatggcattctagcgaaaccgtgttttgaacatggctaaatatccattttctctggcattgacaatcccaaattttcgtaagtaacaacataaacatgtctcaaatactgtaacacgtcatatgataccaaaatttaccagaattcggtaataccaagttttagcatattttgctggtaccaaattatacagtagcattagatgtatttaggttgatctcttctcaaacttttattatgatagaagtttctgagttacaatgtagcattggtaaaataatctttagtttatcatgttgtatagttatatcttatcaattgttggcattaaaaaaatggcggggttagttttggcatcaaactgaacacaccctatattagcaaaagggtgccctttcacttggatattttactaacagcccatatcactacagaatcgtgcatatcgaactcctcaaaattgcaagaaataacggcacagtgatgcgcgataccatcatctcaagtccacaggatattaggatggacgatttttagaccatgttggatttggattaagtatggtgacgtatatcacgataaaacaatggttaacggtgaacaattagtactgtgctagctgctttagaaaatggcattttgggctatgtgtcagtactataatccagctcgactttttatgagtttttgtttttccaagtcattttcattcgtgttgtcaccttgaaacgagacagaatggctaatcttgtttgaactctccgtatatacattgcaaatacaataggagcagtgcatggtgtttcgtttcattcatgcaccatttcacacattgtatttgatatttgcatcagattgctacgaagctaagaacaatcgctgcattcctacatctacgcgcggttagctcgccggcgtcgcctgcggcggcttcttgatggtcttatcgctattgtgaaccatcagcatctcctgcaccgccgcggagagcagcgactagggccggttcaacattttaaagggccctaggcgaacttcacattatagaccctttagaagttaagaagttaaggctattttttaacttgtaatatctataaagcatctatactatagtaacagaaataaacatttctaacatgttaaataataaatcaaacagtttgcaagttgcaatataacaatttgttctcgataaataatatcgatagtatgattgataacttaaaaaacacacagtagaaacaaagtactatgacctaaaatcagtgagggaaaaatgtatataatcaagggcctaggcctaatgaaaactgatccaccatataccttaatttaattagcttatggacttatggtgcactgaatggttgtataatctcttgaacggttgaacccagaacggtagaaccctaagtccctaatcttggtaatttaacggggaacaaaaaataaattagaagaaccgatcaattctaatcagtgagaaggatcgatggattggatcatcaattctaatcagtgagaaggatcaattctagcctattgggctaaatatctatacaggatccccccattttagcttggccctaggccatcgtccttatggccctactccagagctggccctggccagcgacgccgcgctcggcggctgctgctgcaagccgtgaatagcacccgccgccgccgcgtgctccacctccatgccgagccgagcaaccgatcacgttcctcctcctatctcgcccaaaatctcacctcgcttcgctgctctgagcacgtctgcgctgcaatggcggcgacagaaacatatacgtaggcgcgcgcgcggccatcggctgccgcacgcggcgccgcgcccagatacggcggttcagcggtggattatccgttttcgcgggcggatggatcagggcgcgcggcgttgcggccggtggcgcgcgcgcgcgctcacgcggaggcgtgccggaagttggctgcggacgaacactctgcacgcggcgcggcgcgtcgcccgaacagcaaaaccgcattcacgttaattaccgttctttcatcaccgagctaatccatccgctccacgttaattaagttgggtttcaaacacgtgacgcgtccctgaagggaaaacgggtttaccctgggttgagaaggccaaattgcagggaaaaaacaacagccgcgattaacaggttaaaggagctctaaagcagttaatgtggcactgtatgcgtgtcgccgaccgccgctgacaacatgtaacctccttgtaaccttttcaccccctctgctcgaccaacgacttgatagccacgaaactttgaaaataagaacagcccttgccttgagacggtcacgtacgtcacgcagcccacgctcttcttggaagcatctcgccatgagtgccatcgccgccggccgccgtcgcgtcaccatgccgtactacgcgctgttcggcgaggtggtcatggatgggatcgtccgtgtggaacccatgggagggttcgacggtacagccactgcctactatcttcaggtacatacgaataataatcgatccctttctttccgttccaggatgaactccctgtgtgccatgtcgtcgttggtagtggtactgattcgtggtagttttggggctgatcaaagtgttagtttgttttaaaaaaagatttggtgtttgatctgtcttaggagctgtttggttgggctgattttggcccgttgcatctctttctttccacaggcctagtagaaaaaaaaatacgaagcgcgtgttaaaaaaaaagttgcgaagaacaccctggccagctgcttggattcgccgcgtttttctgatggattacttatctttagcagaaaaaaaaattgttcacttgttcatatgaatggtagtagtagtttaatgtattgtgtgctgtgggacgtaggattctggtggattccgttacttatatttagtaccaaaaatttagcagtttaacaaaaaaataatcaacacactcacatattcaaccttctttgatctagctgttaagctaattaactggaaccatttctattttgcattctccaataaaacatcctccttataggttaacagttaattaggtggtaatatttgtttcatttgatctgcagttgacatgcgacgtctgccgtggggagactgccaaggagatctgtctgttcccagatcacccctgccctcaccatctaggtcagatggcattcgtgatgtgctatccgacctgtgacatactgtatggatgcattttcttctttcatttccatctgttagttgtggtttctaaatttttgcttccatctgtttgtttgaatgtagtgcaaggactgtggctccctgggctcagtctccctcatacccggcaaggggaaagccctcacccctgattccaagaacatggtgatgttaatccattgcgatggacacatccctatcgctttcagcccggcaccctactggattgccaacaaggtgaagttcagcactttagctccagaaattttggtttggctgtgtgcgtccgattagacatagaggccgggtttatctcattttcttaaaaaaaaaagctccagaaattttgatgaaatccattgttcactgatgtttctctgttgacaggtcaatggggatcagcatgagttgcacttctccaaggatgggttcgagggctacggcgacaatgatgagctgattctcaccagtgccaagttcaccgtcgagaggctgaagaaggccgaggtgccttaagtacatctgaggtaagtacatattcagcggat

SEQ ID NO: 19429 - DNA, 3688 bp, Oryza sativa
gtttggctgtgtgcgtccgattagacatagaggccgggtttatctcattttcttaaaaaaaaaagctccagaaattttgatgaaatccattgttcactgatgtttctctgatgacaggtcaatggggatcagcatgagttgcacttctccaaagatgggttcgagggctacggcgacaatgatgagctgattctcaccagtgccaagttcaccgtcgagaggctgaagaaggccgaggtgccttaagtacatctgaggtaagtacatattcagcggatggtttccccaaatgtgcaatttcttttgcatttttcctaattcatctccttttttgtcattggtgcagaaaatgtcattcaaatggcatattaaggctaaagacagggcaaatcatagactatcacaagtggtcattgagaataattttttgtgcttccactgagcatttgtgagaggctggaaagcgatgttatctggatgatgaatgatatctgtcctttcttttggtgtttgtcatatgctttcagatctaaaaacttcgtctaaaaaaataacttctaaagatgaatctaaacaaatgcttgtccagattcatctctaaaaattagtttttttaaggacggagggatactccacatgcctttgtttctcggtttctgtacacatataaaccactaccatcacactcccctcgtttcgcagccgtctggtaaggccgacagaaaaggcccatccttccatctcgacttcggtttggtttagtttccaactttttcttcaaacttccactttttcattacattaaaactttcctacacacataaactttcaacttttccatcacatcgttccaatatcaatcaaactttcaatttttgtgtgaactaaacacacccttcgattatagatttgacctggtagaatcctcaaacaaaaggcaggtattagcaagatactagtataactgaataaacgttctccattctactatcctgcatagtaactgactatatgacaattgacagtcgaaattggaagccacacgatcaaaaacgaaggatgaaaggtagagccaggtatcttgcaaatttgataggtgttgtctactgtattgaatacatcaggcttgttgtttgttcatatgtgccaatttctcataatcttcataaattccggccggcatcgcccagtggaaaagaaaaaaaaaacaatccagtccatttccttgtactatggcccgtttggcaattgctagacccaagtgccttcttgaacgccacagctagcctacacagacgcaaagaagaatatacacaaatacatagaaacaaattacagcttaaagctgttaaactgaaaaccactaaggagaccataaattttattatgagaaattttaccgtccttaaaaaaatatttgaggtacctaaattctacttaaaatttttggtaatacctagtatctaaaggtactaaattttacactagacaatacaatatggtacctctggtatcttctcaagaatgataaaattactcttttattataggtaccgtaaaattttgcaactcatgttgttagtactcctggttaacttcaacgtagaacaacaatcacgtaaatactagagattaactatataatcttaaagatgaaaaagccttaggaataacaagtttatatgttatatagttccaatagaaattcggcagaatatttgaacaatttagacatgaacataaatgttaataacaaagacaatatagttacatcgcgggaatggaaaaacataggaataggaaaaacatagcattttgataggaatacaagtataaaacagaggattgcaaaatacaggaaaaacatagaaacggccatttgattaggccgcaggaaaaatacaggaattcgaggagagataaaaactcaaaggactcacaaaagatcatcgaagcagtcgagtctgaagaggaagcggggagggtgctgtcggtcgggagcaggaagggcgcgagggggagcgggcagtcgggactggggcagattggcaggaggaaagcgtggccggcgacggcgtagtcgctcaagaggagggcaggaacgcggcacgggggaggcgggggggattcagtgcttgctggcaaaatttaataatagtttgatcctatcagatttttgatagccgttcaagaaatttagttcaaagtcttttcaaaaattggtagcagtctttatgaaaaaaaaaactttcaaaactacccgacttgggtaccatagcattggtattttggtaacattatgtttaattggttatcctatcaaaacttaataacattaaaatttaatagagtttaaagtggcaataaaatgaacaaagtctttaactatttatcacaaatatgccagtcattatttatgtgacatgtcatgcaggtaagatcacgatcaaacaatactttagaccggatgatgtggaaaaccaagtttaataaactcgatgcacgcctagtttgtaaatttaggtaaaaccctgttataaatttaagaactgataacgcaatttactctgttcactttttacggtaaccgtacctacatctaatcatacgtgctaattacatggcaccatgctatctctcatcgtttgccttatataaaatcaacattaactaaaaattaaattttaaaacttaattttaaagttgatgttgatttttttatcgaaatttatttttcagcattggtttttaaatcgttaagaacatacgtagaaaacttttactcacaaattattacaattttgcttgtatggcgtatcatccgtacatgcccaaacgataagggggctaattgtacctgcggctaatgtgtgcattcagcctagctacctctcctgtcgaatactcgaatcacgttcgtgcatcattgtaacacgcgaaaattcagtatccgacctctttgggactgtttgataagtcactcgtaactcatttcatccgatcctaaacatcgtcctatttccattttccctttcctaatcattattttaccggttctaaaaaaactctcggagtatgatgttttatttatagagtggactgaaatactatttttcttcttactattttgttttgcataaggctatgttgggaagtgagttttgattttgctatattctgagcatacttctcgaactattaaacaatacgttttttctaaaaaaaatacatgtaggtgtttattaaaaaaccaaatattttttaaaaatatataataattgttatttagttaatcaacatatttgtcctcagctctatcgaactgagcttggatttggagggaataataatcggagtgaggtgcgggagcgagagtctttccatgatgacatgcgtgtaacaacttgggtcaacgtggctttcttctggctcactcgtactccctccgtttttaaaaagatgatatcattaacttttaactacatatttaattatttatctttttccaaaactttataattacataattttttttaataataagaacgttaaatgtgtgataaaaactcaacaacgtcatctatctaacaacgattgaccccggccgtgggcgcctgtgctgcccgtcgatggttcgtactaacatcgtattcaccggcagtcaagacatgatctattgatcttcgag

SEQ ID NO: 19430 - DNA, 3350 bp, Oryza sativa
gctccgcgtctcgtgtcgctgcgacaccgagcccatggcgacgtccgaccccgccgcctaccacctgaagccgcggttccgcgccctcttcacccgctactcgtgcgtccgcgtgcgcgcgcccaggctgcgcgtgttcgagtggcgctgctgcttcgccgacaaggtgcgcgtggagagcgtcgcccgcctctcggacgtcgcggtggagctcgccgccggccggctgccgaggctgtgggacgaggagagcaagtctctgtcggtagaagactgcgacaagctgatgaaaggcatcctacgtgggctcctgcctggactgcggccgcgcagctgggattgggttcagaggaaatgcgtcaagcgcgatgaaaggtggcttagctttgagatctcaagtgccccaaagtatgatacttaactgattactgatgataaataatatatattactccatccatccataaatatttaacgctgtttcgtcttaataaaaaacttttgtgaaatatataaacctatatgtatacgtaaaagtatatttagcaatgaatcaaattataggaaaggaactaataattatttaaaattttttaataagacaaactgttcaacatgtttaagaaagtcaacggtgccaaatatttagatacgaagaggatattattattgtgtagagcacttgtttgtgccgagtcacccttcaatctaaccttgtttttcatgtaccacacgttgcttaagatacaggtgggcagaatttaaacgtaaatattcgtagaatgatacaattatcaccacatattgatctattttatcaattttttacatgactaattagatgatatgaaaaacgaaaaacaatccaatgcttgtaaacttttttcgtgactaggctctcttcggcagtggaaaaaggaaagaaagtttgtttcgttttccacgagtatgtttcccgaactactaaacggtgtgttttgtaaaaaaattatataggaaagttgcttttaaaaaatcatatgaatctatttttaaaatttaaaataattaatactgaattaatcatacactaatgacctatctcgttttgcgtatcttctcaatcttgcaatcttctcatctctcgattaaatcatcacatgttagagcccacaagatcgaagagctaatctccttatggcccctaacattgtaggccacaagcccgccatacgggctgctattttaattgagtgttcgatgatagaggttgaaaacccttcatcccttcacgcaaaattgagtggtggattagcgcatgcctaattaagtacaagctaaaaaactttaaaatagattaatatatatttttaaaaaataactttcctatataaaagttttactaaaacacatcatttaatagtttaaaaagtgtgcgcatgaaaaatgagggagtgaaagttatcagtctaaacaataactgtcatcaaacttaacatatactactccgtcctctaaaaaaacgaattcctagctaccaacctggacacacatgtccaggttcgtaggtaggattagtctatttcttgggacagatggggtattggctagtagagggtccaatttaactactccaaactgtcaactgtcgtcaaaaatctaatcggatcaaaccgcctaccgcgttgctacgaatcatggacagggtcatcaaccattgttgtacaacatcaatacatacaactctatcgtcacccggtatctccactgcttagtcgccaatgcctcgaataccatgacgtttgccagcatcaggttgaacgtggtcaccccgtccgccgctatcgccgcgcgggccgacatcgccacggcgcacgccgagtcacgttggaggcgggccagcacgagggacctatagctatggtgttgtccctgctccttcggcaagaagtctcgggagtagagtcgcagagctagcccctcctcatgctcccccacaacctctgtggacatgacggcggattggtggaccgacagagcagtacacattgtgtcgacgggtggtaccgcaactacggtatttggatggtatgaggatcgttggtactagggtatatgtgattgaggtaaaagagatggagacatggatttttatacaggttcgagccccttatcttacaggtaatagccctacatcctgttgaccggagccggcgttgctcttattcatctgaatcacacaagtacaatatttgggataacatatctaactgtcgtcgacttggcggctagataaccaactcgtagacgacaacagggtagtcttcctcctcgaatccgtactcggtgagatcagagatggcactagatccctcttgccggcttctgtaggcaccggattgggtttgtctaggctaaactctgatgtcgagatctgacagcgtattggtttgtattggcttgtggctttgtggcgtgtcccctctcctcctaggggggcttgtatttatacccagcccctttgtccaagtagaactaagtagataaatatggatacgatctgagtagtccttgtcgttttcatatagaactctactcgtcattccttatccggaactccttctatatacgaggtttgtttccgtataagatatggtatgtgatgggccctgccgagtttagtcgactactattaggtatgtggtatccataactatgacacattgtacatgggaaagtgatttcatccctcgaggggatatccctcgtttcatttatgccacctaaatagttataaaattttttgacaaaaatggtaagatagattaatataaaatatatcactccacaaatatgtaagactaaattcaacttctacaaattgtaaaaaaacaacaaatatagctgcaaatgtactataactatttttagcttattttgttctttttgttgcaaatacaataggagcagtgcacggtgtttcatttcatccatgcaccatttcacatactgtatttgatatatatttgcatcagattgctacgaagctaagaacaattgctacattcctacatatctacgcgcggttagctcgccggcggccggcggccagcgtcgagctcgccgggcggcggacggggttgcccgtcgatgcgctctaggtagaaccggctcggcatccacacgctcctgcgccaccgggcgtactcgctgaacagccacccgccgcgcccgcacgcccggggcgccacggcctcgctggtggcggcaatggcgccgccgccgccgcaatgcgaccgcatccacgattggccgggagcgcactggtgcagcgcgcagcgtagccccggcgggaggcgcgcgcagcagca

SEQ ID NO: 19431 - DNA, 35684 bp, Oryza sativa
tggttagtttgcgcgctaataacagtttttttcatcgaactaatccatccgcgttaattaagttggccttccatcgtgtagcgcttccctgtagggaaaacggctttcatatacggcgtgtatacggggtgagaaggcggaaacagcgaatacgtcttcgaggtctaagactgaaaaacgccaccaccaacaacacgcgaacgctgaagagataagtcgagagaaccctgcgccgtcgccgacgatggggctcgccggcggggcgcgcgtggtgctcttcgtcgtggcggcggcggcggctgcggctctgactgccgccgccgatcagatcttcaccagttcaggtaatcgcgtcggagtctcggcaagaaatcaagatccgtcgtgcgccccccatggactgtccctctcttcatgtcattctcgatccaaattcaccacttgctcgatgcgatttctcggcgtatattgatggaatacttgtcgatttcattattcattttgttcgattatgattgcctgctgcttgcttcacggtggccatgttcatttactgcctagatctagaattctgtagttgaaggctgttctttgtgtgcttgtatgatctgaaattgctaataactgatgatttgctggacctaactccatttggccatgatctatttattttcttacttttcgatctctaattgctgcaagaggaaaaacaaagcagaattgcactgaattgttgccgatgtcaggtgcgccgtttgggcggaattcgcgtgagccgaggtaccatgttgagttccatcctgtcgatgcgccatttaatccagtaagtttttgctaaattttcctctgttttacagttacaggaataatcagctttatttagttgtcacaaattctgcacactcggtgatcatgtgtacatcttttagaaccgaagctagcaagatctgaacaatcctcatacctgctaatgtagcctactagccttggtgttggtaatataaaggcattgtctaaactgtagtgagatttagtgattagctgtgataaataaacgattccgatctaagcaatgttgattatgtttgttgtaaatcatgtgtttttcattccattctcatcaaaaatttcagttattttcagcaattgtcgctctttactttattccaagaacacttcctgttatcacaatcaaagacttctatggtgtactatgcaggagaatggccaggaatctgtaccaatgactagccacgtggggaaacattatacatgcttcctacctgttgaggaaacaaaaaccatgaagtcgataatcccacaaaacgcaaccaatgttatcatagaaagtgaacggagagttaagccaaaggatccagatgaattgctggaaattctcaaggatcagtgcttctacagggtgagatagaactctttctttatgcggtcagtagaactgcatgtgttccactgcctgattttatattgactgaacaaaaactgattattgctattactattttgacacagcatgaaggttggtggtcttatgaattttgctactacgggaaaatccgacaagtccacgtagagggcgagaaggtaagctgccccatcctgtttattttctttgctcagatcagtcattggattttatcctctttatgcactatctaaaaaatatctgagatgcgtcaatccaagagttgctagtttttacaggagaaacaagttctggccacagttacacactacattatgaaaaataaaatattttatctttgacaataaatgcagccgacagtttctagagcacttgaattgccacgtaaagtttgtgttgtttgcaggttattcaagaatatgttctgggtgaatatgatgctgatgcaactgatgcttactatgaaaatcaaacatctgactctgctgatgaagatgataacctgatagacacctctaagaggtaatatacgaatataaggatatataaagcaaattatatctgtaagctaaacccacttgaatgaatctcttttcttcatgtttcaggtatcatgtccacctgtacacaaatgggactgtctgcgatctcactgatatgccccgggaaacagaggtatgaaaaaaaaaaacgttttgtttctatgtcatattaagtagtatgtttgactgcacttgctactttctttctacaggttagatttgtatgttcagaacccactgtagtgattagttcaattaaggagatctcttcctgcaaatatgttttaacagttcaaagcccaatgctttgcaagaatccgtaagtttcaatattcttttctctcaattgtctttacgccatttcatgttttgagctcattttcctgttctgcttgcaggctatttcagcaagaaaaacgtaccctctccattcactgcaacgagttgctagctgaagctgaagccactgtggatgatgactctcttccaaaagaagctcagatcatcatcccagatccagatggattgcataattatgcagcttatgctacttgattatgcatcattgttatagcatcagacagtgaagaaaatcatcttccgggtgcaacggcaatttggcaatgctaacaatggtataggttgttcgcggagcatattatccattcatgtgaagcaggtttgagatcatcagactaacattgatcatgaggaacattacgggcgatgagtgcttctgtactagtgcaaacgaagtactaaatttcagtgtcaaactgtagacagtaacattttcttgatatatgtttatagaagaaaatcttgtgatgcggaaaagtgcatgtgcaaacatcgtttcattgcgagattatggtattgctctgaagtgaagaaatatcatgtgcattgagagcaaaggtgttcccttttttcttgagtgcagatgacggcaagtcggcaacacaagacaggggatttgcttaatgtaagatgttcatactaagtcaagggatttgctttaatgttaagttgtcacactaagccaaaaagcatgtactccaatttcaatgctatgataaagagcaaatttgcttttgcgattatgttatttgagaatagtacaatttgcaaaataaaggtgataagaggacttcaaaatgccattagaaagcatacagaactaaacaaactattctccaagaaacttcgatctgtactttagtcaactgtagaatggttcaatgaattgacttggcctactatacattttctagtcaaaccaaacatcgataagatcttcggtgaacaccattagtcaacacaggatttggttaagcgttgtacaagtggcgaaattgcctatgcttaccaaaatggcatgatccaattatcctaaattgaattactccatctaccctaaaatataacaacccatatagattcgttgtaatgtagatgaagattaagtaccaacataaaaattattagcacacgattaattgagttttaattattttaaattaaaaatagttttatatgatattctaaagcaaattttcacattaaatgtactaaagtacttagcattttgaaaatcatgctaacaaaaaccgagctaaaacttgcatcttaatcagaactgaacgagcctgatgtgtcccattttatattaattgctatattttgggatggaggaaataataaaattattttgtgtgatatatataaaatccatctaaatttgaggacgtgcagttcagggctagtagtgaatattccacgctgacagacaggtgggccacgcggtaggcagtactagccactgagtgggacccaccagcaaccgctggccaatcagatcgaagggatgtatccacgcctcccatgtggccggaccgcgcgagttgcagatccccaaatgttactcaagcacatacccacacccactgattgcgtggaccccacgatcctatgggcccacatgtcatttgctaatctagtgggtacattgaatcgctgggttggtggagctaactgtactcggaattaacgtaaattgactatcctctttagtttatcggatacttttatgagagagaaggaagaacagagagagagagagagaggagggagaagaaaaaaaataatcgaaaataaaataaaataaagagagagatagaaccccagatctctccacagtttcaacgcctcaaatctctcaactctcgtcccaatccttaggtacacgcctccctctctttcctccaatttttgttcggagggaggacgaatttcagttcttgtttctgtttcgatctccaaccaaatctggcccaagaaaatttgagtttcttgtgtggtagatgccaccaatgtgtgccaagcccctctgagatctcaccggctgatcagctgatgtagtttgcagtcgaattttgttccgtttttgggggcaagattgtgttcttggagctgtagattggttatacatttttttttccatttcttggctcagttttgtccattcgacgaggaatttctcgtcgtgtttgttgttgattgattgatccaatctttgatgcgccaagaagcaagatgaacacgaattactcgtccctcccattgacctccatcgagctccaatccaaccagcgcacatccgaggtcgccaatggcgtcggctacaacggccacgccaagatctccaagcaagattcgttcctggtcgacggcgatgccgccgccggcggcggcggcggcgagaacgacgacctgccgctcatcggcgacggccccgccgggccacccgagggctccggcgtgcccgccgcggtgttcaacctcgccacctccatcatcggcgccggcattatggccctcccggccaccatgaaggttctcggcgtcgccgtcggcctcgtctccatcctggtcatggggatcctctccgaggtcaccattgagctgctcgtgaggttcgccgtgtactgccgcgcgctgtcctacggcgaggtggtgcacaaggcgctcggccgtccggcgagcatcgtggcgcagatgtgcgtcatcatcaacaatgccggcgtgctcatcgtgtacctcatcatcatcgcagatgtgatgtcagggtcactgaagcacattggtgtcatggatcagttgatcgggcatggcgagtgggataaccggaggctgctgatcttggtggttcttgtgatctttctctccccgttgtgcgcgctcgagaagatcgattcgttgagcttgtcgtctgctgcatcggtcgcgcttgctgtcgtgtttgtggttgtgtcatgcatcattgcgctggtgaaggttgttgagggtaagatcagtatgccgaggatggggccggattttagctcgagggcagcaatgctggatttgctcgtcgtgataccgatcatgacgaacgcctacatctgccatttcaatgttcagccaatctacaatgagctcaaggagaagacacctcacaacatgtacaagattgggaggatcaccactgtgctatgtgttgtggtatatgcactgactgcggtctcagggtacctcttgttcggcgaagacactgaatctgatgtgctcaccaactttgacaaggatctcgggatcagattcagctcaatcctcaacttcattgtcaggattgggtatgtcatccatctggttctcgtcttcccggttgtccacttctcgcttaggcagacggtggactcgttgatctttggcgagttagcgccccatagcaggaaaaagatgctcaccttgacagtggtgctcttggcactcatctatcttggctcgacgatgataccaaacatctgggtggccttcaagttcaccggtgcgacgacggggttggcactggggttcattttcccggcccttattgcattgagattggacaaggaaggcaagtctttaggtaagggtgagaggctcctgtcaattgtgatgcttggtttggccatggttgttagcattattggagtaattggaaatgtatacagcctgaggagcaagtctgcatgatctatcatgatgaacaatttagtagggttagtgcattgccatggcagtcatacagactgtattagcatggtcagatacagaagacagcagaggtactacttgagcaaagctcagatacattttgtttacctttagaggtgcaggagcatttcttgaaggtttttgtttttgggagcttggactagattgacagattctttgatgtatttgcatttattggtaaggcagcacaagatgataagaagctggttgtgttgtactgcgaggttgttgcctgtctactacatgaaaagaaaagaaacgatatgtttggcacttgagttttcaggcgtttttcataaatgttcgggagtagtggagtatagagcctggagatcattttcaccgttgaaaccgtaggccagaaaattactggtttaatttgcagtcgcttgaatgtaatgaaattctcccccataacctaagataaatgctgagttgcacacatttttatgttttttttggaagtacaagccctcttaataaccaaagtaaacaacgaagcgtcgaccgaaatgtccgaaatattgtactcttgagatctctccaaattagttgtatggatacgaaaactgagcatcatgtaggttagagaatagagagatcctatcagggccatcgccattgttctcgagaaatcaaaagtctgtcacgatagttttgctgaatgctatagcacccaccaaaaattaaaatatcaatcatgacattccttttcttttttgttgcaaaacggtgtcgatacatcagtaattcaatatgttacaaaagaatgcaacaataaataacagaactacaaaattgttgtctcatgatcctgaagtactgctggtgcatatcgttgttaacagcacgcagacgccttgtagctttaccctgaatccctgagtccatgacagacggtatggtaagacagaagagaatggtacagcagccacaaagaagccccacaccaacctgcgagtgacaaggaaataatcgagttatggaagataaactgcagaagaaaccgcctttcgctactactagataaacataatgctggcaggccggtatctgaaaatattttagcaccaactaattaatacaaaatagtaaatcttttggcaaaagcaaagatcaaaacaagcagtatcggtgaaagagacgaaaccatttggcatatcaaatgaaaaagaaatcacctgctactaaaactgtgagttgctgaggaatgtaaccatgcatcgtgcactctgaaacactttgtctatcttctgccaaactaagctctggacatctagaagcttcttcactttgtcctgaagcattgagtgacgccgtatcgtttcaccatgtatctgcttccaggaaaggcaaaaatcaagtttaggaaaaaaaatacataccatatataccctgtgagaaattttcataacagagtttttttattcttttacaaaaataacagaacagagtgaacaatatataacagtgtataccttcaaaaacaatttgagaacagcctgaacaaactcaaagttattcctgcaggaaagctcatgtatgaagtagtccaacagcaatgaaatggattgaagttcaggtctctgctccaaattttgtggctcatcatcgattaactgtagcactcgtagttccatatctaaagatgatggtgataagccttttaggtagtcagtaaatgccgaatctgtaaaacagatcaagagtcagcatctcaaccatgacaagcatcagcagcacaggccacaacactaacaaatatctcccggttttgaccatgcttctgtcggcaaaatatggcactacataacgacttaatagaagcagcaagtgaagtatgtgaagcaacagtatggacagcatctccttgtagtctaatcaatgagctaaaccatgaaataaggtaaacttgagcaaatatgcctataaacactcacaattctttgtatctccacaggattgtaacagccgactaaagtgagaggagaggtcagccatttttttgtgacttgtgtcctcagtactgctgtctgtttctttactgttcgccgcaggctcaaataatatctcccccgaaagggatggaactgtgggcaagaaaaaaggcgccttctcaggtttctttggtggctcaattggtttattccgaacctgaagacgcagaaatatgatgagaacttatttagttgttcctttaaacaaaaaaaaacattataattcaaagtagcatagtgatgcaggttacacaattgtcacttgcaatgtaaaaaagtatacctttataatgtcaagattcgccagactttgccattgactcttgggaagcaaagagagggtgatcatatttggtatttggtgatccattataacataaggtttaactttactttcttttgaatcttctgaactatgaatgggctcttcctcagatttttctgttgatgaaacagtgggcaaacgcacatttctgacatgtttaccacttgaataattatcaacatttgttgatggtgagaacaaagcttgattaaccctgtcaaaattagaaagaaacacagcggattgtatatcagaaagaataaaatacagaacactgcatactatatatgttattcataatagtataatattatggagtagaagggaacagctataagctaccacattcaagtggttctaaccacagtgccgacattcaagcaggccaacgtattttcaagtgaatattacgagaaattatgccactaagagaagtccagttatcaactgtgccacttttttccattggtccatttgggaacttctcgctttgccattttcaccccaccccatctggacaaggggttttgaccagctatggcatgctagctgctgaggaccggaggtgacaggaaggggctgccactagaggcacaatggttggtacttgaggaagggaataagacaaggggtagaatggcactttggaggctctgaacagacagaacttgatggggatggtagaatggtacttgaaggctctgaacagacacgcagacagaatttgatgggatgtcaatactgaggtggtttgttagtggcaaaaacaagaatgggaagacaccattgggaagaaagtactttgttggaaaacaatgtgcaattggttaagttggccccacatgatgtgctaaaaaaccagcacactggagactgacttacgagagcaaattttctcaacgctgtgctgataatatttcaaaaacaaaggtagatcttccaggatgaacctcatcctcttttgtactctgaggtggtttgattgttacttgcaactgatggtacataatttcagtaccatgtcatcaactacaggatggacagataaaattgtttatttgccaaatgagccatgtcatgattttgcgggagtaataacagatggaaagcttatctaatattttgctaaatgatatctccaaaattaacttagatctgcataaaaggtctacaaaacgaacatggtgagcacaagtaaatgcaaaagaagcttaccaaagatagacaccattttgatcaacatgggtggttgccaacacatccatattaggagacatagagagagatgttatagatacatcgacatgcattgcatcaatctgccttgctaaactgatatcccatattctaagagtcccatccatactcgatgagatgagccattttccatcctcactgaaacacaaatcagtaacacggtccgtatggccttcgaatctacggaccattttcattgctactgtatcaaacaatataagcaccatatcatctgctacagtagcaagaagacctgacataaaatagcataagactgttaattgggcatagaattatacacgagaataatcaaatatgttaaatactaccatttgcccggtggtatgcaatcttggtgacagatttaccaatatccagtctggattttagcttgcaacttttaaaatcccaaacctgcaagaggggacaatcctataggtaagtaatattgtcatggataaaagttcacattatacttgtaaagataagttcaaacatatgcagacaaatagctggtgtttgcagcaatatgcaattccttatggtaggactagaagatcagcattaagaatcaaattacccagctgaggacataaagatgaaacaaagtgcacaacaccactctgtaaaatgtgcagtaaaaggctgtttgtagtttgtataattacttagcatgccacaggatttacaatagaattaaaaagcaagagagcatggaaccttaatatcaccaccgtatccagcactaataagagagccatttgtagcatcacacgctaatccaacaacttctccgtcatgtgcacgcttaattgccaacgatgtatcaatataactgccacgactaatccccgattgcaggttaaatttttcgatccagccaccttcagtgcccaagaaagtaaaatttccacatgcacttattgcacaagcctgtcagaaaaagattaaaaaacaaaataatggaacacttgtaaactccaacttgtgaaagctaattcaaagaaaggtcacattgatctagtctaaaatgaaaattccatacatgcaatttaagaaaacatgcattaccttaattggtgacttgctgcctgatgacggtgtcagaatatgctccccaatgacaaagttctgtagacgccatacatacgcttgtggagtatccgtatggcaggtaacaacgttacaccaatcacgtgagcgtatctcagctgataacagaagcagaaggtttctcagcttaagttatagttttttttttcatacaggcaaaaatataaaaagaaaagggtgcaaatcagcaactagtttacaatgcacagctgccaaacataatgaaacactttgttacacaagcgctaagcaaatgaccagatcaaagatgttggaggacatagtttctgggtgccattttcattccacaaacataaaaagcatttattaaaatattcacattgcaatgtcctaatagattatgaatactgacaggcaatattaaaaggccccaattggaaaatcttcagaggtcacactttcattgactttgacaaaggtcatagcagcagtaaaatcagatagttctgaagaactaaaagaaactgcactatgaaatgggggtcgtctgttgtacaataggcatcctacatcttactacaaaagtttatccacttcttcaactcttatttctgttgccgctgctctccacatgtgctcctttgtaatggcatgtttataatttccagaatgtagttgtttccattggaatacaagcaatttctctaccaaggagaaaaaagggtgcacttccctgtctgatgctactttcaatggccatagtactggtagaatatttattggtagcataaaaatagaaaacagtatcattactgccagtgacttgtatttattcagaaaaacagaagtggaagaacagtatccctatatatgtcattagtaaaagcaacagaagtattgcaaagaccaaaagagtaccacaatcaaatgcaataactggtttcagcttgatctcttcctcctgcatgacagagaagttttaacatcttagagaaggaaaaacaaataggtagggaataaatgtagtaatcaaatccatacctttaatccaagcttttttgccctttttgacacatgtctttgagaaagttctctgctttgttgatcctgtcaacaaatagttgtgtcaatagaattaaatagtgagctaagctaacgtttcctttttctcaaagaggcaaggcatcctgataagaacgtaaacatgcaggattcagcgaaaaccaaacgcatctgatgaatagtatttccatagttcactcaacacctcaacagaaagaaaaacaaggaagaatgtcggaagtgataggaattgaagtttcatttatgctctcactgctatgctcatattgttgtcacacagaaatatccaccttactaatgcaggctaggataaattcaatttttttagaagaaaatgggagcagaccagttaataataaaataatagttataaaggtgtaagtccgctgaaacaatagtatgcctaaaacatgaataaacttataaaaggtcacatgccttagcatggttgatcagaatagaaccattatacagttttattagaccagagagtattgaagaaatgacaaataacagactcagcatcctaattgatgtaaaaacgtacacctagaatgttaatcatgatgtatcactgccatgttcctaataagttcctcgaaagtaggagatgtgcttcatataaaagttaaagacagtgagttacctggacaactgaaaaaaggcgaaaggcacgatcttgaccagcagataagatgcattttccattgccgtagaatctatcgacagaagtatggttactactaataaaatatccaactgattttttttaaaaaaagcaagacatgattgaaacacttgtcacctaatgcaccgtggtggagcactatggccacttcgaaatcgtaacaaacgagcatctccatcattagtatcaaatatccacatctggtaaacagcatattagattactggactatcaagataaactgatataacgttttgcagctgataaaactttatttgacatggtaatgccaattccagaccagtataaatttcatctttcctggctagtttgtttctagtgaggatcctggaatacctcactaataaaaggctaacactgaaataccatagacattcaggagagtacaactggttggtgcagcacaaaggcacgattttaatgcgctgaatcattctcaccgctactaagtgtacagttgatgccccacatctggttaagtactagctgcatgcagctttggacctttgcatgtttctgtacaacagcttttaagcttgacacttacctttattgaattatcagaagccgagctcatcaaaataggctcattcgcgaaaaaatgaagtgaaactatagaagcatcatgggcctcccggataacagaatgaaggcgccttttctcaagattccatatactaataacacctgacgatcctccagaggccagaagaggttgcccatctggtaaaagaatatatgaaacacttcagctcatgtatgaaatctgtatcatagaaaaaaaatgcaacagcagcatttcctgaactgaatctaacatataattattaggtggtgccaaaactgccagtcccatcttaatatgacaagctttctaacaagtcatttgagtattcacagtcaagaacagattacaggactaaaccgacaggcaaggaaaaatgaatatatcaggattttgattggacatttccattcttgtaataatctggtgaaaaatgttaataaaggttctaatttacaacaagtcgatcaaaacacctgttcgaaatgacaatgcagtcacagcaccacgaatttgatgattgaaagacatcaactcttcatcatatcgtatattatgaacatgaattgttccatcagaacatccgactgcaacaacatcaagggcaggtgaagaaacacaacaacatactgatgagttccaacccttaaactcataaagtttcttcttagtgctgatattccaaagctgcaagggaccctcttcgcttccaatgatgacctaacgtaagaccagattagatttattaccagaaatggaattgaatgcacaataaatttgacctctaaactatctccaaagcaaaggaaactccacttgccttatttagataagtatcaggatgcataatgcaagttggtgtaaacttgtctcccaatgatatgttcccaacaggctcactatttggctctgatcctctgaaggaccatataaatacattccccttaatatctgcacttagaatgtattctccaaatgggtataatatattgatcttttcttcatgtttgctccaagtaaccacctgattgaaagagatccagttagaacataaaaaagaattgtctgattgagaggaatcctgtagcagttgatgggcataaaatgtagcatttggatatcctttttgggagtttgaaagaaccatttcattcagaaactattcaaatttccagtttcaaatattataggagcacattatctgactatctccaaaatgtagcaacctcaagtgaaccagtaataatatttagataagaacaccaagcccctgcttttaccagtaataatatgaatggttgcctcaatcgcctaaacaagtaactagtactagtagtaactaacacgataatgcaagatctgctattgcaagcacagtaacgccctcacctgatcagttcgtttgaaaacagcgatatcacttccatacgcagcaaatgtataatccttgtacgatgcaagagcacggatcttcttgggcaattgaggtccttcgatcacataaaaccataaggaaaaaagctatacatgaagaatcttcacatagcccaaaaaaaaaaacagacttaccagaaaggaccaaattcagtttagcacactgcaaaacaagaaataagtccagttagtttctaaaaatgagttagctacatcagaaaactatgcaaggtgagagaggctagcgttaaagctcatatgtacaatgaagcagctcgattgaatcgaggtagtagtgagcaaatcgcattgagctaataccacaatcagtaactagcccctgagctcgaaccatgacttaaatacacaatcaccgctccaaagcatctcaaatcacgcgttctaacttgtaccagatcaactcgctccaccaagctccccgtaagctactccgatttgagacgcgagcacacaaggccaagggtggacggtggtagggcggcgtgggggtgggagacgagcggggagaaagcagctcacgttgtagacgtggaaggccttgccgacgctgacggcgacgaaggtctcggtgccgaggcgctgcacggagaagggcacgccgccggccgtgatgtacccgatggcgcggaacggctcgaagatccccatctccctctctctctctctcccaccgcggcggcggcggttacttctccggcggctgctgctgctgacgatgcttgtcgagggtttggccgctcagcttgggtgggggtgcgccgccggcgagggttttagaggtgggggttttggagcggcggcgggagaaggaagggtggacgctgtctgggtaggtcagtgttgttgcgttgcgtgatgatgaggtaggatgggccgggccgggtgatctggaccacgagggcatctgggtcctggaggctggagctggaccgagcccaagttgcgagttctaaagtttctttctttttatttgtttttcagttttagattagataggcagagatatttcagttttcaatacagggaaaattctgcatgaacttgaaattcttgtgtattttaaatttaagaatttatttataagtgtcggtaacatggaagcagggaagagttgcaaacttctttggtcctctccggccacagccagccatccactggtggggacaagccgacaaggccatccttctcttaaaaatcatgaggtaccatactcctcactcctgaactgaatgttcatgggctaaaaagtgattaactcgagatactcagatacaagctgcaagcaatgtcgtactgccagtgccagatacgttaaatggggaataactggaaaaaaaaaactattactctctctgttccaaaaatatgcatatcgtccgtatacatttaaaaaccatgcacaagtacctatattttcgaacggatgcatcatccattcgtaggtcctacgagagttcataacacgtcaagagttcagatatttgttttgttattacaactttctggactgtcagtacagctatagatcacaacaagagtatctaaattcagaatttgctaataaatttacaattatcttagtttacaactacattttcccacagatgtaagatccagaagctaaaatgctggagttatattgacaccaagggacacagcaatgaagatgtttcatgctgctgcatctgcacaaaattgttgccctcttttcaggagcgacaagacatttctgaactgcggatcagcggatattcatgagcaccttgctaccttcatctcctatgtattcaccacaaaaaatactggatctaatagatctgaattttcacacagctagcaccccaacaatattaacgtaagctagcgaaacctatgtggtatgtcacaagcagctaaataaataatggagcctcagcatgaacacatacaatctacagagagcacacacatgatctgcatataacaaatcacaatgggagaagagaccggacatactgccgggaagcactgtttcgtccaaggcccagccctaggcccaatggtgttctatcggtcttcttactgtggtcacaacactgagatgaacttacttgactgtgagattttgagtgagcatgtgattcagcacaagaatggccagtgccgttaccatggtgggaagggccctcgccattctgagagactgcgtttgtcatctgtatcattcccatttcctcatcagtgtgtgacgtatgatcaagacgttcaatgtcctcattgtatccatttaacaagaattctgagcagttcttgcgcgctccatggtcaaatgggtttctgaatcttccacctggacctcttagataactgtatctcatggaatttgccatctcgtttgttgtaatgttcttcgctatctgcatgggagatggaagtaaggcatgaacacgtcataaaacagaacagaaaaaatgctcctcaagtcctcgtgtccattctgaaaaagttatagctaccagatggaaagatctgtcgtatacagaaacatcacagaaaactaattaatagatcaaataagccagataatacctggcatctactgacttcaactctatcttgtaattggaatatcagttttgctactgaattatgtatcacagcaatttcattgcctaaaattcaatgttacttctactgtatccaaactttataggggatacacacatgaactatataattatgacatgttcatttgacaaatccagcaaggcttcataaatttctggggcaaaccctcataaaatcagcagagaagtttctatatgaaactttgtattacagaacatttactgatggttgtaaagacaataaacatgcttcctggtttttttcattatcaggtcaaaaataggttggtttctcatgagaaaaaaaaagatcaagtagcaagctaaattcaacctttacatacctgagatgcctggactactgctagaactgcaacaccgaagaaaaggaagaggtccattatgaaaaaggaaagtgccccagtatggttaaaagcagaatagctgagccaaggaataaaggatgctggagaagccggatctcttaccatccctgtgacaaaaacagcattgaggcttatggaaattttttttcactccaaattattaaggacagaaccacaaaggacttagcagacaatacttataatggcagcagaaccagtaatgatcattgcaaaaacttctagagtgatgaacatgaagaattcccatttgttcttctgcagttacagtgcactatagatcagaccaaaggacaagaaggtatccggcagggaaaaacattcaaacgaaaagctaccaaaaaagagagattgtattgtagagcacagagctcttcataatgttatagcaactttcttaagatatacatagcaacataatcttctgcattaaaagttcagcattttaagacataagttatccatttcatctccagaagagatgacaaccatgtttgatcactactcaacacagtgatacccaaaagaacgtaagtaccttgccaatgcaattagatacccaaggacagtgatggtcaaactgctcaacacagcgatcacatgtagaacaatgcttcgaacgaacaggtctcacaatctgtagaataacccttggaatcagaggcccaaatatcaacctagcaaagagaaaactaatcgacaatgctgtacttactttgcatgttatacaaagctgtgaccagttaccagacagaagtgcgggattgtctaactccaacttcaacaaaggttcctaaaggaataaatactcatgattaggattgtgaaattttggatatattgtttggctttaagtctggaaatgaatcaaacaagattcacacgagtccaaagagaagataaatgtgcctgtagaaagctatattaactaagctaatatttcaaacttacatcatccctttgattttgtgaatctcgtatatttgctttgatgtagccaggatctttcctgcagatagcataggccaatgtcatgatgcagctaaaggataatcaataaatgctgcatatctcatctggcgatcatgggggtaggtaacagaagaatagcaggctatttacacacagtaaaatgctcaacagataaagaatgcaagaacagaagggcataaccatataagtaaaacatctaccacatttctgataagcaggtcagctgatgtaaaatgcgtcaacatgaaaaaatatataatgaattgtgttactatattgaaatttgtgaagcagtatctaacaagaatcaacatgctggcaatatgtccccatgctatcttgagttttcaacttttaatactaactgccaactaatcttcattttcgtaagtacctgctacatttatagaacatgactaggccagcagttgcaaggaaaactcctgaccatgcaaacagcccaaatggtgctgtcatatccatgatatattgacctgaaagaatgaaatgtagtaaatactgcatcgtgggagatcaaatggagtgagcgacattggaaatggtacttacctgatataacagagtgtatatatgtagcaagcaagccaacaataatacaccaaagtacaggagctagccccagtttcgatagctttccaaaattggtattcccatcacatcctctatcatatacccttttagcattgtcctgcaagcaatcatcaaatcaagtcttgtttctgtctaaataaacaagcatcatcaaaaggatcatcttccagtagattctctcttgaaataccagtaatattctttcacctcaaggtcaatatgaccactcttatgacattagctagattaacaataatgaattagtgaaaaggatattaatctacatgtgcaatcacaaaaagtcaggaaatcatttcggttcccaaactcacaacgaatctataataaaaatatataagagcatataagcatcagcaaagtcacaacaaagagtagcattttgcctccttggttacatagttttatgtcttatgctagtttatgacatttctggtcaataatatcatttccatgtgtagaagtcatagaattttgcagcttcttgtactgaatctacagggaaactacaaagttcagaaagcttatgtatgcaattatgcataatcagtgaattacaccaataacacctcatcatggagacatgaaactcagctctaaagaatttataagtcagaaggaatataaaacctaaaatgatgaagaaaaatgtttcctattagtaaacatcattacgcaaatcatattaagtaacttggcagaatctctagtagatgaactggtaatggcttaatgcattgggctctacaaaagaatggctataatacaaaaacagaaatgccttggttcatgttacttacaaaaaaaaatgcaacttgccgatgactcttatcaacaacaagctgtgctggagttaaaccagtcttattcttcaccatcaagtcatccttttttgccagcctgaactagcacagtgcatgcctccaggttccccctaatagcagcccaatgtaaaggggtacaacctaggggcagcattgtagtaaagaagtaaatctcatgctctgaagtgtactgatataattggagatatggctaagccattggtttacactgttatgtgcacagcagtacaggtaataatggaaatagataaatttagcacatgccttctttatcctgccgccccctataagcatccaaatacaaaaggagacgtatagaatccgcaaatcccttgtaagcagccctacaaggtaatatgccaaaaaaaaacagagagagagagaaagaaatataaggggcactgaaggtttatggggacatgcattactaagtgcactggtagaaactactactccagtgcaacataagataatgataaatgtagagaacaaggtacaaaccagtgcagtgggcttcttccatcattatcagggacatctggatcagcattccacttcgcaacaatatgataaataaatgctgtctggccatactgcgctgcaacatgtgttgcctgcaaacagcagtatagagtttttaacaaattcactgccatagacaaaagttgttgattcttgcttttcattttacctagagaattcataggttaaatttatttatttatttatttatttatttatatactggaaatccctgatcccctagtgtggatacaacagttaacttggcaaacaaatatccaacaatacttagttgtctttcagaatcatgaaccaacattggacaaccaaagcaacaaaccaggaaaacagggaccaaaatacagaagggaagtcaaattcagacctgataaccgtataaatcagcaacatccaccttagctccttctttcagaagaagctcagcaacttggatgtgtccacgtacagcactccagtgaagtgctgtttgcccagtgtggtccacagcatttacatctgctccatgctgttcaaagaccaagcacaaaatcatagtccggtcaaacaaaattatatgtgcagaatgcgctcactgaatagcatagtgatacttcgtctacatgcagagaataacatactctgactacataccacaatcaagataaattcctggtaccatcaaagtatgcatgttatgtgcgagtttattcatgcacttagtaggcacacaattagtaacctttcttattcagactatactgagcctaccatacactcatgatcttaagattaaaaggaaaagaagacttaaacggaaacacctcaagggcgctgcacaggccagctgaattctcatctgctttatccagcagtaagcatgtccacattctcaatgatccaatggaaaaaataaacatacatccatatgaaaattcagggataaaccaaagcacagtctcactagttccatttctattcaagcctacaacatacaaaatgagatactgaaaaactggcatcatctccaggtcatataaacatccgaaacctactaaaagcacatcaatttccagctataacagcttgcagcagtcccaaaccctccatattcacctaatgcagttggccaccaacaaaattgttcacaaacctggagtaattcaaccacaggcactggtaatttggtatccaaaacaccagccaatgagctaaaagtgaatacacctagccaacacagtataacaacaaacagtccacggttcaaaaacatataaaattgcggctcataaagtgcattggttgatgacgcatcctaccaaacccccacccaaatccctcgctagctagcaaacaacgactacacgaaggccagccaaatcgcgagacgctcgggcgggaagcaggaggggggaaaacctcgaggatgtactgcgcggcggcgacgcggttgttgagggcggcccactggagcgcgtggtagccgaggccgtcgggctccgtgaccgggtggccctccccctccactagccgctgcagcttctccagatcgccgtacgccgccgccgtgtacacgtcgttcttcagcgagtcgtcctccgccgcaggggccggcccctccccctcctcgccgtcggcagcggcggcgggggatggggatggggacgcgggcgccacgggggcggcggaggcggccatcgtggtggtggtgtcctcgagcacctcgatctccgacgccatgggggtggggatcggagttggggagtgtttgactgggtgggtgttttgggggggattcgttggggtttcgcaagttgggtttgggtttggtttgggtggaagcggagaacgagggggaaggagagaggcggaggcggcggagactaaggttggtggtgaaacgggaaactccactgtgattggctgaaaaaaagaaggaaaatccccacagtgactgcaagtttagcacatcaccgttggatgcataatggaaagggtggaacagggtgggtattcggtgtcggtttttcggtcattttgattcaatgtaaaaatatcaggaccgataaattcaatctcggtctcggttctgaccgaaatttaacaacgtttttatatatgcaaagaaataatggaaattttcaacacaaaaataaaaataaaaaaaccgtaagcacgtatgagtaaagacttttattatgttgcatgcctagaagaagtatggatatgaaaattagagtttaatcctattgaacttagtggattgtaggttgcatttagacatattttgttaattcggttttttcgtctattcacttaaggagactaaccaaattgaccgaacaaaatttggtatttcacccaatttctcggtctcaatctcagtcttttcagttcggtctttttctgcacaactctagagtggataatgagcgactctccttgtcctaaccttaacagcagtaaaagtcttacttggctaggagttaacgagctactccctcctctggtttcataatttttaatgatttagataaggtttaatttaaatttttataacttaaaaatattcagtttaaagacaaatacagtattataataaaaataaacacacatttaggtatagtgaaagacatattttgaaaactatatctttgtctaaaacattaataattattgccgatgtttgagatcgtaactacgatattttgcatactgtagggatcgttgttaccagggtatatacgagattgaagtaaaagagacggagacaatgatttttatacagattcaagcctcttatctgataggtaatagcgttacttctgttggctgaagccggtgttgctcttattcatcataatcacactagtacaatatttggaataacacatctaaccgttgtcgacttggagacctgaaatgaaacttctatatatgtgttcttatcaaaacttctatatatgtgttcttatcaatctataagtaaagactgaaaaataaactttaataaaaaaactcttaaaatcaactttaaatttaagattaaaaattttaaatttggctggcgagtataggcataagccaaaagatgcagtgatcacctcatgcacggctgcacgatggatccatcgccttggagtccaccattccacggtgacaaaacacggcaagtccgcagcaggctggcttggatggatcggatggcattccgttccatcgattacgcgttcaacagctccgatgaaaccatgaacgacaaccagcgagagaaaaaaaatatatcaggaaatcgatttcgcacctggaatcgggacaagtcattcttcgttcgcgtgatcgcgtctctttagcggtacacgatagtattatacacgattattgtggactgacccagtcggccgcctcgtggaatcaaaccagtacgaccgacgtcgtggacttggcagtcagtacgctgccgattccacacccagtttcctatctaagggcaatcacagtgtgtcaccgatttttgccattgctcgtatgccacgtagataaagaacctcgtaagcttcatacttcacagtgcaaatactagtagtgggtctcaccggtgacaaactttttactttttatctctctcctttttcttctcacccaaatgagtactagtactattagcttctctccacacaaatgagtagcttcttccaagaacccggtggcaaactttggacacaaaaacttttttttgggcccagaagcaaacgtggcgtgtgctttttcctttgcagactagggagggcgaggctgaacgtcacgtaagtccaccgtgaacgccctaatcacatagtacatttttcgccccctgttttcctttctgccattccattggcagttcggttctttgggacaaaagttactccctccattttaggttattagatgtttttactttggttaaagtcaaactactttaagtttgactaagtttgtagaaaaaagtagtaacatttttaacacataacaaatttattatgaaaatatattcaattattgacttgatgaaactaacttagtactatatttgtctataaacttagtcaaacttgaaacagtttgactttgaccaaagtcaaaacgtcttataacctaaaacggagggagtaattgacagcctgaaaggaaaggagtaattgacaagaaattacacgaaccaattaaaagctgctccgagagaaaacttgttgtagtatcgacagacatgtactccctccgtctcataaaaaaccattctagtactggatatgacatattttagtgctacgaatctgattctggataaatgtatgtccagattcgtagcaatagaatgtgtcacatccagtcatagattcgttttttctggaacgaaaggagtatgtatggatcattagccattacagcgattcgcaccgatgatgttgttttgtggattctcttttactccctccgtcccaaaatgtaagaatattttgggtgaatgtgacatattctagtactataaatctggacataaaaactgttcagattcataatattagaatgtgtcacatcatccaatatcttttatattttagcacggtggagtagcttgatggtctcggtcaaggcatggaatatgggcttcgtatcttgctcttcggccttgtttagtttgcgaaaaagaaattttttggtgtcacatcagacatttgaccggatgccggaaggagttttttgatacgaatgaaaaaactaatttcataacttgcctggaaaccatgagacgaatttattaagcttaattaatccgtcattagtatacgtgggttactctaatatttatggctaatcatggaataattaggcttaaaaagattcgtctcgcgatttctatgcaaattgtgcaattagcttttttaatctatatttaatgttccatgcatgtgtccaaagattcgatgtgacgtttttaagaaaaaaatttgggaactaaacaaggccttcatctcatcctctgttgccatacgtacgttaggcctttgacattttgtcctcaggttaaatcatgcttggccacaaaaaggaaataatgctgtggagcctccatgttcattattaaggcctcgaaatcaccacgctaatcagagtaaggcattaatctagaacaaagcatgatgaccagattacaaccatgtatgctgatagatgaaaatgtacgagtacgttgtccatcagaaataattccacagcagctacaattactttcaaatggttcgtgtaattgtacgggaaaaccagctggttaacatttggtacggagtatatgtattcactattcagcatacaacctaacacaagtcctcagcatactatggaacagcgaggcttcgtttgtacaatatgcagcagaaaggcttgcacgcacagagataaacaatctattcatcatagagccttgacagtaccatgtagacatgtagttaagatccttgatcggcaactgaagaaaacagagcaccattgtcacgcatgatcactaatttacatgtgtacatgatattaatggcaaaagattattccattaacttacactctgggctgatgggctgtccggttaatatcttcctgctatatactgtcccagcaactgatcagctagctcctcaattttcttttctctctctgtcgaaactaatgctgcatgagattatcaaacaattggtgagtggctattggtaatgaataactgcaacgtagtatagcaattagttacttcgttccaaacacgcacaagaactgcaggttgtcacattgtcaatggaaaataacacagctaatctcagtaaaagcttacaaactcaataattcaatatgatggatgttaatacaagagatcaaagttcatctatttttttattctaacaaaattcatctatgattgcacaaagaaaacacaaggcatatagtatcaagtattaaattgggtacaaataatgtcctagtccaaaagagatgttgctgcctcgtaaggccgtcataagaaataaacaatggtacgtagatgtttcgcattgtcttatacacaaaaaaaaaaaaaacttcctgctgctgttgttttcttatacaaaattcttagcttgagctattgcatggcctacagtggaagcatgaggtataaaaacagcagagtatccggtgtacctttgttttcagcggatgttagaagttaggtacaacttggtgaaatgatctccgtacgcccatttctatctgtaatttgtatatgcggaatgtgcttgatattgatccagtcatctcctgacttgcatctttctttaaacctattcaagcatgttataagtgtcaggctctgcaaatttgtgagccgccggatgcatggatgcaaagcttccatccagtaggtctccactatgagctcagtgagacaggacatctctcccaaccattctggaagcaattcaatatcctcgcatctccgtatctcaagcttctggagggacttccagcccaggatgcactttggcactggacaactatcaacacatttgtctattgttagttctgtgatgtttagaagctcgaggtgcggaatgctcttccatctttcggaagatagaccactggtgttcttgatttccatcctggatgttgatccagggattgatgtccccatgacttgcttgaacgatgggaacaggaacgaacccaatattctacggtaattaaatttatcgaaatatatttcccctgatatgatgtaatgggtgctcctcgggatggatggttggaatcttaaattctcacataattccatttcccaatgctgaagacccgggaataaatttttgtcaccctctcctccttgcacggatatttgtaaccctttgtttattattttggtcatgacaatcttttggagcttcctaagtggttggctacactcgatgcaaaccggtttgttagacttttggctttctatctgtgaaagatgcagctcctcaaggttctgtaactgatgcaaaacgacacactcaaatttcacggtgaagagatacaactgtcggaggttctctaactgaacaaggtggagatgttcaaattgttttttacagagttccagctttgtgatgctctgtaaccgctcaagatggagatgtccaaattccacactggagaatttcagctctttgaggttctgtaactgatcaatatggagccgttcaaatcgctcttcagagagtttcaactctgtaatgttctgtaaccgttcaaggtggagatgttgaaattccacaccggagactttcagctctctgaggttctgtaactgatcgatgtggagatgtccaaattttaggccagagagagacaattctatgaggttctgcagaccattcaggtggagatgcgcaaattgcactctggagagaaacagctctttgaggttctgaaactgatcaaggtgtagatattcaaattgcatgccaactatcttcaattgcacaagatttgggagtaaagacatccaacgagggaaatcaacaccagcatagttctttatgcaaagtattccaaggctatcatgaggctggagctttggaaaaacagccctattttgcatccctctctcagaagaggcgtatttatcgctggaatcagcataggcatatgaccactccaaactcaacgaggataactccttttttgtctgtaattctaagttctccatctccctcaagccaatcatacattccagaccaccaatatgcagatcgataaattgagaactagtaacttgctgaagaagcattatatagcttggagtcaagtacatcaaagggacctacaattaggaaaaaaagaagatataaatgatggtgaacttgccgtaatgatgtaagcttgacctgcatctaagttagtttatacatactctctccatttcaaattacatgtcgtttttctttgtcttaaagtcaaatattcctaactttagccatcaatttctagaaatttacatagtttaattaacaacatgcgaaatatgcattactcatatgagagtttctcatagtgaatcttaaactatatatctttctagaacttgatggttaacattaagaatgttttgactatggatagaactaaaacgaaaagtaatttaaaatgaagggagtaggtgtaaatgacctccaatggttaatgttaacatacacacagaatggttggaaacattattaatcaataaatgagttgaagttgaatcaccatagagatatatcatggtagtttgcatataaatagtttgtacatctagcataggatacccaatgtatgctagtcactccaatcacaaattaaatactttaccattttggttatatgattggtcaaatcttataagactccaagtatctaaaccaaaaaactaaagcagatgtgtgccatcgggaactggaccacacgttggggttgacaccatgattatatacatagttaatcatagttgtgatgaaataaagtcctaaggtgtaaataagaacaatggttgtgaacaagtgtttgagtgggcgtagtgcagagcaaccacgatctaacaccaaggaggcgtagttagactggaggtagcttgaggttggcttaggccggtgcaaccggtcatgtaatgatgtttttactatgccattgagtttgcactgattcatggtttgtcatcaactttgtcccttctataatatactaccaagtttatccatagtttctttaatatgccatataccaaataccttctaaaagaaagcctaaaatgccctaatatacgtgtaagagttgacaattggttgaccactggaagattcaaaaagctgtgaattttttttatctagcctactagcacataatagaagtttgtgcacacgttttaaaatttttgcattactatttttttataaggcaaattttgatacaaggcgttgtaacttcgtagttttagctgaaggacactgtaagtgaagttttgggggaagacgctctcaagttggatatttgatggtggacactgcccctattaaaataatcatttctggttggataggaaaaaaatcatgtgaattgttagaaatacccttggtcccacatgtcaactctcccatatctcttctctctatcccctccatccacagttccacactgctccaccgatggaattgcacctctacaaaataatttaccgatccagagtcggagttacctcattcatatcaattgttttgatatgtttaatcttttctttatcctctctagatgtgcaccgttcacgcagtttgtagttgcacttgttgagcaccaaccgttccaaggcagtcaggcgttggatggattgtggcaaatattccagtttgcttgcttgaatatctagcttctgcaggaaagttagttctcccaaccactccggtaatacagaaaagttccagcagttcgttatctcaagtttcctgaggcagtggcagtttttgataggttctggcaaggtgattagatcgatgcaggaatcaatagtcaaatacaacagatttacacagccttgaagaaatttcacgatatcagatgatgagccagagtcatttattttcagtgcgatcaaggccaagtttgagcttccgatgaactgttcaaatgataatagtatgctgtagcttttctcgagggtacactcccgacttctagggaaacctggaacaaatctcatcctgggacaatttgcaatgagaagaacctggagattagggaaaacttcttcgcttcgtgaaagctgatggtcattgtgacctgttagtagtagtgtagtggttaaccattcctctaggttcttcatagtactaagttcaagttctctcaatttcctgaatggtttctcagtgccgtaaacatgaccgtccacttttctgacgctaggcatatctgagatgtgcaatacttccagatttgctaattggccaagtggaggaagacattgacagtttgcgatgttagacagtttaacagtcacaagatttggaagggaagaatttatattcatcatccaatagcaaaattcatcaccccgatagccttctatttcaattgtttccaggtcgtggtggggtcggagtttttggagaactgccttgtcctcagccatgcttgaatcctcaatgaaattgcttctggaccacaccaaacgaacttgctgatacttcgccaactcttggacttcacccagtgatcccttcaaattctcaagatttttaatgaccaggctgctactttgtccgtcatagtgtttatacagtaatggaatgttacttgagcagaatattcctccttcctcaattggttttacggaaaaagtgcccacctgcatttttagacataggcataatctgtaaacacaactaccatttttttaaatccccaacgaacattgctagtaagtataatagcagccacagctatctgctgtaaaaagcacatcaatttgatagcttatgcacctgcgcaggcattacattatatgtttctttttatgtgaccacccgcatggaaggctggaagcttgcatgtatttgtaatacgtgtgcatcctcaaagcagcacgcttgagctttagccaggttatatagatcgattatgcatgagaccagtatcaacgcttcaactatccgcaaatctccggagcagtgatggcagagccatctttgtgtttgttattgggtaatttaaatccattctttttaatacctatactaattatacactctgagaaggctcccctgtcaagtagaaagacggagcactaattactttttaaatcctattatcatagctgaagattgtagggataattcatattgaaataataatatgccatcaaaaataccatgatgcaatggacttggtagacaggatggaaactattggacattgcaacatactagcaaaagacacaagtaaactagtagagatgcagtgcacttggatggattcagtagattgtaattgacttgaaatagcgaataacactagcagcatgctcaattacactaacgtattagcaaagaaggaatactagtagatatgtttgtagcagaatgccatacttagtgggatgtaacagccagcagattgcatcagccttgaagcactagatatgcatgataggatgtccaaagaagctaccagctagaataatagccaagctggcccaaatagcagtggcatatcaactccactagtctagaagtagtgacatgatgaacaataagctgtgtgctggagagcagcagcagcaagcagtgcagcgagtaaacaagaatgaagatgatggacttaggccttgtgttctgtttacatggtggaaaaaataccatcctaatgggccttcacacctaggcctcgggtcacggtccaggtggcccaaggcctaggtccgcccctgtctcgcggggagttctcgaggaatattcctgttagatccaggtccaaagcgcccggcaaaatcgagctgatcatctcgacccacttcgacgggcgcacggtgtgaaccgtgcgccgctacttcactcgcccgcccgacgtctgcctacccgcacgccaatcatcgtcgcctgcttgtcagtcaccgctgcagcttcttttgaccgtcggtcgtcgctagtcgtccgcctgctcgcccacttctccgaccatcaccgagctcctccgtggctcgcgtacccagccgccggctgccgctccttcgcctgctcgccgccaacccgcgagcactcctccgcttgcttatcgcccgcatgcttgcgctcctcggccgcgctcgccgcccgcctgctaggagcccgcgctgcacctctgcctgcttgctcgtgagccagcgtcagccactcctccgccttctcgtcgcaggcttgctcgcgagccgtgcccacccgctgtcgcgagcccacgccgcacacgctcctctgcctggtcgccactcctacgcccacttggcaattgttgacggtggctgcaaacggtgtccatcccatccctctctcatccgttcaaccaaacaaaaaactaggataagcccatcccgtgaactaaacagatgagtggatgattccaaccccaaaaccagggatggcttcatcccatcccacttagtcatgaaaccaaacacatgctcccgccgccggtgagagaaggagaaaggaaaggggtgcggtgaaaaaaaaggtaggccagagggttaccgcgcgcgtgcgaagtgggatggcgccgtccgccagattttcgcggatgagatcgtcccgaatattggaggaatattctctttttggaaccatcctatccctcttaatctctcaaccaaacacttggttttggggatcatcccatcccatcccgggatatccctccaaccaaacactacttaagagaaccatcctatcccacccatcccaaaaccaaacctaaaaaaggtccaacctatcttgatccatcccacccttgcaaccaaatatatccctctattagggggaaggttagaattagttcatgggaattaaatggtaggaatcatgtcctgttaggtttcgtgggatggggtgatcctccattccccgtccccgtccccgtcccctacagagacccgcatagggttcaagtttaattttcggtccaagtttaatttgtttacttatcttatgtgattaatcttgtgtttttatcatatgtattagtgggtataagttgctatattaatataaagtgtgaatatatgtgttgcattgcatatagaatttcacatctatatattgttttaagcagggatgtagaccctacggggattaattcccgcggagataggaacaagttttccccattgtatttcgcgggagcagggatggggatgcattcctcgacggggaattcctatttgccatatctagccggaataaagaaatccggtgctctcatatcatgttaattttagtgaattggggattttcaacagtgcattgatttagccctaaatagcatatatattatgtacacaagagaagggaaagtattctaatacccttgacatctactagacttaacagtaaatttgcttggtactgctagaaacaaagaaactacatacctttccaatattgatatacggaacctgagaatcaattctacctacaaagtccacaatattatcatagttagacattcttctagtccatattgatgagatggcggtaaatttattttctccaagttggcaatgcatgactgtgcagaccatagatgctctccagggaatcatgttcactaactgtgctctcttcctctaaatacttcgaattgtaaaacaatgggtcagtgatagtcaactcgtccaagtgggtgcttagaagttctgtccattggcgaagttgatctcgtgagccttcgatatgcagttttgatttcaatctagggatcgacttctgcatagcatgttcgtgtggagggatcgcagtaccttgtcctgaatgtgagcatccttcagtatactgatcatatggacgtgatggaaaacttgaagtatcttccttgtctacaggcagactgagactgctatctttgacgaagtactctttgctctttgggggagtgggatgcagtttcaggtcatggcaacttccaatttgtaggtaatcaagttcggggagcgctgcacttgtgacctccaaacaaccatgagacagttttggtgacaactgggactcttctggcactagtgaaatgtgggacaatgctgaggccaatgttttctttgcccttgctcctccaatagataataatagagcgtcaaaccaattctttaccttgcccttttcagtggatgggcctctagaaagttcctcacttcttctcacttcgtttttacgaaaagaacagccaggtaatgtgttgaactcttgtcctgtttctgtcatctcttcatcgcagccatgacttgattccaccatctgtacttctgtgtgtgtacagatatcataaaataaatgtaccgtggcctcatttggtagtcctaccagtgtcagtctttttagcttattgcatggcccaattcgtgcatcatgaagctggggcatattatagatttctagctcttgtagatttggtaaattaccaagtacagggatatggtcgcatctctcgatatgagacaatataagtttcaccaggtttgggagcgtaccatatatcttgttaagccggggcatattattaatttctagctcttttaaatttggtaattgactaattgggatatagttacaaccattgatatcagagaatacaagtttcaccaagtctgggagtgtatcatttatcttgttaatccaatcaggaaattcggtgcaaatgtaaccttttatagagagggactgtaaattcctatgaggcctcaaattacccagcactgctcgttgtttaacagaagataccataccagataaagaccattcgaaacccaacgaatgaaactgtcgcatcctgtccagttcaagctgcttcgcttcctctgaaaacaccacattctctaggcacttgatattgagttgacgatgtgtaacatcaaggatttgctggaggatcaaaatattgctgcacctcccatcatcttgcaggcgtacattaaaattgggcagtgtcagaaggtccaccattcttgcaataccttgctccgagtagagagtgaatcctccaatggacaggtacttcagacgaaacaagccttgggtgatgatatcttcctgcagcatacccaactctaactctttaatgggatcttgtgaactttggtcttctgcagaggtacctggtgcctcagaatcactttttgcgccaacccccgagatgttgaggtactataatgtaccaaacttccatcgtggaatcaacttcaaaaagttttgaagtttagatcagcctgaaagattcaaacaccggagttcacggagttcagttgaagactcagggagggcaggcagtttagcacaacccgataaagccaaaacctccaacatcgagcagccagcgtcg

SEQ ID NO: 19432 - DNA, 2927 bp, Oryza sativa
  unsure (1)..(2927): unsure at all n locations
nnnnnnnnnnnnnnnnnnnnnnnnnnnnnnnnnnnnnnaataaaggaagtgattctagacttgtacagtctgataggttcaggtgttggagctctttatgtttgtgaatgccatctggtagttttttcagttttgagcagccatgtagatccaaatactgtagcttgagaaactcacaaatgtaggaagggagctcaacaaggtcaatgtttgttgacagggtcaatgcttgcaggtgatgtagtttactcaacgatttaggtaatgtgccacttaggcctgaaacattcaagtacttcaatagactcaaatgactgatcgagtctggtagttcattgatggtgcatgcactgaaatctaagatgcgcaagaatttagtttctgaataattcttgggagatttcctgcaatccttgaaatgaagcgctcttgctgtattgggcaatatgggatctcgggaaaattcactcaaattcaagaggtacatgtagcggcagcaatttttagtgttggagctactgcagtcactggcatgaaagatacatacttcatcagctgcaattacacttgcaagatcgtgaactatatcatgcatcttgagtacattttgaggctcagtatatcgtgcagacatctgaaaaattaagtttagtcacttgacagagtaggataaataaaacagcaagacagacacattctttctatgcatgataacgaatgcattttatatggtgtgaaactaaccaaactcagcacataaaatggttagaagcttatccggagttcaaattcaatttggccgtcgtttcttaatactagatgcgtacgaccaaggtgcagccgtctacaacaggcatttcttcttcttctttttcattacacgggcacacaccactccaccagcacaccacactcacggacacaaaccacatctgacacctccatgaatacaccccttaacacatactcaaagagacaaagactagcgtcaactccctagcctcaataaaatcctattgaatgtgcgcccacatgtacataatacttaacctgatgggtggtgttactcatgactccatcaccaaaccactgctgcttgcatttgatgcatcaaatttatgtgctactcatttaatctcagtacaaatagctatgaaaaaactgaaaaaaaaaatagtaacattggtacaatattcatctaacatttcgcaagatttttaaatccaaatatcatagcatgtcaacaaaaagacaatattccaattatccaattagtttcaggattaaatttggattgaacttgtggtgcatgcatatgttttattctgatttcaagctttaggcttttttcatgactttgggcccaaaattttagcccaatggtggaagatctggctaggctgcccatgaataagtctattcaacagaagtagactgccaaagctaagcattttttgtgtcctgtgtgcatccaccaccatgttgtggacacctccacagcaaccaaagtgaaaggagggagcgtcaagcttatcaattccatttcaatattagccagagtagttggtatttatcattccactaacaaaaatagtatgcaacaagtgatgcgtctttccattctaaatattggtcaaatttcaattgggtattgaccattgacataccactagtttcggtaccattccgagcaaaagtgatccttccattgaattccgcttactcgattccttcaaattacatttatctataaactcatttttctctatcatatttgttccgattaccaccatttttacatataatatcatgtgaaattttgataaaatattgtataataatactatttggaaatcaatcgaatgggaaaaaagagagaaaaagagttgcggctgaggaagcataccgcagttgccgcgttcacattctgcaaaaaggacatttcaatgagttcttgcaagcagtactctgcgtattgttctgtcgggatggattctgggggctgaatgaatccaagagcaatccattgctgaatcaaactgctcttctgtatgtggaagcctttgggaaagactgacaaatatgcaaagcacaacctcagagaacaaggcatgctgtaataactaagcttcaagttggctataactccgttatctggaaaacgatcatctttttcggcccatatattactatgtaggttttgttcccactcagtcggacgcattcttcctagaaagtaaccaagggattttacagctaatggcaaaccttggcatttctccactattgtctcccgcatcgcttccacgtagggaggcactggtgtcggtactcgtgcttttttcctgaacaaggtccagcagtcttcgtttggtagaagacccaattcaatttgcaaatctttgttcattcggtcagcaaccttcttgctacgtgtagtcacaataaccttgctacctttcttgcagagtctaagcattgcctctaactcatccagcttaaaattattttcttcccagagatcatccaaaacaataagacatcgtttttccgtgaggatagactccacagcaacattatgaattccagaatcaccatattggagcgtatggctattacattgctgtttgatagataaactgattgcattaagatcaaatttctcagacacataaacccatgctagcatctcaaaagctatctgtgttgtgcagtcactaaaagccatttgagcaagagtggttttacctaatcctccaagtccatatataggaataatggagtgttcttcatctgatagcagcagatccattattctccctttctccgcgatccttccgacagtatcctcactgctgtatcttctaggctctaaatgccgactgatataagaatcctgctcctctgtggcaccatctaccttaaag

SEQ ID NO: 19433 - DNA, 11105 bp, Oryza sativa
tcaggctccaagcccttctaagctagcgtctcggattcaccacgcactgagtcactgacctctctccgccttgcccctcgagcagccgctcctctaggcttgttccgcggctgggtgggctgccggggagacgacggcggaggctcaccggcgaagatggccggagggaaggtgtgggcgtgcggcggcgcttgggagaatggtggctgggaagggatgcccggcaccggcgacgccgtccgcacgatgaagttgtttgattttgagatgaatggggatcgatttctgatgggaagctcttcttcatcaagtgaagaagttgtttgaattttgagatgaatggtgaggagtcgattagttgctgcgattaatatccgagtcgccggcagaaaatcactactccagtatggactatggagtactactatttattcttatttttattgatggtagtgctgatgattggcaaccagggtcttcgattccgacgaaatccggtaagatttcgcgaaattttgatgttttgacgaggctcgaaagtaaaaaccgtatgagattttgagaagtttcatttaaattcaaatttgaattgataaaaaaagaataaatcaaataaaatcttataaatattatgatattcatagaacctattgggatataaattttcgaaaaaaataatgtattatgtgtatttactgaaacttacatcaggaaagaaaagaataaaaaattaaaccgaaaagcagcagtatttgacaagaactccatccgaaatttcgatgatttcgatcggaatttcgccaaaaccgaccagtttttgagaatttgtcggcaaatttagagaatttgtattcaaattttggtttatgaaatttgttcggaatttattggtttttcaccgaatttcgcgaaatttcaaattccgccagtggccaaaacgaaagggtctatcggaatcgtaaaccctgttggcaatatgaatgatagagtgtagatgtaattcctcgtttcaaaataaatttctaacaaacctatcaaaaaaaatgtgacactatctatcatatccagaaatttagatttatttatttaggataaagaaaatataagatactgcctccatttcatattattacctccgtttcatattataaaactttctagcattgcccacattcatatagttattaatggatctaggcacacatatatatttagattcattaccatatatatgaatgtgagtctgctagaaagtcttataatatgaaacgaacgaagcaagaaaggaggaaaatatagtatacaaaataatactataattctctatcttaaaacaaaagcaagcacacgcactactacgtcattttagctaaagtattttacttcaataattcaagacaactcaaacttagttggcacacatgtactccaccccctatcactagagttgttttcttttttgtacaagatcatcctaacattcccacaaggacataaagaaacagcagacccttcccgggaaaatttcactgagacaggtgcattccgtgcacgtacaataatcatcaccatcatcgtatcatccaacctacaggaaaacgcaaattcaaggtactcttgtccaaacctgtaggtggccagtgatttgctcccatcggctacaactaccagactcaaaaaaactagacacaggtatgatgctaataagcttagcatgatcgactgatggacagacagtaataacaaataggaaacggagggaactatatgtgtcaactcgatgaactctataatatatggatgatttccagcgccctcctggcaaaaataacgtcctcgtaaatctatcgtcaccatctaaaaccacttgaagaggatgcctccatgggtggcgaagaacggggcaaacacgagcgactcgacagccatcagcttgatgaggatgttgagcgaggggcctgaggtgtccttgagaggatccccaatggtgtcgccgatcacagcagccttgtggcagtctgagcctttcgggcccagggtccttgcatgctcagatgcaccagcctaaaaccagggagaacgagagttataatgtttggcgaatatgggaggggaaaaaaactgcttgacgtcaagtgttgctgtgatggaagatggctgataagttcttacctcaatgtacttctttgcgttgtcccaggcaccaccagtgtttgatgcagagatggcaatctgaaaggaagcaacatggttatgaatgcaatatggcaagagtaagtgatgagagtgtggctgtgaaaaagaatgtgcgaacctgaacaccagaaacgagagcaccagcaagtagtcctgagagggtctcgacaccaaagaagatcccaacaatgagagggctgagcatgacaagagcacctgggggaatcatctccttgatggatgcatcagtggagatcttcacacaggttgcgtagtcaggcttggttgtgccctccatgagcccagggatggagttgaactgcctacggacttcctccaccatcttgagcgctgcgctgccaacactcttcatggtcatagcagagaaccagtatgggagcatagcaccaacaatcagtccaatgaaaactttaggtgtcagaacatcgacagtggagatggcggcacggctcacaaaggcaccaaagagggcaagagacaccaaggctgccgagccaatggcgaaaccctacaagtacaatcatggagatgggaattaactttaaaattgtgacatttgtaacaaaaggaaaaatatttacaagtgcaaacacaattttaaatttttaattgacttcagagtggaaatgaagcataaaaacaacataaaaacactttcgacaagataagcagttttaccttcccgatggcagcagtggtgtttcctgcagcatccagagcatcagttctctcacgaattctgtgactcatgccagccatctcagcaattcctccagcattgtcactgatagggccataggcatcaatggcaagaccagttgcaattgtgctaagcattccaagggcagccacagctacaccgtacattgcggcaaggctgaagctgaggaaaatactaaaagcaatagcaaaaataggaataatgacagatttgtatcccagagcaaggccaaagatgacattagtagcagctccggttctgcaggaatcagcaacgtcttggacagggctggacaagggaaattcaaggtgtgagggacatgagggactagaagcaaatatataagattacagacaacattgaatatgatcagacttataagcacctgtaggcgtgcttgtgtaatactctgtcacaaatccgatgattagtccagcccaaagaccaaccgccacacacaagaaaagttgcctatcaaaatcagggaaatgaggtcaatgattttaacaatgaagttttaagtaaaagatggaattccaatttaaatatgggcataccagttatacacagtcttctgggcaccaaagttgaatattgtgaaggaatatgggaggcctaaccaactgacaagtgcaatgccaaccgtcatcacaacggtggaaattataagttgcttcttgagggcaggctcaatttcatcaacagccttgatctcaaaaaaatcagtggcgaaaagtgtggttatcagacaagcaatgataccaactgagctaatcaggagcgggtacagcataggagtgaattcatggttaattccaaaagaagagattgaagcaacgacaagagcagcacaagatgactcagcataggaaccaaagagatctgaccccattccagcaatatctccaacattgtcaccaacattatctgcaatgacctgcaaaaggaggaagaaatgatcattcttgcatgcacataaattcctatcgatgttttaatgctttgctcaataacacaaatcattatgaaaagaacaaaacaaattatttcaagtaatattaagaaacaagtttttaaagcgtcaggaaagaattcttacagctgggtttcttgggtcatcttcagggatattcctttctactttcccaactaggtcagcaccaacatcagcagctttcgtgtaaataccgccacctacacggccaaatagggccatagaagaaccaccaagaccatacccagtgatagcctcaaaaagaccttcccagtcatcaccataataaattccgaacaagttgatggcaatgtaaagaacaacaaggccacttgcagcaagcaggaaacccatgacagcaccagagcggaaagcagtaatgaatgcccttcccaacacccttccttgcctcaagggttgtcctggcatttgcataagttgcaatcttcattccaaggaaaccagatacaagagaggtgactgcaccaagcacaaaggcaacagtactgaagatagcatttgcaagggcaggcttgcacatcctatccttgctgtagtggcaaggttgactctttgtgctgaatccctcaacagatccaaggaagaggaagatcaggaccgcgaaaatgcccatgaatagtccaacatacttgtattcagtgaagaggaaagaagttgctcctgtttacagtttaaaaaaaacagtatttagatcatagacgcatacaaatatacaacaattagtcaatgacaagaaaaggttagcgataacaataataatagctgaaacataaaacaccaaagctagcaacgcataaatatgtttataattagaactgaacctgtttttctaattgtagtgtttgactggactccataaacatgagcaccaaaatatggtaacaaaggctaaattaaatagtgaaatagatgggactttggtcactggtcagtaacccaatatctcaaatatccaaccaattgaaaccaacaaaaatgtatttgattaaacaaagttccaatcctagaaagtttccacaaaaccagattcacaaattacaaaccatgcaaactattagcatatctagcatttcctgtgaaacagatcatatgcatagcaggactccacaagtaaggcacactaactgcaagccctatagtcttctaagaaagaaatgttgaccaaacaaatatttccaaaaatacgtttgaactttactagaaaaggacagaacctaacactttcacaatattaaaactcacccaagcatcgctagagatgaaacctgccaagaaagcaggcgcctaacataggacaaactacataaatcaccacctctcagcctgcaactgtccttgaattataaccttacatgtaaggtttatgattaatgaatggaccacaagatcgtcccgtccatgtgcgccgcatctaggattccttccaagctaggtggatacagtcaaaatgaaactattttctccctgcttcaataatgcaggtgcgcagaaaaatcgttatcttcttatcctcctaagagcaataagtaggaccactggtccaataacttgtcctcctccatcagtaaattctcctatccccacagcatggccaccgcagggctttacgtgagggcctctaagaactgagcaattcaagttctgatctaccccactaaaaatatctccccaataaaatatctcagcagacgcaacaaacgaacttaattgacccgcgattagcacgcactgactaagaattattataacatgtgctgtgtaaagtgggaacatgattgtttaatgtttctgtagatccaactaacaatgtaacagttcacatctagcatactagcatagttgtagtttcgaaaatactatgcatacgatttctgcgtacgattctagtatgatttctaactgatggtgaacgccgtgcgtgcatcactagaaaacaggagacaaacgttacgggctttcgctggaaatcgttagtcgtacaagtatcgtacgtgaaaaatcgtatgtgtagcagctctcgttatagtttaggcacacagtaaattcaatcaaactcagagaggaatctcatgattccacacaatagaatactactttagccacagtaaattcgatagaactcagaggaatctcatgatttcacacaataaataaagtaacacaagctcacaagcactactgctagacacgcaactccgcttgattaaaagcagcgccatcttaacctgagctttataatctcttcacagcaatataaaaatataaatcctgtgctgcaaattccccacaattatatcaatcttgtgctgcaaattccccataattgatgctcggataagctacttttgaacatgttcacgccacaagcaaccaaaaaaaaacaactaaattagcaaaaattagcgccagtaaccgctgcgacggcacgagatctacacaactacgcgcgtgctcagatccacccaaaaaaggccaaaaaaaaaaacacgaacagcacacgggggtgagtcagtccccctccctcaccttcggagatggcgtgctggatctcggagcacttctcgacgacgttgtgctcgttgagcccctcctcctcctcgatgaggtactcgctggcggcgccgccgtccttcccggcggccgcgccgggggacccctccccgccgcgccgctccgcggtcatcttcaccttggacaccagcacccactgcaccaccgcgaacgcgatgccgaccacggccgccgccgggaccagcacctgcgtcgccaggtccggcagtatcgccgccattgctacctgcgagatcctcgcgctaggattcatgtactctcctcttctcggaggaggattcgacgcgaagaggaggaggagaggagaggagaggaggtgggaggaggcggggttttataaggagaggaagggggagaagaagtgtactgtagtagtactactcctacggtggggaaggtggagggtattttcgtaatttttcagtcgttcggattcttgactaatttgactgtattttttagtgggtgatttctcgtgtttatccggatgaaacggagcaattcgggggttataatttaagctatttgattcaacggaaattcatataaattttagacgattttatttctataggaattttttctataaaactctttgaatcaaaggaatgaaccctatggaatcctatgaaatttctatgaaatgactctttcaatataagttttggaggaattttaacaagaggtagaacctcatgaaaaaaatcatttgagtctttatctcttctcaaattccggtatttttcctgtttttcctgtgttttacaatcctctgttttccacttacattctatcagaatcttatgtttttcctatttctctgtttttttattcatgtgattcaaaggggccctagtagtaccagtagtactttttataaacagtactagtactaagtgagtatggttttatcgtagtgatacgtagtgttgttttgagttgaagcacgtacgataggtttgtgggtttatcgtatcagcaatgaacatttgtatgaccttattttggcataaacgcgtaataagatcactggtctctcgtaaataatttaattaatcgtattgcatcagaattactttgtttctcaacttctttaacttttcaatatcaattgagttggttggtttgaactcctgccgttcaaacaaaccttgtactacgtctcacctaatctgacgtgtattagcgtgtaggaatactgtttttttttaccgtgttttaggataaggaagtggataatggataaacacaccggcaaagctcttccttctttcccggagatttctccctattttttttctctcgaatgacacttaacgaaaatattttactacgagagattacgagacgaagacatcggagtacgtgcagaaagcttggttaatttctctcgtacaccaactcgttgaataattcggcctaatagcctaaagaatgggagataatcatcgttgatcgaggtgatcttctggccggtgatgactcatcactgactcgactcgatcatgagttagtttaatggtgaaattgaccggttacagacatctggtttgaataacgaacatctttattttttctcatcaacctaaatccgcacacgggacacacggcacggtacaattttgactcgcattgttcgtgccgatttcgcgttaattacagtagtagcagtacaccatctccgttttaaaatataaaagtttctaaaattagacgtggatacttaaaaaaataaaattaaatatgagaagaatgtaattgttaagaggagaaagtagatgagtatttaaatggtgaaatattataatttgttgagacgagaatttaagtgaagaagttattatatttcagaacaaattttgaatattttggcatgagggagtagctagacagtagtagaactagtgtaggagtatagtcttaagaaaacgatagtactaatatgtcgtgatatattaagaccctctttgtttaggcttataagccaacttataagtcgaaaagtctaagcctaaacaaacaagcagcttttccgtttggcttttttgaagccataagccactctaacactattaagccaaaagctaggttgaagaagcttttttggcttatgtgaggtagatgtatgactcaaccactaaacttaggacattaaatccaccggcttataaatcatataagccaataaactaacttaaaagtctagaccaataagtctaagcctaaataaagaggacctaaatgtaaattagttccgggatcgacagataaaaagaagcataaatgatggacgaggtgagccggcagagcgaattaattccacgtggaacttcacccttcaatagtaattccatccattatccactatagtagatatcgcttttgcaaaagttagctgatgcacggcatgcacgctgatgtagcggcacttatctgagatgattgaaatgtcaaaaccagacctttgttaagtagattaagctattgtaaaatctagtacaggtaactagtaaatgtactgcagatgatggttataagtattatattcttttgacaccagtgattaaccattcatccctattatctataagcaatgcctctaagttgatgcaattttcagagagagaagaagaactgaaagctttcaccacctcctattgcagctttagtaagagtaaaaggcatctttcaattataaagagtggaaattactgtcaccaccaccagtaggtcgagtaaaaagcatttttcaaaaaaaaaaaagtggaacaattactgtcaccaccaccaatagactttagcaagagtaaaaagagcgtaattaatatctgatttaatctgtatggacatggagcccaaaagatgatgcatgcatggtccctggtgatagcttgccttacaactctgcacacacctacaatatgattgcattagcatgcagccaccagatggatgctttcatggagcaatgtgcatgcatgcatatttggttgttgttatactatactactcctactcaattatttggactctttgaagcatctcacaaatcaatgtcggtgctagagacgtgtaacactgaatatattttggaatccacttggagagctttgctgcagttcacacaaccatggatccatcaattatagctggatttggattaactattcctagctagttgaatagttaaatcaaagaagctatgtatgcaaaattaacaaaggccgggtttagttccaaactttttcttcaagctttcaacttttccattacatcaaaatttttctacacacacaaactttcaacttttctgtcacattatttcaatttcaaccaaactttcaatttagcgtgaactaaacacacccaaaaggtgtgagagatgtgcaagatcaagctcaaatggtatcctatacaacagagcatgtgcttagcttaatttaatcgtgtcttgttatgtaaccacgcacactagtactgtactgtactgtactggacagcaatttatttgagtattagtagctaggaagcagggggatcagtggttgttaaggggaagtagtgagaagagatgaaattaaaggatgtaatcacatgctgcatgctgctggtgaggagtaattattttacaaaggctgtcattggtttggtttgaaggaaacatcacttgcatagctggaattgaagcagtcgtcctaatattaggtagatctaggtccagatggaccagatttatgacaatttctttatacacattaagatacaaaatacaggcatgctgcaattatacatgacaaataataaggcaccaaaatagcaacctttacttctcttatacagaaagataatatgacacccacatatatccaaaccaaaataaatgccaattaaccatctccaaccttgcgaaaaagaaacgcttaactcaaactgctcaatgaaatcgatcggcacatgttcattaatatcagtgatagttttgttgctaatgacagcaggggcagatctacggttctaggaccgatgtcaggctacatcaacgactttcgacaaaatatataacaaaactgcttattcatatgttataatataattagcatactatgacaccgataggcacgttatgatatcaacgaatcgatttttccgccacttaatgacaggcaaaaacactacagataaaacaaagtacaatgaagctttcaaacaacctactggcgagcaaaaaacgttttctaaaatgataacacaaaaatttgtgatgcagatggcagtaccaatgaattcagaaatacagttggcactgagttgtaacttgtaatgttcgacaacaaacaacaattcgaatgcgactcggtggcgaatttgaaacaatagatccagccaacaaagaacaattcctgtagtatagtgcagctagctgtgcaaaagctttgctccataaatgcatattggaacacttcacatgtagttgggtgcaaggaaaattggatcaagaagaagatcccatttctcatgtgagcatatgccttgtgacttgtgagatgctagttaagtagtcacatgtaccatctcatagat

SEQ ID NO: 19434 - DNA, 6570 bp, Oryza sativa
  unsure (1)..(6570): unsure at all n locations
nnnnnnnnnnnnnnnnnnnnnnnnnnnnnnnnnnnnnnnnnnnnnnnnnnnnnnnnntcagatttggagggaagcctaactgcaataattcgggttcatgtagagctgtatcagtatgactaaatcagcaagtcagaaactaagctgcttgggagaaaattttaaatacgagtactttccttgtcttctttagcggttatgaaagagagctggccaaaaaattgacaaaaaggacatgacaattgatcctaaaatcaaattttatgctgatgctttcccaacttcccaagcaggacatgtttttctacaaatgaatgaattaactcttataaagttaaaaaatagatttaaaatattttctaagaaattcatatacatagaaagtttatatcaaaatcgcaccgtttaggagcccacgcagcacgccactgaatggaatggttccatttcttagaaaataaggcagatcccattgtcttttcctatttgcttgctcctgttatgctccattttactgaagatttgagagtcaatataatggatggtcatggtctcatggaagaaaagagatcccagtaggtattttatccgtccattgtcagtactgatgagtagagtacagcaagtggactgaaggagcaattggtacagctcaattgctcaaatactatcttttttttttcttctaccactactatcttcatttgatcatttccttgtcacagccattactgctgctgcaagtggtctcctattttttatatattcttgtgaactttcttaaggaatatattccaggtttccagcaaaagaaaaaggtcaattgggacgaagaaaaggcagaaaaaaaatgccatgatcctttttgcacgtagcttgcatgggacgccatcgttgaagatgatatctttgcttgcaatggcaagctcggaccactataaacgatcagggtcccatgcatcatacctcctccaatcccccaaactcagacgaagatgacgatgacgaggccatttttgcgaaagaatcagtcgaattggctaaaatacaaatgccaggagacaaattagtccaaatccaaattcaaaatgatgggggtttgtgtctggtttgtagaatttgtcttgtgttcttgattcttcagcacaaaaggttgtgtgattctgtgaatgggacacatcattttcatgaggtgcaaggtaggtgtgatctggttcaggcggctcctggttcttttggtgccttatctttttcaggccattggagagcacaaaatttcccatggttgtgacttgagtgtgaccagttgtgtgaaggtatgtagtgagactctgagagtatgcatggattgtactctagtggaacatgtcccatctggtggccacatgctactagcctagtatgctacacaagtgtcaaattaagcaggatttcaatcaaataattggtttccagctttctttcggcttaaaatctggcaagagttgtagtatagacagatacgtagacatgttaatcaagtgaagagcaagcaagcaatttgagtcacctgcatatggacatggcctaatgtttatcaagtcgagagtacatcataacgtcatgtgactaatagcaggtcaacatcaagtatgagtatagctatagttgattcaacaaggcgtgaaatatacgaacatccaaaattcaacacacttaactcagtctgggctataataattcaataatgcatcgctacttcagttagattcagaaggttctacccccacaaacctattacatcttaaagtacaataaaaatggagaaagagtttccaccttgtgctagggaaagattctattcaagtgtggtgttcagtactgctcttcatcccatcataaacttaacttaaaccatgcagtatccccgtgtagtatgtctagctgtttgctcttgctaataggccagagaaggatggaacaggggagttcctcatttgttcttgagcttgctttatctcctcgggatcttcaagtgtaaaacagagacagtcaggtagaatacatacataatatcaacaagtattataaggtaacatttattaaaaatatatacatcattcatatcaccaaataacataagctctttcagccctttcatgtcagcagtacataaatattttgtaaaatgcgaagctgattaaagaaacaaacagctaacccacaaatgttttgctcaaggagctcaagaaaggaaccactgtaaaaacatatcatagaatgaagcaacgaactgtaaataaaaaactgagaaggtacataacaggagtagacaatggcaactaaaaatatacacaaatacaagctaatttaaaaacaaaaaggcacttttaccaaatatatgctttttaccattatcttgcatcctaactacagtgatggtgtgggtattaattatatcgccttgctactttgtctttgcatggctgatttgttcttgattagatacagaaaagcaacgtaattaggtaactataatatgtcatgcttgtatgctgcatgcggtggagccccggcaccagactaggttcgctgggccttggctccacagctgcgtggagcaaataatatgcgacaataatctgatgagtaagcagaaaagaacggggcctaaatttacaaccaatggaacagaatgagagatgtggaatgaacaacacaattaaatgtaatatctttctgcaaaagtatgatacgagctacatggtgcaaaatgtctattgggcttgaatcctgttctgcatagctgctacttgtgggcacaaaatatagtgtaataactattacattataactcaaatttggacataaaaggctaaaagtgtgcagcatacctatgttctccatcattttgggcataacgaagaccattatgaccataaaaccaagcatcatacccatagggctcttcaaaagtgacataatggagaaaggctcccttttctaggaaaaagaaggggggaaattgactgcttattaaatattatacaatagaaagtactgaagaaataagaaacatgaggttagtattagtcacctcgtagtattgctcttctctgagaggttccaacacaagctcatttagaactcttctgttttcagtcaatgctgcttgaatgtgcccaggattcctggcactgatgtctacccgaacctatcacccagcataatagagaatgaatcttgatgcccatttaacccatgttacagaaaaaaaaatgactaatgaacacttactggtgaaaataagtagcccaatgaggagacctcaattaaatgagtaccagctggcacattgtggcttaagcatatcatgtcaaggaggaacaaaaagcaacatagtatgctcttctaacattgtggcattgctgcccacaaggaaacattggaaaaaaaataacaaacaagaatactacaacaacagagctagatttatttctattagcaacccagaggctatatctaattttcaggaataaggctacccataacagataggaaatgtaagatatgagacatccaacaatagagcaggctaattaaatttaatgaaaaatgactaatttccctaatccgggaactcaaaatggagctgaaaggttgtaaacatatggttttgcagattttgcaggatacaatgcaaagtagccatctggcctggcaaatgtaaccctctgaccaccgttaagtatcacttttgtgtttgatgtcttggctggaagaccaaagccctttgcaattgcacttgcagctataagcacataaaacagaaaaaaaaaacgacatcaactggttatcattataataattagtacaatttggcttcacgggtatggaaacttaattccagataaggagcaaatgcaagatccctgagtgcaaagaaaactaagacttgccttgacaatctgagttcacatgaaatatccagcactgaaaaacccatggttctatccacaagctaacaatgttttcagcaagagaaaatgtaaaagttaaaagcggtctgaaacactatacagcagccatttattattgtggtctgaattatttcaataagcatggttgggaaacgtgggcttcaatgctcatgccaagttgccaacatatctatcgaacatgttgtaacgcaggtagagactcgtcctagaaacaaaaagtgccggataaactatgatggcaatcacaacagtacaacacacggtttttgcaattcaaaattccacgaaagctcactttcaaactcttgtaaaacatagctaaaatcatcagatattcataatcaaataccccctgaccaatgaaagctcagctaaaatcagtcaatacgaataccaactgtcatctaagcaaaccccatgagactaagtaaccaaaaccaggggctcatcgaactgtatcagtgcatgatctgaaaaacagcttgcacaaatgcaatgaattccacgagtgcctgaaaaatcactaactaaattaacaaaccctcaaagctgctaagtagtcgatagctaacaaagttggctagcgctggcttgcgctaagacggaactagatgagctcgataaatagtgtatcaaatctcgttagtcactaccttaagtacaaagttagggacactttaatcggcagatctcgaaaataattccagcaaattgaccatagccaactatgaaatcgaatgttaaaaaaggcttttatccccaaacaaccctgacacacaaagatatctgatgcacctaagctacacgagtacgatccccaacgatccgagcacaacaacaacctcaatgcacgcatctggcacaaaagctccacggaattcactcgagccatagggtgagaatagccggagactaaccatcgatcttgatgcggcccgcgatcgtgtgcccctcagcagatctggagaaccaccaaagcgagagccgtggtcaactcgcggtcgatttggattggatcacggagcaaaacgagattgggggtggcgcggcgagggggggacatacccgggctgataggccgccgctgcgcctacgcgcgctgccacgacggcgaaaagtactaggaggaggaggcgcgcggccatcgtcgcggcggaggtcgtcgtcgccgccgtgctcgtcgcggctgctcaactaaacaaggcgaggcgaggcgaggcgagagagagatccccttggacttggtggatttggtttggtattctcgtcgcgggctttcctgcggcttgtgggcttcgcgagcttccattttgtggggtttattacttggaataagtccacctagactccccgatatataggttaaatctaattcacgcccctcaaccgtaatacggatatcttgatccttaactgttaaaaccaatgtaattgactcacaagatagtatttataatggtatttgctaacgcagctcgtattcacatcaataccactatgaatactatctttagagtcaaattataacggttttaataattgagatgtcaagatatatatgtagcatatcttaatactagcaaagtcctactacttaaaaaataattagccatgaaagtctaagatttgagttcaagtaaataagtctcattacgaagaatctagctagataagttacgctgactttagaaaatcaaagttgtttattgccgaacgaaaattagattttacgccgttttctccttagattgttaaaagaacagctccatatgataaaaggataaataaatcgattttgatggaggcatatgaagctggcctgatttccacccatgccgatgacggtaggggagcggtatggcagtgacttcaaagtttgttaggtttaacggacaaaatatattgcatcatcttgccatgtcataagctactttctcaaatataaaaatactaaatctatttggttggacgtgactacacagctaatggtagctggtttgtttaaatcagctaccactccatctatgagagatcatattccacctatacttcaaataaaattttctcttaaactactcatccaatctacgatccgattacaccgttatgttcgtaacaattaaatctttataacaagagctcacatgattatattttgatgaaaaattataaattacttttataatatatctaaattacttttagatttcactaaattacttcttcgacatataaaagtaaattcaataaagcttaagtaatttacatatattataaaagtaacttataacaaaaataaagtaactttaatgcattcatttttttttcattggacgtgactacacaactagtggtagctggtttgtactccatctagtgtttcctttcaacttgaaaaaaatgcaatagtatgtttccattttgttttaagatacttttataatatatgtaaattacttttagactttattgaatttacttttatatgtctaagaagtaacttagtcaaatctaaaagtaacttatatatatgatnnnnnnnnnnnnnnnnnnnnnnnnnnnnnnnnnnnnnnnnnnnnnnnnnnnnnnn

SEQ ID NO: 19435 - DNA, 3186 bp, Oryza sativa
cccccattccaccggcgcgttcgtctcgggaggttcgaatcaggtattcgtttcttcctcctccgcgcttcgcttggtgagcgggcgcgaggcgtggattgaagatccatccgaacttggggtgtgcttggattgggtgccctctggtagtacagcgccatagctgttcgtgtttattctgtacgaatctctgctggttgtaccagggaggtccaggacgacacaccatagccatgtggctgattcatgtgcacaatttttttatttttttaaaaaaacgtttaatccctcatttcgagtattttctgtggtcatactcgtatgaatctcaatatctcataggtgtttgttttggtctcaattgaacatgtaacaggttcaaaacggggatcggtagtgttctgcatcagtgatgggctggagatttgcgttgttactgttacatgttcttctgtgccttgtcaatggcgtctcctgtggccgcacgagctcttacgtgcgtacggagtacccatcgactgatatacctctagaaagcgaatggtttgcggttccaaacggctacaatgcgccacagcaggtatctaaactcttctgccagatcagttcattgcaatgaatcgacggtgttttaattgattggtctgctgccaggttcatatcactcaaggtgactataatggaaaagctgttatagtatcatgggttactgtagcagaacctgggacaagtgaggtgctctatggtaaaaatgagcaccagtatgatcagagagtggaaggaacagtaacaaattataccttttacgactataaatctggatatattcaccattgccttgttgatggtcttgaggtactagacttcattttcttcatatcgtttaggctttgcattttatacttgcatacaattgtagaaatatttgtccaacattatgtttacccatgcaaaatactaaaatagaataacctacaacatcatgtttcctttgtaaacagcttagacatattctaagtaactatcacacaaccttctcacttataattccataatgatctactttagctgtaaacttagagttattatgcacaaatttgatttgacagagaacttttcttcgtcaaatttcaattgagtaaggttatcatgttgaaacacgatgctcacctgcacaaattattttcacacactttcttagttctgtggaatagttctactattctagtatgatgcattaacaaaatactctgtgtgcacattattttgttgttagttccaatttaaaattgtaaatatataaaattactatattgttttgcagtataacaccaaatattattataagattggaagtggagattcagctcgagaattttggtttgaaactcctccagcaattgatccagatgcatcatacacatttggcataattggttcgtcttttgttttctcaagtatttttttgttaacagcatgtgtcatcgaattactttggatctctgcaacatctcttctaggattttacctaggttgcatgagtcatataagatagatctcaacaagattatactatcagaaggactggaaacacatcctctgttcttgtcaaacatcctagctttaggataagggaatacatgaacggaaaaaatggggatcaatgacttcatggaaagaaccactatgtcaagatatggttatagtgtccgagcttgttgatactaaagtcttctggctgtgctttgctaggtgatctggggcagacatttaattccctctcaacccttcaacattatgagaaaagcgaaggtcaaactgttttatttgttggggatttgtcatatgctgatagatatcaacataatgatggtgttcgttgggattcttgggggcggcttgtggaacgtagtaccgcttatcaaccatggatttggagcgctggtaaccatgaaattgaatacaggcctgatctggtatgttaacattcttctcatctatacaccagttgtttttttttaccacatattcctctgattggaagtagtgatttctcgacattttgtaaactcccaacttttttggatttttccttgctttagcatgttcagaagaggacaattacaggcaaataatactgaagaaaatagatatgtgatctatagatctttgtattagtttattttttcttatagctggctgtacgtggatttacacactgacaaggatctgtgcttataagctactccgtccgtctcattttaagtgcagccatggttttccgcgccaactttgatcgtccgtcttatttgaaaattttttgaaaaaattaaaaaccataagtcacaagtaaaatattattcatgttttatcatctcataacaacaaaaatactaattataaaaaaaattcaaataaggcggacgatcaaagttggacggggaaactcatgattgcacttaaaatgggactgagggagtaataacttatccattgttcagaataacactgcagttccacctgagcattttaactagctgacatagttgtctttctttaaccctgaccgcattcgtatttatgttttcagggagaaacttctacatttaagccatatctgcatagatgtcacactccatatttggcatcaaagagcagttctcctatgtggtatgcagtcaaacgtgcatctgctcatatcattgtgctttctagctattctccattcggtaagataaagatcctttctctgacttgctttgttttgtatatgccattaagtctgtacaaaccaccagatttagtggtggcggctgtggtggtgatagtgacttgggagttccaagtgcttcacgtagttcaaaattccaagtcaaggaggggcaaaagtagcacttcttagacaaaagaaattatcgtgttactgtcttcttgtcttcttactgatccaaatgtgagtatgacgatattctttatctctgatgcggatggatagaaacataaagtcttctctggtttgattgaaagtttgaaactactaataatgcaaggttccgcgttccagctgtttgaaacctgtaacattgtgtggggacaggcatggatgctcccttgaatgagtgcagatctactagtatctttttttcattggcgtaatatcctgaccatcatctactatatttagaa

SEQ ID NO: 19436 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnnnnnnnnnnnnnttcctttcttgagctccttgagcaaaacatttgtgggttagctgtttgtttctttaatcagcttcgcattttacaaaatatttatgtactgctgacatgaaagggctgaaagagcttatgttatttggtgatatgaatgatgtatatatttttaataaatgttaccttataatacttgttgatattatgtatgtattctacctgactgtctctgttttacacttgaagatcccgaggagataaagcaagctcaagaacaaatgaggaactcccctgttccatccttctctggcctattagcaagagcaaacagctagacatactacacggggatactgcatggtttaagttaagtttatgatgggatgaagagcagtactgaacaccacacttgaatagaatctttccctagcacaaggtggaaactctttctccatttttattgtactttaagatgtaataggtttgtgggggtagaaccttctgaatctaactgaagtagcgatgcattattgaattattatagcccagactgagttaagtgtgttgaattttggatgttcgtatatttcacgccttgttgaatcaactatagctatactcatacttgatgttgacctgctattagtcacatgacgttatgatgtactctcgacttgataaacattaagtcatgtccatat

SEQ ID NO: 19437 - DNA, 741 bp, Oryza sativa
  unsure (1)..(741): unsure at all n locations
tattgttttgaatgatctctggaaagaaaataattttaagctggatgagttagaggcaatgcttagactctgcaagaaaggtagcaaggttattgtgactacacgtagcaagaaggttgctgaccgaatgaacaaagatttgcaaattgaattgggtcttctaccaaacgaagactgctggaccttgttcaggaaaaaagcacgagtaccgacaccagtgcctccctacgtggaagcgatgcgggagacaatagtggagaaatgccaaggtttgccattagctgtaaaatcccttggttactttctaggaagaatgcgtccgactgagtgggaacaaaacctacatagtaatatatgggccgaaaaagatgatcgttttccagataacggagttatagccaacttgaagcttagttattacagcatgccttgttctctgaggttgtgctttgcatatttgtcagtcttccccaagggctcccacatacagaagagcagtttgattcagcaatggattgctcttggattcattcagcccccagaatccatcccgacagaacaatacgcagagtactgcttgcaagaactcattgaaatgtcctttttgcagaatgtgaacgcggcaactgcggtatgcttcctcagccgcaactctttttctctcttttttcccattnnnnnnnnnnnnnnnnnnnnnnnnnnnnnnnnnnnnnnnnnnnnnnnnnnnnnnnnnnnnnnnnn

SEQ ID NO: 19438 - DNA, 1503 bp, Oryza sativa
agtacagccgcagctgcagctcggcggtcgccggcggcagctcgagcgaccactcgccggcgtcctcgtcggggagccccctcgcgcactgcacgcccagctccagcctggtcgcgttggcaagcgcgacgaactcctccgcgtacctgcactcgaacgggacgtcctcccggtaaccaatgtgaggcgttttcacggtgtcgccgccgccgcagcagcgccgctgaagcgtgcgcgccatgctctgcacgcgcggtttgctcgactcgccaagaggcgcgagaagcccctgcacggacatgctgaaccgaacgttggggagccgggtgtggagatgctgccaccgccgtgaaacccgcggcggctcgctcggcgtcggcgtaggggcacatggacaggatgggcacgaggatgtcatcggggagcttgctgatcaggtcctctttgggtttctgttccgcgggtagtgcgttactgcgctgatttgcttgccgtcgttgcgatggcttcgacacgtctcctctctttttgttctgcctcttttttccagccatgatgagatggcagcagcagacaaattagagcaggtacaatagcaggctattagccagctgtaaatatattttaatgagataaaagatgagagagaagagcagcatgctacagatatgtagccagctacagcacggattccaagacataatgtgtatatgataggtgggaccatatattagtagtaaagtaatcaactattatataaattggctattagattgactatagataaattggagctaatagtgggctataatattaaacttctcttaagatcaacgattggtgtcacttggttgggtacacgtaccaatgagactgcacgattgtattcattggctggacagatgtgttcccaattccgactcggactcaaaattcgattcgtcaggtactggaatatgaacatccaaagctcccagacccatatatactctctatcaattttctccaaaccaaactggactcggagatcaatagatcatgtcttgactgccggtggatacgatgctagtacggaccatcgacggccagcacaggcgcccacggcggggtcaatcgttgttagatagatgacgttgttgagtttttatcacacatttaacgttcttattattaaaaaaaattatgtaattataaagttttggaaaaagataaataattaaatatgtagttaaaagttaatgatatcatctttttaaaaacggagggagtacgagtgagccagaagaaagccacgttgacccaagttgttacacgcatgtcatcatggaaagactctcgctcccgcacctcactccgattattattccctccaaatccaagctcagttcgatagagctgaggacaaatatgttgattaactaaataacaattattatatatttttaaaaaatatttggttttttaataaacacctacatgtattttttttagaaaaaacgtatt

SEQ ID NO: 19439 - DNA, 545 bp, Oryza sativa
cgatagaactcagaggaatctcatgatttcacacaataaataaagtaacacaagctcacaagcactactgctagacacgcaactccgcttgattaaaagcagcgccatcttaacctgagctttataatctcttcacagcaatataaaaatataaatcctgtgctgcaaattccccacaattatatcaatcttgtgctgcaaattccccataattgatgctcggataagctacttttgaacatgttcacgccacaagcaaccaaaaaaaaacaactaaattagcaaaaattagcgccagtaaccgctgcgacggcacgagatctacacaactacgcgcgtgctcagatccacccaaaaaaggccaaaaaaaaaaacacgaacagcacacgggggtgagtcagtccccctccctcaccttcggagatggcgtgctggatctcggagcacttctcgacgacgttgtgctcgttgagcccctctcctcctcgatgaggtactcgctgcggcgccgccgtccttcccggcggccgcgccgggggacccct

SEQ ID NO: 19440 - DNA, 306 bp, Oryza sativa
ggaaagcctgaaactaacaagatattctaaacgaatatgggtgctaagatgagatggccacatgacgtagcactttggatttgagcaatcatcaacaccagaatcatatatgtcactgcttggaaaagaatcttgtgatccaggcatgacagcctccatgttccccaaaatcaaccggcagagcaacatatattgcactgctttttcgccaacatcacaaagaccaacactgtcaagccagatataatgtaaatacataaacaattaaaatggaatgggcaatacatttttctaagtttataaaaa

SEQ ID NO: 19441 - DNA, 979 bp, Oryza sativa
cactgagttgtaacttgtaatgttcgacaacaaacaacaattcgaatgcgactcggtggcgaatttgaaacaatagatccagccaacaaagaacaattcctgtagtatagtgcagctagctgtgcaaaagctttgctccataaatgcatattggaacacttcacatgtagttgggtgcaaggaaaattggatcaagaagaagatcccatttctcatgtgagcatatgccttgtgacttgtgagatgctagttaagtagtaacatgtaccatctcatagattaacacaaagtaaagcatatggttcacacttatgcatagagataatctctcacacacatcagcacacatccatggatggtaggcaggtctaagatatttttttccttgtttattgcatggatttggatttatatactaatcataatttaatctttttgcaatggtaggtgagacacttgatggtgatgttctgtctatactctctctagattcatgggagcaacccattttccatcacgatgttgccgacactttcttctctacaaggaagaataaagaaagatacagatggtaaatacagcacggcatacagatggtcagatttggagggaagcctaactgcaataattcgggttcatgtagagctgtatcagtatgactaaatcagcaagtcagaaactaagctgcttgggagaaaattttaaatacgagtactttccttgtcttctttagcggttatgaaagagagctggccaaaaaattgacaaaaaggacatgacaattgatcctaaaatcaaattttatgctgatgctttcccaacttcccaagcaggacatgtttttctacaaatgaatgaattaactcttataaagttaaaaaatagatttaaaatattttctaagaaattcatatacatagaaagtttatatcaaaatcgcaccgtttaggagcccacgcagcacgccactgatggaatg

SEQ ID NO: 19442 - DNA, 524 bp, Oryza sativa
  unsure (1)..(524): unsure at all n locations
nnnnnnnnnnnnnnnnnnnnnnnnnnnnnnctggacggcaggatgcatcatagcggcaaaggcggcatgcagcagcagcagctagggccctttgtggatgaaagaaatgaaaaccccaacccccacccatatccaggagatgtagcgagcatggataatctgataatgctagaggccagattagggaccttaattagggacgggccttccaccataaattaatacatgtgtcgctcaatagttgacggaaatgcagctgtacgttaggagtatatataacatatccacaaccacagacaccataacactccatatttctccatctcatgagacaagaccggccacttgtactagtaaccaggttccataattcttcttgacgctttaaatagtaacacgatcttcgaaatatgtgtttaaatatatttttctattataatatatatataataaattaatacgnnnnnnnnnnnnnnnnnnnnnnnnnnnnnnnnnnnnnnnnnnnnnnnnnnnnnnnnnnnnnn

SEQ ID NO: 19443 - DNA, 1277 bp, Oryza sativa
aacttggcctcaagtgcatcccgcatgtccttcccagaaggcatgtgcatgtacacgtccactatgttgtcagcgagtacactgatcaatgctccacggaacaggcaatccgaagcctcgaacttagcctctttctcaggagaaagaggtgggtcacttcgtttgccccgtgaaacatagaagcactgcatcgctgtcaaccacaatagtgcacgtgttttccatctcttatagtttggaccatcaaaggcatgtggtttcagtgcagcagcaaagccaactaccgaaaatgacctatcaggtttttggattgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacatgatcgcccgcccgtctgtgcaaacgtcgcagcaacgcgtggtttcggaggcctactctcccaacgcgtgtgcacacactcgttgggatgggattaccgtagcaacaacagctttggaaaatggatgaaagtgtgtcttctttttctcgcgggagatcaaatccattcccattttataagaggaatggaagatgaagagtaagagtcatggaataggaagaggaatggagcaactaattgtcatcaactagccatgaaccatccttcactacacaaccatcaaccaacaatcaattaagagtaattgatgtaagttaccaatggaataggaagaggaatagagcaactaaatgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaa

SEQ ID NO: 19444 - DNA, 878 bp, Oryza sativa
tagtggctttttcaaaaatattagaaaaatacagagtccagacaaatcacagaaaatatgttgacaggcataacatcatagccataaatcaaaatttcttgtatgtaaccaaatgttgctaaatccttatacaccagagaggataaatttttgacagaaacattcagtgccatataatgaagagtatagagagagatgaatataattcgaaagcagatttaagaggtacaatacaacaaataagagcccttcaaggtacacccatgaggccattatccctccaaaacacatttctgaaggtccatttgattttagagaccaaggcaataataatgctatggcaagggtcaatttaattttagaaaccaaggttgtcatgggctcatggcactcaagtgagtcattaccacagtcactagatcatgatacaatactgtcgttcctgaacctgtcccagtttgctggtcacagttgatgcaggtcacctccaggccgtgtttggttattagaggcatccaaatcaggtacagaaacctacctgattttgattggggcaacagtggccaggttcctcgccattcaggtggtgctggcatgtgtgaaggtgtgtggtggcacactgcaggggataatccagcagtagaagatggggaccaagttgctacaccctgtgatctcgtggccctcaaggttctctgtcgccgatgcaagacaagtcagcagaagaggggaggaggtttggagaagactagggcatttgcttataaaagatggtggcaagggtgtctgctgaaagcctgaaactgcatcgatggcgaggatatgagattatgttagaactgaggagatagagcaacagaattgtgtggctggatggg

SEQ ID NO: 19445 - DNA, 691 bp, Oryza sativa
catgcacaggtgacgctctacagtgcacaaagtggcaaaaaaaaatacaaaagcttctctttcccatggcaaattgttaagtacaaatctaaaaaaggtatttgactaattgccaaacgtaaaagtgacaaatagttaaatttcccgaatttataggcacacgaagatgtcctgcatgtgcaaacgtgtacgtatatatacgtcgttgttggtcagtataagtagtcttcagtataagttgcttgacttggagtcttggatttttggcagagtgcggagcttttctctgggcagcagctgtcagcccgatttttccaagctttttttctcacaggactggaagttctggaagggtttgattcccttgtgaaagggatgccacgcccttgctgtcggaaaatatatagacaaccagcctcatcatttacattagacatgcaggatcttaattttaaaattaattttagaatattatttctaaaccgctaagaacatgtatataagccactttagcttataatcagctcatagcaaccgattgatggggacaaactgaatgtgcagtgcagctggcttccagatttgtccaatcaggaggtatttgagttgagttgagtcgagtctcatgtcgtgtttaatttggtcctcaatatatacttgcttgttgcacactactcggtctgcaactgaa

SEQ ID NO: 19446 - DNA, 693 bp, Oryza sativa
tgacatgaagcaagtgttgaattatctcaagaaaaaggaacaagatgaccctgtaatgtactacaaattctagctagatgaagaaaacaaggtgacaagcctgttttggactgatggtagatcgactcagctatatgaggaatatggcgactgtatcagttttgacacaacgtttagaacaaacagatacaatgtgccatttgcaccgcttgttggggttacaggacatgggtcaacttgcttgtttggttggcatttttaggagatgaaacggcagagacattcaagtgggtttttgaaacatttataacagcaatgggagggaaacatcccaagactataattacagatcaagataatgccatgagatcagcaattgcacaggtttttcaaaacacaaagcacagaaactgtctatttcacatcaagaaaaattgcagagaaaagataggaagcatgttctctgcacaagcaaatagaaacctgtatgaggaatatgatgacatactaaacaattgcctaacagaagaagaaattgaagtgctttggcctcagatgattgaaaagttcagtttgcaaaatataaaatacttgcaactaatgtggaagaatagagctcagtttgtgcctgtctacttcaaatatgatttctgcccttttatacaaagcacagcgctgagtgagggaacaaat

SEQ ID NO: 19447 - DNA, 479 bp, Oryza sativa
ccgaaggtgaaagcatccgaagctccaccgcacttgtcttcatcctcctattcttctttgtttactgccactggctgatgttggctctactactagtaggagtagtggtggtagtgtcgtcgggagtggcacggcactgcggggtttttgatttttttttctttttcgtcttcttaagttgaaatcaacctgatttgggggggttcttgctggagcgggggatgataggttgcggacttgcggtcaggaggaggtcaaaaggagggagaaggctttgattagtgggggatttcaaggattggcgatcgtcttgagctcgctcggtgtgcagaacggctgggttcttttgtggacgggggagtttgctttcacctcgatctgtacaaatcgatggtgggtggtgggaggtaagagtcgcgctttacttgttgtgtccttcttgatgatgagcccaatgtgggttcagtctactcgctgtg

SEQ ID NO: 19448 - DNA, 669 bp, Oryza sativa
gcgatccatagtgccacgagctattccacaaaagtcgccgtgatttgcgggtttgtctccgagaccaaatctccgatccagtcatcgtttttcttcttggagattgcatagaggcatgacgtcttttgggcctgcggccgtccagctagcttgctcctagctaagcgtacgtagtcggagactcggagtccggcgtcgtgctgaacaccggcttgtccttgtccacaaccaccgccgccgccggagtgggggcttgggcggcggctggtcgccatagcttcttcacggcgatcacggcgcgcgtgcgggggagctgatcggcctttttagactacaccggtggcgcccatgcccaccatggagcacaacccgaagcacggcgggagcacgccgccgcacagcccggcattgccgtcgagctcgtcggggttgatcgacagtgggcagtagctgctgctgttactgctcccttctgacaaggggattattggttctttgtttggcacatgtccccagtagaatgtcactgctattaccacatcagattgaagacaacaaaagcaagtaattaaatgggttaatacaactaaggctgccaaaactgtcaagaggataaactgctagtggttagcgattagaagtaaatttggactgctgggttgccatatg

SEQ ID NO: 19449 - DNA, 649 bp, Oryza sativa
caagtctaatgcaccaagtaataaatagtccaaggattaacatagaaccaaatatggtaaggatatagattcgtaatattaatattattgtacaacagcatatgcttcactaacaaaatataaaaatgatgaagggaggaagaggactagaaagtttcacaagtatgcttcaaacaccatcagcatataatgtaagtttattttaaacttaatttatatacacagctactaatcgattttgcagaaatactcttgttaattgtatgtaatattttttaaaatttccacactgcagaattcaatgatactaactactagcagagtttgtgaacaagacatgctgctgaaagacagaaacaatgacctattaatcccaagcaaacattacagttaccaagaatttgatgaaatctacaacaagtgcaaggatcacaccagaggtaaaaattgcaattacaaaaataaattataatcatttttaaatttgtatgagtagtatgctaacatttcatcaaaatatacagattccagttgacaaaactatggaggaattgtacaaattacaaaacacacatttgaaatcacaggtactttcattaattaataatttaatcatgttaaaatgatataggctacatatcaaaaattt

SEQ ID NO: 19450 - DNA, 455 bp, Oryza sativa
caatgaaccatcatgcatcaatcaatcacaatgattagaatcatcattcaatgcaaagaacaggcaattcaaacaagccaagaatggcatattttacactaatcacagttccaatcaagaatcacagaaagaatcatatagtcagccagggacgacggatctaacatgccaagcgccttttgggggtggaacaaggctgtcacaaattaagagaaaaagggctcccatccaaggtctagaagagaaattaacgcgagcaaaactggaggaaaatcgtgtcaggtggacgctgctcaccgggatgcgataccgatgcggcaccagctcgctcggtcgcgggtggggatctgcgaggcgcagaggcggcggccgaaggcgagctcacgaggtggaggaggagtcgccgccgaggggaaaatatatctcggcgagggggagaggaggggggaggggag

SEQ ID NO: 19451 - DNA, 709 bp, Oryza sativa
cagttgtaatgctgcttaaatgttgctctcttcagagtagtacacaaatggactccatgaaagtagttaaagatgtggtttgatatggttctgggtagcattgcaataaagaattcatttagtctagtactcctgaattgatgctttatttccttatttatggacaatttttgaaggcatccattttaaaaggcattcatatctggttcttcattttttttctttattcttgttttcatctgtgttattgatgtttggttgctagctcaattcatgtttttctcacttatttgcaggtgttagtacaggtactggaacattttaatcaagtcgagtcacctctgcatggttagtgttctgggtcaggcaaaatcgctacaagatgaaagaagatattatgtttgacaaccaaacaaagccatgcagatcaagggttgactccaaaagcaatataaatgtgctcaagccaaaatttggatcctcttggggttcccaaattgtcaaagggttcacagctgacaaaaagaccaagaagacagcagctgctgcaagcaagaagccacctcttgcaagtgtggaaaatgttaacaccagcaaccaacagattccatatcattctagggttaagagatctcttatgggagatttcccttgttcacctgctggtgctcaggttcacccccatgtctttgattgccatggcatcagg

SEQ ID NO: 19452 - DNA, 445 bp, Oryza sativa
caagatcaccccttcttccccaccatagcgatagtatacacatttgtcagcttcgttcacaacaaagcctgcagatgtaagcgtggtgtcaaacttctcatgccattgcttaggtgcttgcttgaggccatacaaggatttcaatagtttacacaccattccctcctgaccttttagtacatacccgtctggttgatccatatagatctcctcctccagctctccgtttaggaaagctgtcttaacgtccatctgatggacgagaagaccatgaaaggctgccagagcaagtagtactcgaatcgtgttcaagcgagcaactggtgagtatgtgtcgaaaaagtcctcgccttccttttgggtataacccttggccacaagccttgccttgtacttttcgattgtaccatcaggcctaagctttttcttgaaaacccatttgcat

SEQ ID NO: 19453 - DNA, 803 bp, Oryza sativa
gtccttgttgtctatattgttgtgcatccacatttcctagatgaatttcttgccatgttcttctaaatggccagaatataatatattaacacaatcattttgccacttcttgctgccttatgtaagatagtcaccttgttggtcgtaccatggactgtatctgcagagttcgaactgaagtttctgttgcgtgttctgaatgttgacgttcctcctgattttgatgctgtctacttgtgttctgaatgataacttgtgtcctgattttaatgctgtttacctgcttgtcttcattctcacgtttggaatcggaataccagaatctaggcatatctccaaacaacccaaatgaacttctgtaacagtattttatagatccaatccatttccaaccttttttgagggtagcagcagtcaaggaatcaatatagatctactgtatcgaaattggattgtcgtcctctgctttggcattctgttaagctatataagtatatggtttacttatgcagcaaccatttttgtcatgttgcatggctgtttgcacctttgacaatttggtatgttaactggcttcaattcaaggggctaattgactgtgaaacgtgaaccattctgcgctaatattcttttcttcctacgttgcttgtgacgaatattctgctagattgagttgcggctgatttagctactatgtttctttcaagtttcattgcacgtagcagctttagcagataagctttaatatattttatgactatgcttcaatctattttttgcctaccttttcttcttctaccata

SEQ ID NO: 19454 - DNA, 660 bp, Oryza sativa
ccaccaaccgggagtaaagaggaaaatctttggtcccggttggtgaggctagcgccacgtctctggttcctatcctttttttttttcattattctttgcatattgatttcacaccaatctcaccaaaatcataaaatcatcacacatttcaaatctcctctctccaggcgcaacgaccaatggcggcagggagaaggatggtgaccggcggggagaaggggcggcggatggaggagatccagctggcgctagaggccaccgtgcgcccgatccgtgcgaatgtcttccgagcccacgcacgtatggcgctggcggctgattcagtccaccggtggcaacgacgacactagcagctcgtgttccatctcgatcgaaacttgatgacagattcagacacaaaacatgttgattacacgatggttgccgctttgtaacacgaactaggtgaacagatgctgaattcagaatatccaaagaacatgacaagattttcggcattgccaactcatgatatggtattaatcacctggaataaactcatatattcagtgcatcctattcagacgtttttattcaactattcctttgagttcaaatttcgcatcggccaagaacaggcaccaactctgaatctctaatactcaaacgcattcatcgaga

SEQ ID NO: 19455 - DNA, 742 bp, Oryza sativa
  unsure (1)..(742): unsure at all n locations
atgcacttttagcccattgggctgtaaatttgatatggtatttgttgcgttcggttacaacttacaacatctccgtcctatttttatttcagttagggtctctctacacatcattcgacaaattttcaggccccaaatttgtcagatttctgatcccttggattagcatccaacggcagcaaaaataaagaaggaaacaaatagaaaaaaaataaaaggcctaaattgggccaaaattgcaacgtgtaaatataataatgggccgataaaatcatattgggccaaaaacacaacaaataattttatgattatagcccaaaatcaatcaacttggcaatcaagaaagctggagaaaaggacagcacatacatcacgtgatcaaagcacacatccagcgaatcaacgcttctcccatccaaaacagatccaaagtcagatcgaagaagatagacatggagagcgaaaagaaaaaggcaaagaagaaaagagaagaagaagaaccaaaatccaagatcaaatctgaagaaaaaatcaaaacatcaagatccaaacaaggtcagttaattaacaagaaacaatcatatagtaaatacagaaaattacactgtacatacacatgttgaactgaaacatttgcaccatacaagcacacaacaatatatttacacatttctagaacagttcatagctagtgcacacatgnnnnnnnnnnnnnnnnnnnnnnnnnnnnnnnnnnnnnnnn

SEQ ID NO: 19456 - DNA, 715 bp, Oryza sativa
cagaagaagagataatagaagaagtggaaatagaagacccagatttggccaatactaaaggaagaaaaccaaaaagatatagaagaatagtggagaagatgatagaaacttcaaaaaggaaaagtaaagatgagcaacacacaacagaaacaagtaagtgtagcaagatcaagaatccacatataactataaattgtagaaataacaagttttttttgcaggaacaagtgagataaccaatatagggaacaagcaagaagagatgaaaacatcaaaaactacaaaaagaagtaataaacaaatcaattataatacatatacaaaaatgaaactatatataatgaaaacctaatgcatacttcttttttgcaggaaagaaaaacaatactcaagaggaaactcctaaagagaagttgcatgcaaagacaagctgaccaaagacattggaaatgaaaggacaaattgaataccatcagtaatggaagaaaaaaaaaagagatctttcttctatgtaatagcattcagactgtaaacactacaaatgttgtataattgtttttctcatactacattacaagtatgtaatatactgctagagtgctacattatatgtatctaatgtactgccagtagaacaaatatcctcgtcatacaaatttttgtcacacaactcatttaagaaaaactgtgaaatgtatactgaaacactggtcaa

SEQ ID NO: 19457 - DNA, 803 bp, Oryza sativa
gcggcgagcatctcttcgccgttgatggcggccggacctttgtcaaacgtcggtgcgcgccgcagcgatggcatggaatccggagtccactataaggaaaaaaagctgtagtctgtgttcgtttagagagatttgaagaggattggaggagattgagggggaataatttcacaccacaataagtgtggaataaatcccctccaatccctccggattaaccgaacaaggccgcaaagggagaacaattgccatgtcatcggagatcagaattccgaccctcctcgggtctagctctgacggccttccaaagctaacaacatgtagtcagtcagatcacatggtcaatgtaaccaagacagtgctgaaataactaacattagcctagccacatctgaattattgagtgcaattatcgaaaccgtaattttgtggtgcataaaacaatgggaccatgaaattctactccagcaccctcttttcgaaaagaacaagatatcttccataccaagatcagaggcattcttctacttcgcccttagattactttgccatgttgacgctctgcatagcttttctctatcgtccgtgagtgccacggtgttcgatcgatccgtgtggcgctcgagacggcggccgaccgtcacagctctaagccagcatggcggttcaatcaagcccctgtgtggcccaaatgagactaaaacctgtgtcaatgcggttataatttgaaaatttttagtttttaacaatttgggaataatggagtaatatttttctagcaaaaagcaacatatatgttgaca

SEQ ID NO: 19458 - DNA, 459 bp, Oryza sativa
taaaaccatagttcggagtaggtcttttgtgccaaatatccaaaagcattgccatggtttacaagtttatcatgacacataacaggggttacaaacatccaaaatcattgcaagaacagtgcatgtccatacattcatgtcttcaaacaagagcaagtccctaaattaaagaagtagcaaaagatattcaattagtcaagtattttataaggatataacaaataatggcaataggagtttgattgctaatttcaagttgttgaaagaatacctcaatccgatcttggatatcttgaaggcaacttcaaaagcttgctgcttcttcattatcagctacaagataacaattataacaattattttgcatccattgcattgtaaaatctatgctaagcatgatgtatgaataaaacatcatatgtacctcgatacttgtttcgcagccaatcttgtgagcac

SEQ ID NO: 19459 - DNA, 536 bp, Oryza sativa
  unsure (1)..(536): unsure at all n locations
nnnnnnnnnnnnnnnnnnnnnnnnnnnnnnnnnnnnnnnnnnatccaatcaggagacaggtcctccaaaatatgcagctgttcttctatctcccctgtcaagtgatagtccataaaaggagggaaatcattcagtatagcatgagacaataagtacaaaatggttggaattgttagatccatgctatacctgtctcttctatctccaagttgttagcaagaatattgtgaaaaagttcctgttttgtaataagtgaattcttggtagaccgagaaatatcgcagactatgtcgaatgtgagttgtaaagaagctatcttttcctgggattctgctgggtcgacttctttggttttgtctacatcagcaaagcaaatggcaggattgttttcctgcaaagaacaggttcatctggtcagaatgcagtgaattcactatggaatattcaccaagtaatgagaatcagaacagaactgaaaagaaagccttctgttataacagacaaatcgggaggatactattagctgatatttagtc

SEQ ID NO: 19460 - DNA, 415 bp, Oryza sativa
  unsure (1)..(415): unsure at all n locations
nnnnnnnnnnnnnnnnnnnnnnnnnnnnnnnnnnnnnnnnnnnnnnnnnnnnnnnnnnncagctactaccatttgactaaaatgctcaattaggcctaccagattgcatcttttttgtcttggccatagtctccaatcaagctggagaaacagagaggccatcatagataggagtagcaccatgaactctccaatgctcatgcttaaattctgccggttcatgcgtctctttgcaggttggtgagcagtgcgttttgcctcctctctctttcagtttttggcagcagatcagttaatatggtatgctggggtttgcatgaagtggtagttagcaacttgcaaggctcagcaacaggtgaccaaacctaacgcacatgcacaagcaaccaggatttcttttggagagagagtgatg

SEQ ID NO: 19461 - DNA, 242 bp, Oryza sativa
cattccattgagagacagagctgagctgtatgaaacatatttggtgttctgtgtcactggggagacgaccaatgtttcatttggaacagcaatctccacaaagaaagataattcagagtatttaatgctgaagcaattaggagacatacttggtttaacccgcaaggaagctcagaatgttcacattaagatggcagaaaaggcatttgtgcaacaggctgaagtgattcttgctgatggga

SEQ ID NO: 19462 - DNA, 1311 bp, Oryza sativa
  unsure (1)..(1311): unsure at all n locations
tataattcagctagctgcttctccagatgtttctagcttgtggtaggccggtctatctgaatttcgtacgctgcaggacaccaaacagagatcaacatttatgaaacagcaaagatctcgtacatgcccccatctccaagattatattgggtcatctggtgaaattaatctcctggcaaattaagtcaagatgcaccgtctgcaacacgaaatgtaatgttgacacgcaaatgctagaaaatgatttcagatatggtttatattaggacttgggagttgggacacgtatgttttatgttcagatagggtctattcagtcgtagagaagaaagtgaaattgcgagcagatctgcaaacatacattaaatgatgcatccagaagagttagaagtcatgacactactataagtcagattaagcttggattatttccagcgtttccttgcggtcgctgcacttgttttatccaagactaatactgtaaacaacttctggtttgattggaataaataaataaatattaggtatgacacgtatgtccacatcaaatcttcacgggccagcttccttccatcagatttgagaaaaaacataaccaatctggactaattccaagtcaatcgatttgactatagattaaaaaaacaatcacctagctgatcacacttatcctcgaatttcgaaaacacatttttctctaacctatataaaccctaccatggttagcaaaattccgtaacaaacatcgataatacaagatcataaaaagaaaaatgaagcctttccacatggccactctcgcggcgctcatggccgccgcggccgcggccgcgacggccgctggcgccgtgacgttcgatgcgacgaacacggcgtcgagcaccgccggcgggcagcggttcgaccgggaggtcggcgtggactacgcgaagcaggtgctcgccgacgcgtcgtccttcatctgggacgccttcgagcagcccggcgacggcggcgaccggaagccggtggacgcggtgaccctgaccgtggaggacatcgacggcgtggcgttcaccagcggcgacggcatccacctgagcgcgcggtacgtcggcggctacagctccagcttcggcgacgtgaggacggangtgaccggcgtgcttgtaccacgaggcgacgcacgtgtggcagtgggggctgcaggattacggggcgcattcgtgggtgtacgaggggatcgccgactttgtgcggctgcgcgccggctacccttgcggctggttgggtgcagccggggcaagggaacagctgggaggacagctactc

SEQ ID NO: 19463 - DNA, 493 bp, Oryza sativa
cggcgtcgacgggcctcggtcggcggcgctcggctggctgaagatgctccaggtgaaggaggaggcggcggcgagcacctgcttggcgtacccggcgccgtactcccggtcgaaccgctggccgccggcggtgctcgccgcctcgttgctcacctcgtaggtgacggcggcggcgggcggcggcgacaacgacgcggccacggccagcaggatggctgccacgacgtgaagcttcatgtctggtggtcttggtgagttatgtgggcaattggtgagaggaagtatttatagccaacatcgggatgtctgaatttcttcgaaaagaacatcagcaatgctaagtacgtatacgtatttgttagtactccctcgttccaaattaaacgacgacctcttttctaagaaaagctctaataatcaaactaaccatatatatgctaattattatacaagttatatgactagattcatatttaaaagtactttcgtgtga

SEQ ID NO: 19464 - DNA, 965 bp, Oryza sativa
  unsure (1)..(965): unsure at all n locations
nnnnnnnnnnnnnnnnnnnnnnnnnnnnnnnnnnnnnnnnnnnnnnnnnnnnnnnnnnnnagatgagagattgcagcttctagccgttgatgctgtgtttggccagccaaactgactggctagatttggccatccgagctggtcatttggccagtgagatggcttagccatctaaatagagaggctgttggatcacattttcttgctatgtttgatattttttaacttgaagagtgagatgagatggctaactgttggagatgctctaagttcgcccagaacagaagcgtatacccgcatatcgaatgggcgaggagttgctctcgtcagagagcgtgtgtgaagcaaatcacgaaaaacgaacccgtcaaagtttgtaatccagaaaaatatgaacccgtcaaagcttatataatccagctttgctaccagaatcatgaaaggaacgtaagtacatagtccattcgnnnnnnnnnnnnnnnnnnnnnnnnnnnnnnnnnnnnnnnnnnnnnnnnnnnnnnnnnnnnnnnntttcattgttaatgtgccttgtagaaagtgcaacagttatacttgagagcagtgcggttgagaaaatttatttggggttaacagttgacaccatcacaccgatatattgatttgaaagatcaccacacttataataatagaagaatctttttaagggttctaggtcaattgacttggtttgctgaatgatgtctatatgccatgaatgcatagatgaatgcttacataataattctaggaaatacagtactgcaattgggattacagtagcattatcaagtgaccactaggatcatacaaccagcatcactagtgcaccattatcaccacacatcaccaagtggagaggaataggaaagggattgaagacaaaaaagaaactactcgaatgaaatcagctccagaaacacatggtaatagaacccacttgagat

SEQ ID NO: 19465 - DNA, 618 bp, Oryza sativa
ccaagtaaagttggcatttacaatgttggcactgtaagaggtttgacaatatgagctttctttatttactttgattaaatgcagttcgctcatgctaggacagaatcagattttaattaaatgctgcatttgttggttattttacatcaaatttttacgctggaatacacacagatggttattctggtagaataattttttattgtatgcttatgaaaaattgacttctcttgtcaaattatctccattctgcatttttactcatgcatttcttgtgctgtcaatagtatattctaatatatgtatgattgctttcaggtcgttcagtcaaggagtttgtggatgcctgcaaaaaggcaactggagtcaacattaaaattgagtaccttagcaggaggccaggggactaatgctgaagaaacaagtgacccaacaaagatcaacacggagctcaactggactgctcaatataccgacccttaaagaaagcctgtcagtcgtttgaagatggcaaaagtcacatccacgcggatatgggtcaaactaaatatagcttgctgatcaataatcctgctgaatcgtcgatatttgatttttttagttagtggtataggatct

SEQ ID NO: 19466 - DNA, 1614 bp, Oryza sativa
  unsure (1)..(1614): unsure at all n locations
nnnnnnnnnnnnnnnnnnnnnnnnnnnnnnnnnnnnnnnnnnnnnnnnnnnnnnnnnnnnnnnnnnagtaaataacaacataccttcgcataacgaaaagcatgagaacaagattttcgattcaatatttctttcttaacatctttaacaacctataataaaaatagaaaaaatatacattaaaaaaataaaaaacaataacaaattataaatacagtcaagaaagtaatactacctcctttctaaaaatttcatatataatatcatcaagttcacgacgagaaagctctccatcctataattcatatatttcgaaatagatattagtaaactacaaactaaattcatataacatagtatttcataaaaaaaacattaataaaagactataacttacacaatcagattcatcagaatcatctacaataggtgctttacccaaatttctcttagcagcaggagccatctaaacaaaaaatataaaacaaatatctaaatcactttcttaataagacaaacaacaatgaaaaaggcaaatcatgcagaccatgaacttggctttacaactataattagaagaaaaacaaaaaaaaataggagtgcacagctaaagatgctttatcatggagagtgcacaaggaaacaagactccaacaacatgacacagctgatggaaacaaaagaacaagcagaagatttcactaaagaagtatagcagctgcacacaagctataccaaggagaaggtggcagaaaaataacataacaacaagctgaatggaatcaacaggcacagcaagttaatgaagatgaagaaaacagggtacagttgataggaattaaaaaaaaactgacaaacaacaatcagtagattttgaagcactagtagctgtcaattacacaagaataacttggaagtaaaaaattaggaaatgcttacaactatccaagggacatggaaagtagaatcatgcttacaactaaaaatctgtaaaagtttaatctactacaatatacaaaattcaaaaataattacagtaataataataacaaaaacaaaaatacaacaaactaagttcagacatcacaaaattttagaaactaactagctgtcaagttatcaattctacctcacaagccatcaatactaccctgaaaaggacacaactacaaataaatcggaacacctcacaaacatcccaagaactaaagcataatagaacacaatgcgcgccagccatcaaaatactaccctgaacaggacgcaactgcaactaattcgaacacctcacaaacatccccagatctaaaggcataataaaacacaagcacaccaaattttgttcaaatagctcacatatatacactaacttgctaatctaacgagagaaaactaccgagatctacttcacacagatctagttcacgaacatcacataatacctaacttcctaacagattcgaagaccaccaagagaaaactcaatcaaaataggtttcaaaaagagctcatgcttgacgaaagaacacctacaccgaatcggatcaacaaacacatccatacaccaaaaatcccaaacgagaacaaacaaaatgtaagagatctagttcgaac

SEQ ID NO: 19467 - DNA, 679 bp, Oryza sativa
tttgtgggcctgcatgctcatgaccctaccttggggctttcatagtgcacttacgtgtcatttagccatataattctacgtcaattttgctatatatttgtcgataaattttcccctaaaaatttgacagatgtaattacagtacaaccgtaatgtaattacactgtaacttgcatgtaattacactgtaactataatataacttgtatgtaactttcaaaaatctctccataatatattattttggtaaaataaaggttgtgggaacaattttttttcagatatgtgtgtactgtgattttttttctttctcaccaaaacaaatctttataatagatctaataatttaaaattacgtgaaacttacatacaagttacactgtagttacatgcaagtagagatggcaatgggtacccggtccccggtccccggtcccccgtggagaattctcccattaggtgatggtgatggtattaattgtgtctccatggggaatcaaatggagagaaagtattctccgtcgggtctggcgggggcgggtttggttccccgtcccccgtccccgccctctgtggaggcccgatataaaagtatgtgtgtagtaatatcctgtgtatttgacccatatggcccataaaaaccaggcccaaagcatagagtatataaagcaattgtgta

SEQ ID NO: 19468 - DNA, 549 bp, Oryza sativa
atgttctataattttccgtatttgaaggtttgatttcttagtgctacattgttgtcagcatatgatacaggaaatgacctagtcagaattatgatgcttggcctgcaaaaagtaaaatttgttggttaccagtattcagaatagatagcatggagactaccaggataagttttcaagtacctattggttaacttgaggtgcttgttatatagtatctaaggttattttcatctactgaaacttaggaatgtggtacgctttgcataggtaccactgttgtttgcttgtgaacattttgcagattatgttgataccacaaaaaggttgtaaacagaagcagtttgcaacgatcacctagaccatcgtttacatcctgttggattaatcattgcctttctattaactggagtaatcgttgtctttctatttccttgataactgcagataaaattttcttctgtcaaattagcaaagatgtacatgaaaagagttgctatggaacttcaatacatgggacctctgaacaaagatccagctttggagtatatg

SEQ ID NO: 19469 - DNA, 1808 bp, Oryza sativa
ccattttcttagcttttccatagggattaattggtaactgtaacagagtaaattattaaccaattaggtacataatatttacacatcagccttgagtttgcctttccagcaacaagatgaaatagcacagcacaatccaaacactgcagttttgaggccatcataaattaattacctgacgtgtggtttctacaataggcatcttctctggttctccataggtggcacatgtactagagtaaataagggtcttgactccatgagacgccatagcctccaaaatcaataaggtgttcgatgtaatattgtgatagtacctgttaaatacttaagattatcagagatatactagacatgtttcagatatattatacagttcatcatatctgtgatagcagataatataaatatctgagaactaaaaatcagaaagcacttgattatggagttaacattgtagcataccaagtaccatggattaatagtgaaaactgttttttatcataaggaccttttcccctagcactacaattaggccattagacaagggtgtgtacaatggtaacgtctgtaggggttagtagaataagaggtcccccaagctcatggaactgacaaactgtcaataaggtaatgacttacctaaggggttccaatgtactctcacccacataggcaacagcagcaaagtgcataacagcatcaaacgcattttcggcaaagatcttgttgacctgggagccagttaagtgaaaaactggcatttgaacattttaaaaattacgaggaggtaatttagaagtacaaaatgaggatacagttttttgatctccaagaatcagcatagataaactgaagtcttcctggctgggggaacaactcttggagaacctttactgctcccatgtttcctctagaaagattgtcctaaaaatcacaattaaccatcaagggtggcatttgaagaacaaaccagttcagaaattcagtacaaaggaaaacttaattaccacaatggtaactcgataattgtcctttaacaggcgtaatgaagcatgtgacccaatatagccagctcctcctgttactaagacatgagtaacaccaggttcatggcgagaaaactgcaagatacataaccccacaatcagttatacagttgaattaaaaataggggaaatataagaatggcataataataattgcagcataagaaacataacaggcggatttgcatgaagagttgaaagattaagcaacagaagtcaaaacagatggaacatatccaagtttagccatacacatactaggtctgcatcgcagcttatacatgtttctagacaacaaaagtaatgtgctatgtttgaccttcactctgcaacagtctcttaacattttattctaaagaactggatagttagcctgtagttttagagatgtgatatatttacatctgcaaatcatatcgtagttttcttgaacaggaacatgtcaaaattattatgcagattgattagctgtcagaaggtcttcgtggctgaaagctacagtttgttaggatgccatttaggcatcaacttgccgcaacgaaaagtggcaaacaacttatgaagatatgtgtattgaaatatcaagttggaacatgaactaatgtaatagacattgcaataacaaaggcaattggatggagagatgtcactttcctcacctgcttgttagcactgagagcagaaatgaagatatgtgtattgaaacaactacaatagcagtcatcattttgttttatgctagttatacaaggacatatt

SEQ ID NO: 19470 - DNA, 561 bp, Oryza sativa
gcaccaatagtgaagaaactcttctcaccatcatatgcgaaatttttttttgcctgatcacttgaattagtttgctcacttgaaaagagctttttcattattgttgctcttccacaacatgaacattggtacctgttttatgttcgctgcgtattgcaaatggtttgccaatacacataataggtatatatcttacattttggtgtgctttacatatttgttctgtttacttttgtattatatatctattttttatttattttgcaatttttttgttatttaataaggataataagctaaaggaggctgcaaagattgattcatcatttacaaggttttccaccaagtatttctgtcgagttatatctgcactttctccacatcagaaaactattattcagggtgctggttttcagaatttgcttgagttcaacagcaattatgttccaaataaatttgctacttggattgcaaaacatgtggattttaagacctcacaaataattttaagagacaaagtaatttcagttacaaagcagactgtttgtgacatttttggtt

SEQ ID NO: 19471 - DNA, 1483 bp, Oryza sativa
  unsure (1)..(1483): unsure at all n locations
nnnnnnnnnnnnnnnnnnnnnnnnnnnnnnnnnnnnnnnnnnnnnnnnnnnnnnncaggggtacgacgtgacggcgaggttcctcgactactgcgactcgccggcggtggtgcaggggttcgtggcgcagctcaacggcaagatgaaggacggatacagcgacgacttcttcgtccagatctccggcaagaccatcgaccagctctggcaagattacaaggccaagtacggcggcnnnnnnnnnnnnnnnnnnnnnnnnnnnnnnnnnnnnnnnnnnnnnnnnnnnnnnnnnnnnntactgtagttagtatcagatatgtggataataaggcaataaataaagccatgtttgatgtccgagggactgtttagattgtagctaaaataaatcttaccaaatttaggtaaagttgttaaatatatgcatccatttagttcattattaaactctgataaatacataagaaatcctgtcaaaacttaacaatattgttaaattgctaaaattttagcattaataaaatttaataatatttattttaactataatctaagcaggcctgaaactttactgaaaattcaacgaaatactactgcctgatcttgttatactccatctgtaatcaatttgtgctcactgtcaaagcttcaagtactgtcctgtcaatctatcatgactccataaatgggtacttctaaatgctactacttcctcgatgccattttaggatttaaagtttgtcctaaaaaaacttctcattttagagtacatattcatttttgcaacaggaaagatttgaaatattattggtggaaattggctggtcacacatgtcccatctccactgaggttctctgcagtactgctcactaacatgtgggccccacaaatcctcgggcctacatgttagtctgcagtgctgcatgcgtagtactgaagaggatctgaattgtatctaattattggcaacatggaaattaatctcttggcaaattaagtcaagctgcaccgtctccaacacgaaatgtaatgccgacacgcaatggcaaaaataatttcagatgtatatgcttgatattaattaggacacgcatatttatattatgttcagatagagaagagagggcccgtttagtttccaaaattttttccaaaaaacatcacatcaaatctttagacacatgcatagagtattaaatataaataaaaagaaaaaactaattgtacagttatggggaaatagcgagacgaatcttttgagcctaattagtccatgattagccataagtgctatagtaacccacatgtgctaatgacggcttaattaggctcaaaagattcgtctcgcggtttcccggcgagttctgaaattagttttttcattcgtgtccgaaaaccccttccgacatccggtcaaacttctgatatgacacccaaaaattttctttttcccaactaaacacacccatagtgaaattgcta

SEQ ID NO: 19472 - DNA, 532 bp, Oryza sativa
cagtatcatgtcatgtgcatgttttcaaaacaagaaaacatgttaagccatgcaaggtttgcttgttccactgcatgcgtataacaaaaacccgcagtcaggtaacataattaatctaaccaaggcggtgatgaattcttgagtacaattgctggaatgttttgtgttgcgtcaaacaatatatataatatgtgcggccatgaacgactccaaacctccaaaattaaggaggttactgccttactgatcacgttgcagtgtttcttggatttgcatggtagctgatctcagcaaagccctaactgaaatataccataacatgatgtcaatgaggggtcggagttttaaactccgaactcctttgggatctctgacggccatttgatcacgcttgcgtttgcgcagattgaacagtgaaccgatcgagtagagagagccacggcggactcgtcgatcgaacacatgtgacatctcgaaccactttacactgcatctctgacatgccgcgcgccggacttgtggcaattcgtca

SEQ ID NO: 19473 - DNA, 510 bp, Oryza sativa
gatcaagacgcgaccaaattaaaatatcagcaactaattaaccaattcaaacgataaaagaaaacgttaaataatatccgtctctcacacgatcttttgaagtactaattttatttcatatcctctggctaaaattcaattaaattaaaattgaggatttatcatttctaggtatcaacttttaaaacatctcctctccacttttcagttcatcaggtaagtccacacttgccgcaggtgagtcagtcgtggtgcttcgccataagtgcgccaacgtctttgcactctgggttaggacacatcagtcgtagcctctccaccttccccatcacgtcatcgacacgatagtgacggagcaccgcaagctcttccttgcggtgctcatgctttcccttcttaggtgtcgcgtacgccttcttctttcgcttcttgttgccgccgccgccaccacagatgcgaccgaggaggtgcagcgtcgactccttctgaataccatagtagattagcgtg

SEQ ID NO: 19474 - DNA, 341 bp, Oryza sativa
tactatttctgtttgctctcttgcaggccatgagcttgctgtctacctcccctaccatccatggcgtctctgatgcagcggccagctgccatgccagcggctacgtctacctccacggcaacgagacgaggtgtcccaaggggagccatgactgctgcgtcgccggcgagcgctacccgcggttcaggtgctcgccgccggtgtcgatcggccaggacgacgccggcgatcctgacgctgaaggtgttcgaccacggcgaggacgacggaggcgtccccacgtcctgcgacatgcgcttccaccggaacacggagctggtggtcgcgctgtccttcgggtg

SEQ ID NO: 19475 - DNA, 282 bp, Oryza sativa
gaactgttatgatcaagtcttgcatcaccatcacaatcatcaacatgacaagcaatttcatcattataatctgcatctggcattgctctagctgcttgatctgagttactgagctcatgacgtatacaagaattgatccaccgaagataggcaagctcctcaacttcagttagccgactcatttgcagaccctcaacctgcttgctcaagtttgcatttgtgtgccgcaataatgaagcctcagcttgaacctttgcaactatctcactctggtgacaataa

SEQ ID NO: 19476 - DNA, 693 bp, Oryza sativa
tgtgttgttgtgtatcatctttaattcttaggctgctatcacttaagcaattgatgcacttatgttgattttagtattgaattatcgatcaaccttagcctagtaatgattactgagcaaatatcaggccaatagaatttgttgatctgaaaaaggctgctatttctgctatgattttaagatgttctaaagctatgtaatgatcttattgctataccatataaacaatcaggtagacaaaacaaacttatgttgtaacaccccttaggtatgcacccgctactcaactttggcgtggacggctccatgtgatgggtggtggaaaagaagatcgccatgaacctggattagagcactggagcttagctgtcaaggatggcaaagcattggagaatgagtggcgaactgagatagccataccccgtggtggacctcataggtttgtacgagtgtacttgttgtcaggtgtgccgtttatgcagtttgctaattgatgtgcagattttattagtgagaacacatgcaactgattagaatattgacagtacttcatttttgtcttaactttttacagggcatgcattgttgctaatgataaactctttgtcattggcggtcaagagggagactttatggcaaaaccaggctcgccgatatttaaatgtgtacggaggcatgaggtatgtatgctta

SEQ ID NO: 19477 - DNA, 638 bp, Oryza sativa
ctcccctatagagggggcgctgcccgttgttctgccatcccctgtttgtgagccggtcagaggtccatactctattctagatgatgagcatgcatgaagcttacattttccagacacccaagctctccaaattaatgggtcaaaggtcgtgtcaagcgtgccaatgcactgtgctttgtaggctgacgaagccgagtactacccgtgagttgtgaacttccatgtgatttggtctggttctccttcatccagatgcatgccatggactgcgatccatagtgccacgagctattccacaaaagtcgccgtgatttgcgggtttgtctccgagaccaaatctccgatccagtcatcgtttttcttcttggagattgcatagaggcatgacgtcttttgggcctgcggccgtccagctagcttgctcctagctaagcgtacgtagtcggagactcggagtccggcgtcgtgctgaacaccggcttgtccttgtcacaaccaccgccgccgccggagtgggggcttgggcggcggctggtcgccatagcttttttacggcgatcacggcgcgcgtgccggggagctgatcgggctttttagactacaccgggggcgcccatgcccaccatggaacacaaccc

SEQ ID NO: 19478 - DNA, 706 bp, Oryza sativa
  unsure (1)..(706): unsure at all n locations
atggagaaaggttccctttttgtagaaaaaagaaggggggaaattgccggctttttttaatattatgcaattagaaagtattgaagaaataagaaacatgaggttagtattagtcacctggaagtatggttcttctttaagaggttccaacccaagctcatttagaactcttctgtttcagtcaatgctgtttgaatgtgcccaggattcctggcactgatgtctacccgaacctatcacccagcataatagagaatgaatcttgatgcccatttaacccatgttacagaaaaaaaaatgattaatgaacacttactggtgaaaataagtagcccaatgaggagacctcaattaaatgagtaccagctggcacattgtggcttaagcatatcatgtcaaggaggaacaaaaagcaacatagtatgctcttctaacattgtggcattgctgcccacaaggaaacattggaaaaaaaataacaaacaagaatactacaacaacagagctagatttatttctattagcaacccagaggctatatctaattttcaggaataaggctacccataacagataggaaatgtaagatatgagacatccaacaatagagcaggctaattaaatttaatgaaaaatgtctaatttccctaatccgggaactcaaaatgnnnnnnnnnnnnnnnnnnnnnnnnnnnnnnnnnnnnnn

SEQ ID NO: 19479 - DNA, 698 bp, Oryza sativa
  unsure (1)..(698): unsure at all n locations
nnnnnnnnnnnnnnnnnnnnnnnnnnnnnnnnnnnnnnnnnnnnnnnnnnnnnnnnnnnnnnnnttcgctgagccattctaccgctgacttacgcatagatcgaagtgggttggggcaggggaggtgcacaccagatggcttcataacgtcgtgtgacagtcctatcataaccttctttctgcacatagtgctattgtgaaagaacataatcgcagacgcaaatctgctctttatcagtagcattgtaaaaggagcacttgctgtctgacttagtgtgacaacttaacattaaagcaaatcccttgacttagtatgaacatcttacattaagcaaatccggtgtccctcgtggttgccgacttgccgtcatctgcactcaagaaaaaagggaacacctttgctctcaatgcacatgatatttcttcacttcagagcaataccataatctcgcaatgaaacgatgtttgcacatgcacttttccgcatcacaagattttcttctataaacatatatcaagaaaatgttactgtctacagtttgacactgaaatttagtacttcgtttgcactagtacagaagcactcatcgcccgtaatgttcctcatgatcaatgttagtctgatgatctcaaacctgcttcacatgaatggataatatgctccgcgaacaacctataccattgttagcattgccaaa

SEQ ID NO: 19480 - DNA, 845 bp, Oryza sativa
aattcttttaatcaacaccagatcattggaaccagttaacccagataaaacataaaatagcataggatactgttttttttcccaaaaagggtaaaatattattgaagaaagaaaaaactgctatcaaaactactacagacaatccatggtcaaccataataattcatgaataacatcacatgccttctgaacaagcaaaaatgaattcaaggtaagtgtaactaattgttccactttcatcattcatgatctgtataggtatgttacaagaatacatggtacataatcatgaaatatcatccaaggtcataaatgaactgcaaaagaagaaaatgcaccctaaaattattagtaacagacacaagtataaaacagctgtgaaatttcatgaagtgaaacaaaccatccgcgtgtttgatccaatccctctgccacaaagttgccaggaaagttcttctcaaacaattcacggttctcaaatggataatgaatgtaggcatatggcatggaaccactctcaaaccagcagtcaaaaacctgaagacatcacagcagtgttaagtaagaaacatttaaaagaactgatatacacaagcattcatatctatagcagttcagacttcagaggcaaaaacgttcacatacatcacatgtataacaatgcaactaaacaagcagaaatagcgagtgaccttatggcattcagcagttagctactccctttgtttccatttacttggtcattatagcattctttttttttttgtcaaaatacttgtcgttctcacattccaaagcatttttagatacgtctttcccttcctacctttcatcaatgcagtcat

SEQ ID NO: 19481 - DNA, 395 bp, Oryza sativa
ctgcacctatcttactgcagcaatcatgatgcagtacacgcacaattcagtatcgcactatcattagtttcttatacaatctcctcaagctaatccaacctttcaatgtctaagcaatacgattaagtaaagtagccatactttcaaaaagaaaaatgcacagatacaatagcgctactaacctgcagtaaaccttcttcataagaaaagcttaccccacagcgaatgtgaaacgtgcaacacgccaactacagacaggaaaacaagcaaatgacaaatgaaatgaatgaaactgactaactgatgcaaactaaagggaaaaaaacagatagtgggagtagaaacacaagaacaagcataagctagcatttcatacgaatattgcagccaataag

SEQ ID NO: 19482 - DNA, 28643 bp, Oryza sativa
aagcttattagccatggcttcatcaccaagtctgccattggtgacgtgtgccctgctgctgctgctggccggggcatgccaagctcacccttactggccactggagttggcgtactaccgcgacaagtgcccccaggccgaggccgtcgtcaaggccgtcgtcggggaggccgtccgccagaaccccggcaatggcgccgccgtcatccgcatgctcttccacgactgctttgtcgaggtgcgtacgttagcttcttcctcttctccggcgagatcgattgatcgacttgagctatgtgtacttagatgtgcatggtgttttgttgttagggttgtgatgcttcgatcctcctggacccgacgccgttcaacccgacgccagagaagctgagcgcgccgaacaacccgtccatgcggggcttcgacctcatcgacgcgatcaagcacgccgtggaggcggcgtgcccgggcgtcgtctcgtgcgccgacatcatcgccttcgcggcgcgcgacgccacctacttcctcagcggcgggaaggtctacttcgacatgccgtcgggccgccgcgacgggaccttctccaacgactccggcccgatcgacttcctcccgccgccgacgtccaacctcagcgacctcgtctccagcttcgccgtcaagggcctctccgtggaggacatggtggtgctctcgggcgcccacaccgtcggccgctcccactgctccttcttcgtccccgaccgcctcaacgcctccgtcttctccgacatcgacggcggcttcgcctggttcctcaggtcgcagtgcccgctcgacgcgacgcccggcggcaacgatcccacggtgatgctggacttcgtgacgcccaacacgctggacaaccagtactacaagaacgtgctcgaccacaaggtgctcttcacctctgacgcggcgctcctgacgtcgccggagacggcgaagatggtggtggacaacgccgtcatccccgggtggtgggaggacaggttcaaggcggccatggtgaagttggcgagcatccaggtgaagaccgggtaccaggggcagatcaggaagaactgcagggtcatcaactactgattaatctacaagtttagctgcgtgattcaattacctggtgaagtacgtgctcaacgatgacgacgtacacggtttgatagtttcacaccctccttgatcaagtcgcaagcgtacgtgttgatgatgttatgattggatgtgacttttgcttcacatttatgttctccctcttttgttaccattccttaattcctcatttgtgaaccccaaggtttacatgctatggatttctttgttttgacctaattgtgtaataaggtcatatgtacttggaataattgtaagttaagttttttgcaacaagtgcccgctatatattgatgtttatctgaaatttgaaaagagaaaaatctaggatggctcgagatacccatggatgtaatgatatagatgtgtgagtgcatgactttcatttattctcttattcaaactagatgggtggcccgcacaattgcgcggctagcacccaaacaaaatcatatatctttcagtatgattttacttaaaatttattaaatagctatacccgtattcctaattatgtagttttaaaagtcacactagctgctaccccttacttctatcatatccttctttatttgcttgcttgggggtccccttaaattttccccaactatttctattcattcttcttgaaacgtttcaaaattggatcttatagtttttgaagttcattatctcgttgggtttcgtttttatatatctggaagtcccgtcaaacgctgccattatactcctctacggtccgtccactgtcttttctcttttgtcattgggattttacaaatcgaatataattatcgtttgagttcatttttcactttctataagtcccgccaaaccgtcagcggcttttccattgtactttatgactcgtccgctgtctaccttctttattgtcatttgtcattgagattttaaaatcgaacatgattatcattgggttttttttttttactttttagaagttccgaacctttaaaaattggaccttgtagtttttagaatttattatcttattggcttttatttcttataatttttagaagtcacgtcaaacaatgccactatactcctctacgacccatccgccgtctactctttattgccattgggattctaaaaatcaaatataactatcattggaattcattttttattttctagaagtcccgccaaccgtcagcagctctgcaactatactcctatacaccccacccgctgcttctcctttttattgtcattgagattttaaaaatcaaatatgattatcaataaggtttattttttttactttctagaagtcccggcaaccgccttgcccgtttgcttcacggcttgcctgtcgtccctccttttaatcatcattaggattctatctgttgttttactaatagtttttatatgtcgtatcaaccgccaccactctactcttttataggcttgttatttaatttatctcatcgtgtgttttagatagtctttttttttcaatagtctttatttttatcaccaattttagttgtttataaattgtattcctaattgaaatcttttttctttttctaatttcagaatttaattttttaaacttttatttaataccgtatagtattcttttaatatttttattttttatttttgaattttggtcgtttcaaaattgtatttctacttgaactctcttttagtttttctaatttttgatattttttatttttttattctgaattttaattaatttcgtattggattgttatatggattcttcattcaatattgcttatttttaattccgaatttcagttaattttaaattgtattcctacttgaactcttttttttctttttgctaatttcggattttatttttatttttattccgaatagtaactaatctcgtattgggttcttatatggactcttctctcaatattcctttttctaattccgaatttcagttatttttaaattatattcctactaggactctctcgttttattttctaattttggattttattttatttttattttgaattttgattaatctcgtattgggttcttatatggacacttctttcaatattgcttatttttaattccgaatttcagctatttttaattgtatttctacttcgactctctttttctttttctccgattaatgtggaaatttctagccctcacagcgaacgtggcgacttctttcaaagctgttttaataatataatagatagatagattattataacacacaattcatatagttgtatgttaggggaaagccgatcatgcatacacactctttttatgtatatcaactaaatactcataaaaaatagtaaaatagatcaatatatcatatatcgcttcacaaacatgcttgtttaaatttgacctacacaacaaacagaaacaaacataacaaaaaatgatgataattaagaaattgtgtactatttacggttgagatttgttatttttgtttctacttatatgtgtcgaattttaacttgaatatttgtagatagtgaaatatcatattttgatctattttaccatttttcaacaaaattttgatggctttgcagttggcatctatgaaatgggtatatgtcatcatatccttttaaaagaaaaacagcttactagaactaccatatatagggtcaattggctggctacttaccgtcaacccaagtactccctctgtattttttactgtattttttaaatgtgttactgtttacttttaagcatacgaccattcatcttattaatttactatgtaaataaagatgaatggttattatttcttctattattatttaacttttttgtgatatgttcatctagtaaaggtactttaagtatggcatatagttttgtatatttacattgagtaaaagaatggtacggtcaaatatatatatatatatatattaaaagtcaatgatattctatatttgaaaacaaagggagtagttatttcattttgcgactatcttaaaaattatcgagagtttttttggttgtaaaactttaaaatataactatagtataactacattacaactcatatatataactacaatataactagatgcatatataatttatatgtaactagaataaaacatgtatggcgcgattgcagtgcactccctccacaaactgaaggccgcgaggtcaaatcccaacaattgtgcttaccaatttattttttctcatccttgctagcacgaatcttagagcaaatatgacggtctaaaagtcgaaagtttccctaaaaatccgtcgaaagtaatctagcaattccgtttcattttcacttccttgaggaaatatctataccgcttgaaggaaagcaagtttaatttgttagcactaattaaagcagtaataccttaagcctcttcaagaactaaagaacacttcaaattattttttagcacagtattattgtagccatagggagtacgtacaagcatatctaacaaacttacggtgtcggtgaaattaagtttgacgctgtaaacccaaaaactccactaagctttactaatttgttgattaccttatataaacaaatgctcgagcactataaaaaattgatttttcatggcatcaccctattatttttattgatggactaatgaaataaatgcttgtaaaaatgtattggcggattctgggtcacaagccgtcagcgaaaaactcacttaggaggtcccactaaaaaaaatagctctatttttttgggcgaacctcatgagagcccaacgaaaattggtttttattggcagtatctaagagcaccactcgcgaaatcttttctgcggtattcaaaagtcccaccgccaaccaaaccctcgctcccttggctccctcgatcacctcatctacctccttccatgcccctctgcctctctcactcccttcatctgacacttcctccatcgtcaccgagatgcgttgcactactgtcgcgaaccgctaccgcatcagccaacgaggaggccaaggccgctagatttggtgaccccgacctcctcgctggtgaatccagttggcccgagcggatgacgcccgagaggatgacaaggagttacatgacgacacagggaaggttactgttggtgtgattcatgaccgccagatctagcggcggcaataacaagggttgcttttcgacgacaccagctgtcctcagcgatggctctgcgaccccgactcttggttgtgatggtaactaggtttgtggctctgagatggtggtggcgatgacaaccaacgctcggtgatggcatctacgacgtcgatcttgagcaaacgtccatatctaggcggaggttgacaagggacgacgacaacacgagctccttcttgttaggattcgcggcctcatcaatggtgttgtgggccagcggctcgatcgtcatggatagggtgaaccccaaggagaccgagatgcagcatggcgatgactactccctcttgatctacacgtggaagtcataatgacagtgaccttgttccgcttggtaacattattcaacattgtacttgtgcaatttgagcctcgagggatcaaattgatcttggattacagtagtagcaaaatgccaagtgaagtccctgcggcaacgcatctccgggtaccgccgcgggttgcacatgacgtactaaaagtgtgacggtgcgatttgatgtcaagacacctttccacgttaccaacaaaacaactactcaaagcggatagcaataggaaataattttaaattagttaacatactctatgtattaatggatgtaatgggagaggttaatgctgccaagtggcagctagcttgtttcgttggttgagttggaggtatttggctaccgggcacgaatagctagtttgataacaaaagaattgctctagcattactagtttgagcctttaatttgatgcatccctctaatgaaaagtcgttttcaagatttctgttgctgcttaattaattagatatatagttgcttatacttttgtcctgtggccagtcctaacggtgcttacattttcgtctaaagttgttcatattactatattttgtgcaccgtcgtcctgtcgtccatgatggtggcatgtgccaatttgccaaactgcagctagtgagagccgtgtttcttttttgcattgtgaactgttagtttgagtcttctatccttgttgcagaacatgagccaattgtatcatatccttatcttcccactatatatataggtgtttataatgtagttgtactactacgcgattggaaagaagcattgtagatattctagtcccatcatattgtgggcacccttactccttcctgagccactgatgtagctttttgttttttcctttggcactctatgtgtatttctcaatcttatccttgaaatctcccttatacttctacaatgacatttgatagattttattatgaaaaaaaatacctttcccttcccgtcgttaacatacggtgttggaagtcctaaacttaaaaactatgtattaattagtggtgaggttttctcctatcttaggatagttgtatttgtatacctcctcatacagaagatacctctaaataaagggagttaccaaaactaatctaatccgattagaataatattgaaaactcatcttttatatatgatcttaactttcccctttttgtgggggagtaggtatatcccttctggggcagatataaacacctcctaacttaactaacactgtgaggtatgtatagctatatactccctccatttcaaaatgtttgacatcgttgactttttagtacgtatttgatcattcatcttattcaaaaaatttaagtaattatttattcttttcatatcatttgattcacaaattttttatgtacacatatagttttacatatttcacaaatttttttaataagacgaacggtcaaatatgtgctaaaaagccaacggtgtcaaatattttgaaacgaagggagtatcttaagtactaaaaaatctctctattgccaattgtgaatttatcttctaatgatgtcaagcggtttagtttaattttccacctttcaaatgtaggaattatatatagttttctaagaataggaggaaacctcacaaatgataggatgggtgattttatttgactagagtacaatgagcttttaggtgatatatctctatctgtatatataccaatttttatccagcatttgtcaattatgcatttaacgtggcaagggtaactatatttatggcgtcatatttttcacaaaaaatagtgggcatgtatttatattgtaagttcctaaattacatatgtaattttagcgtatttacaatgtaagtccaaaatttacatatgtaagtctcaaaattacatatgtaagtcccaaatttacatatgtaatcagtatgtaattatagtgtaagtacaatataattagtatgaataatttatccaccagtgatatagtttaatctctaagtgaaagcaaatactataacaaatcttgaagataatcgactgcaaaatattagcaaaacatggatggtcgtatgagatgtgactataaaactaacaaatttgtggcgacacaaatatagcaattctgaattaaaatgcaggcttgaacgaagcttccgccatgcacagattctcgatatgctgccaaaaaaatgttgacttacatataaaaataaagtagcaacaccattgtactccctcctttatactccctccgtttcgttttatttgataccgttgactttttagcacatgtttgaccactcgtcttattaaaaaaatttaaataattattaattcttttcctatcatttgattcattgttaaatatacttttatgcatacgtatagctttacatatttcacaaaagtttttgaataaagcgaacagtcaaatatgagctaaaaagtcaacggtgtcaaataaaacgaaacggagggagtatatatatgatgttaaaaaaaagagggagtatatattggtggactggatgatgaagctatttcaatcaatctaatacaatgaactttttagtttgatatgcgcaccagctagttggtagatttttcctttttttagcagttgcttgaacaagagctagtgctgttattaatcagtaataaaacctgctgtatttgttaattactaagagctagtcaaggttttcactccttctacatattctgaaaagaatttgttaatttctgcccacttgccgagagaacttttcatcacgtaaccctgacctatcataattaatccagctgcaactagggatgaaaacggatcggaaacggacggaaactagttttatcatactcgttttcatattttttttggaatcagaatcggaatcgaaaactcggatacggaaatgaaatcgaatattatcgaatacagatacggagcgaatacgagacggaacaaatgcggtagcgaatatttaccggcatataaaaaacccctcaaattgagtttcttgataaatgaagagatatcgcttattattttagttcaacatctctaacatttatatcgtcaattttgtagacggtcccacaactgtatgtgaaaatcgattttcatggctgttcctctaagagatccatatgcaaatatgattatcattttctattcccaagaccgtttattagatgtataacttacttaccagtgtataaattggagatgttatttattttacttcacgtcttcgaaacttgtaatatttgtattatactttaaatacttttaaatacaaatgttataaactacaaagtggtagatcccattgtgctctacaattttgatatggaacacatctccatcagatgtcgtttgaattgtagatctgagattttgtaaaaattaatatggtatattataatgaatatttagacccttaaatgacctcaaataataaaatagtcaataataaagttatagatctcatcgagctctacaatgttgatataaagtttgtcttcatctgattccatatgaaaaagttatacatatatacgtatatacatgttctttctaaaatttgctcaatgtgtacggatatccggaaaaaaatccggatagtttccgaccgttttccgattccgacggatagtactcttaatgtattcgttttcgtttccgagaaaaaacatccgaattcgtttccgaatctgaaaatttccggataattccgaccgaaactatctgaatccgaaaaatggtccggacggacggaacctatccgaaccaggttcatccctagctgcaacgcataatcaactgcttaagagacattgtctgacactagctagtacctgccgtgcataagtatacgcgcatatgctttatttcaataatgcttgctgagtactccctccgttttttcttcggggactatactttttatatggcgttattaaatttggtatttgtccatttgatatacaacgatgttgatatttagatatgatagtttgttatttgtcttattcaaataaaggattaagtccgatttacccctcaactaacgtgatacaaggatttaccccttgaactgtaatatcaaacatttgatgctcctaaaataattgattaagtttgtgaattatttttatttactgaagtaagtatataattaattatatattagtgaaagataaattcactacttcaattgtcaacccgttgtgcgatgattttgtcaaccccatgcaattatatcatagaggatttaactagaatattatgtgttagcttgtccttgattgctatctatcttatattcgaaggaagttatcgatctttttgtttgacctcgtcgttcaataaatatattggtttttaatagagatgttaatttgatccgttgtgcaaaatgcatggatgtgcaactagctagaggtaaaaaaaatatcagtgaaaaggaggaggaagaagaactacggtgacccatccggttattgctctgtacaagctagctactttttataaccatactctatacaatcttgtgtatggagctagctaaatactagataatttaaggccatttgtaggttgattgatccgccacgcaagctttgctacctaaccatttcaatgaaatagtaataattaaactcacatcttaactgcagagcacaaaaggtgtttgggagagacttagtttgacttgcattccctgactagctagctagctcgctcgctctggaaagcatgcttatgtccatcactacgctttttgtccagttaattgcccgttataagctcggattagaggaacgattccgaatagcacgtggtttagcgagccaaccaacgtcgcgggtcaaaccgcagagttgtacacacttgtgctgcaacaaacaaacgtacgcgcatattgcgcggtctcctgccaccaccttaccctttgccaacatgcatccgctccaagattaaaaaagcttgcgatccagaagctatctatcaaccgaacgctcccctgatctcatcttacctggaggctggagctcatcttcacctataaatactcgtgcacatcagcatcacttcatcacctcaaccatcgcaatccatcaagcaaatctcactagctagctagctatctcagctcactctctcagtagccactgatcagaagaagagcaagagaagccaattaagctagctagctaagctggttaattgccatgggtagtggtaataagctcgctgccaccgtggtcgtcgtcaccttcgcggtgctcatggcggcggtgacgacgacgtgccaagcagcttacgggccacccaaccctgcttcgtgcgggctcaaggtcggttactactacgccaagtgcccgcatgccgaggaaatcgtcaagaacgtcgtcggcgccgccatcctccacaaccccggcgtcggcgctggcctcatccgcatgctcttccatgactgcttcgttgaggtacattcctatatatatatatatatatatatatatatatatatatatatatatatatatatgcatgtgtactatacttgttttattttatattataatttatagaaaaattcgacaatttgtaaagcacgaaagtactaaccatcgaatatattttaataatgtatttgttttatattaaaaatagtactacatttttctataaatttgataaacttttaagaatatttaatttataaaatcaaaacgaattataatagtatgaaacgggcggagtggtatacaattaaggcttcgacatttcgaactgaaattttcgaaatttcggtcatttcgtaccctctgatatgatattattttgcatgaaatttttatttatttttattttttcttgaattctgataatatttgtttaaatttgactacattttgtttcgaattttggaccgaaaacgggattgaacccacatataattacgagtttctcagctttgtggccgtggatgcatgacacgtttacaccgccaatgccgaaaatgtgcagggatgtgatgcgtccgtgctgctcgacccgacgccggcgaacccgcagccggagaagctcagcccgcccaacatgcccagcctccgcggttacgaggtgatcgacgccgccaaggcggccgtcgaggcggcctgcccgggcgtcgtctcctgcgccgacatcgtcgccttcgccgcgcgcgacgccttcttcttcctcagcaacagcagggtcgcgttccagatgcccgcggggcgcctcgacgggcgctactccaacgcgtcgcgcgccctcgacttcctcccgccgcccaagttcaacctcggccagctcgtcgccaacttcgccaccaaggggctcggcatggaggacatggtggtgctctccggcgcccacaccgtcggcgactcccactgctcgtccttcgtccccgaccgcctcgccgtcccctccgacatggagcccccgctcgccgccatgctgaggacgcagtgcccggcgaagccgagctcaggcaacgaccccacggtggtgcaggacgtcgtgacgcccaacaagctggacaaccagtactacaagaacgtgctcgcgcacagggtgctcttcacctccgacgcgtcgctcctggcgtcgccggcgacggcgaagatggtggtggacaatgccaacatccccgggtggtgggaggataggttcacgaaggccatggtgaagatggccagcatcgaggtgaagaccggcggcaatggcgagatcaggaggaactgccgggctgtcaatcactagctcatacaaatttacgagcatgcatgtttaattaatttattcatgcatatctatgttctatcgttaactgctgcatcttgtctgtttattctttcttttccactgatttcatttcaagtcaaatgaggcttatgtaccattatattgtatcatgtttgaatataataaaataactttcttacggacactacggagataccacaaggatcacacttgttattaatgttaggagaaattctgactgatatgtaaacttttccattaattgttaaagggacagcattagctttgacaacaaattaaactaactaataaaatgggagcacttatatttatggtgccacattttattttttaaaaaaataatcaaatcgtttttacactttaaattacctacactcacgttataataacaatataaagttaaaaacttacactgtaatttataatatatatacattagagtttttctaatatacaatgtataattaagagaattcatgattaggattaaaagtgatttattatatatttggaagagaagatacaagagatataagcatagttacatatcggagagagcgcaatcacatagagaaaaagtgactgaaattatgtgaaaatgtggcatcatagttttaacaaacccgattaaaaagtttagggatgaaagatagtgtgttttcccaatatttcccaattcccatccacatatttaatctaagtaaggccatagaaggcactgaaatatttcattatacatcaatataaacaatagagtaaattctctttatactcttgaaaactcatccaatccctttcaacctcctgaaatttaaatcccttttgtacctttgaaatttcaatttgatcctttccatgcccctgccggtacattttccttcatttcacttttaagtttggttgaaaatatcttttatacccttgatgatttagatttgaatataagcttgaaaaacgattgaaaattttgtttgagtgcacaatatgtgcattttatgaaactaatgacactaaataattagtgcaaaaaaatttgacataaattttgaaagtaaaacaaatttaataaattaaaacttttatttgaaatttcaataggacaatggattttttttatcaagagcattcataaaaatatatggtgagcattggtagtcctatctttgtatgaatgctcctaaataaaataaatacatatttttttatttcattatctaaaaataattttgtcataaataatatatcgcacaacaaactcataactattatagtctcatgtgtcaatcttttacattttcaataatgtaattcataaatttgtatgttcatccaaagggtaacatggtcatttttatagacattagacggtcaactgacgagaggggtatggaagggatcaaaatcaaattttaagggcatataaggaagtaagtaaaattcagtggcataaaagggattagctaaaattgcagggatatacaggggattttctctaaacaataagggcaatgtatttccctttcaatttatcagactaattgcaggtttgtagtttgtacagtctattatatgtacaatctactatctttgttcttaaatagatggcatatcccagattgtatgccatcaaacatcaaaattttaagtttttttatgaaataaaaatattataaatcaatacatgaaaataatactagtaggtttataatataaagcactttcatacagctgccttcaataaatattataaacatattagttattaaaaatattgataagatgtgtgtattaaagattgtcacgaataatttaaatgtcaagtacaaaatgagaatgaggtattggctagtttattgtgggataagagtcaaactttggaccataccaactcgatcaccaagtcaacaaataatcaattagaatgttagaagattgttttgaggaaatcaataatagtctataactaacatattcgagacttcaattttcaactcatgcttataatgctattttttttgactgaaagtactgccagggctttgcccagcagtttaaattttataaatcataaatatgtacaaagttacaaaggacaaacaaaacagctaaactataaagtttgtatccaatcaaaaagaaattgcttgagtgggtctttcattctgcacatatgcagaagaacttctttgacaaatatagatttccatgattgaggcgatggcttcacattctgaaaaattagcccatttctttgcttccaaagatgccatgctgccatgaaaaatacctcaaggaaacccttttgagcaaatctgattctcgccaaaacaatcatctgaaaaaattccagattacaattctaggaaatgcctagctactgccaacaagccacactgaaagggcatgtaaaaaagagatgaagcctagtctctctttgatgtgtattacacaaggcacatgtgagatcgtcatcctcttttgcacaatgtctcatgtcaagcatatcccttgtgttaagtctatcacaaaacaaaagccatgcaaacacctttatcttcatgacacatttggttttccacagccaaatcatgggtctaggaggatgcaacgaggagtaattaagcttataaaatattttcgctgtgtacatatctgttccccaaataaagctccaaacatcacctcttccaggctgaagttgcagataattcaatttataatgctaatttgtcaatcccttgcacatactccgaaattatagtttgctaaatatccggcattgacttgtcattatcagccgttataacctaaaactatatcgcagggagttcgatttattttattcttgaacatgctaattgttagaactaatcatgcgtagtttttcagtagaagtcaagttacacgctaagtcatacatacaagaataaatggaaataggggtaaaacaaaataacttcaagcaaattgtacggtaagccagctagttcctcccaccgaggaacttgtggttttgggaggactcagctttgactttgacccattcatgtgtagactaagaaattaaactaaaatgctacttcttccatcctagaataagtttattttttgttgctcccatctgtcctaaaataagtttattttttaataattgttgcatctgagtttttgaaagttggggataaatgcattcgaagtagataaagtgaggaataaacacatcaggatttgataaagtgggggtattttaatctttttttattgggatgtgtgagatggtgaaaattaaatttattctgggatggagggagtcctcaatatatgaggataggggaattttaattttgattcctcgaggaaatgtgattagccatgatcccgatcttctgaaagatattgataaaccgattgtggtggacttgacgttgataatctaaaggctcctagtataagcgaatactaagaatacaaacaaggaagtaggagaagaaatctaaaaatactacaaacaatccaaaataacagcaaaattacaagtggcggaataatctaaacaaaagccaactctatatgatgatggctatgtgtgtgtgtgtgaactaagccatggggagtgtgctctttacactcacacactccctatggtttagctcatgacacaaatgcaatctccaagacccaaaattaactaggactcgatgaagtatatgggcatatggcttgttttgactattccaaacatcttagcacaaaatctgacatgagacaaaaaaccatatgaaggagggcttcttaagctttccaataagtacttatgggtttccaaggaatctcctgtatcatcagagtcagaaggaccaaacccacgaataggaatttgcttgcacgtgatggttcgtggctcctcttctacatttggccgttttatcttctccattgtcttctcctttgttactaaggacaatcaaatcatcaaaagtaataaatagtatgtcattcttagaaacatttgtatcaaagcatagaaacccattcaccttatggctaaattgaagtgcatgggcacgacttactggactttgcattgttggttcatcttgttgaacttgttgaggagattgtatgtgaatttccacaagagcgatgtcattatcattacatctatttgcataaaccatatatagttaagtagttatgaaaaattctcaaattataaataacattcatgtacatatacaactccacaaaaatttcaaggttaaatacaaaacacacataaaggggggaaaaggataaatccaagcatataaatagtaccgatttcttagtgtgtagttcgattttaaacattaagtgataaaggtttgccaaatgttttttatacaaaaaaaactataaccaattacatgcatttgagatataaattatcaagagggaacattattcacttgaggtatcaaagtccattctgatgtggataggcatgattttagttagtagattcaaacatacaaagccaattatgtttttttttaaatagacactccattgtcgtagtttaggggacatggctgttaagaataaaataattaagctcatcctatatctataccttatataagattacaacccactaaatcctaaagcttaacatgcaaacataccacgtcatcatccactagcaattaatacatcttaacatgcaaacattctaatatacaatttattacattcaagagcgcaacatgcaagcatatcaaatcatcctcatcatatttcaacatgtccatccaatcctatatttcctcctcttcattcagttaatttgatttggatttatgttttattaaataaaggaactcaaattgaatagttcttgattcattggttcgcccatcgtaatatgtgctctaatgtctgttggttttttttttaccgtgttacaaatgttttctatattagttcccctattggactatgtgattattatcccttacattacttctactaatcttagaaagttggaccccaaaaagcatttttctacctctagttttttattatataaatacatcctaattcatgctgcactaacataaaaaccaattattctaatacaccgtatgccttagttgtttaattcaatcttcaaaatcttgtagcaacgcgcggggtatcaactagtataaataaagtctatccccaccacctatagttaaagttatttttcactcaccttgttgtgccacatcacctaaatttgagttagccatctgatttagcctatgtgctctagataatattgattaagcaatcaaacagcccatgacccatcccaactttcctcctcctagtactgaatcgtcactccatcgtctcacataataaccatcacaattgatagggaatctgaggcaacgcatgttaatcagttttagctttcgatcttcatcaaaacattctggtaagcctgctaataaggtaaccaaacatttcttttattacaaatccttataaaatatcagacatggtgagataccaatcataccattcatcattaaatcatggtaaccaagtgttgttttcttcacttgataatcataacaactcaatgcaagcataattgatttagaatttaagaagatctgaaacttttacacattaaaggcaaattttgataaacatgatatgctactcaagtgaggcaccatgtcaagaatgatgtatcactgccagtctgccacactcacaattataaaaaactatgattaagcttaaggctttacatcctctttcactatatgatatggaatataagggcatcatatctgcgatgagtttattaccttcaaagtgaaccatgtaattgtactacttagtaataataaacctattttagtaatgagttccattctgacaaccatttcgtagcattttgattcttttagttggcacatctgagcctgcagaatgaatgaagtacaaaaagtacacatttaggaataaactggattactttgataagttggcaacttgggagtagtattacttgtacttttctctgtacagttttttctctgatggaaatagatgggagtacacaatttcttatggctattgtacttctcacctcaggataaaaaaaaacccttatatttctggacaaattaaggagacataatcccctatatttctggacggagggagtatctaatactacctccgttttaggttataagactttctagcattgtcaacattcatatagatgttaatgaatctaggcacacatatatgtatagattcattaacatatatatgaatataggtaatgctataaagtcttataatatgaaacggaggaagtacttaattaatcatgtgctaatgagtcgctccattttatgtgcttagggattagttcccaaccatgggtgccgagcaaagcctaagtgtcatttctaaaagacggttgtgtgtgaataatattcattgcaaggaatggattttactaactttagatgcctcctttaccactatatgcatgatggattcatctggactttttaaggggataaagttaaataaactatatgatattatatatgactagcattttacccgtgcgttgcaacaggaagaaattcatcttctctcgtgtaatcgggattctatgataatgccacgctgctaaattccataccgagtcgaggtctaagatgattcaacagaagtagattggattgggcataaggctgacatggcatttgatgacttcatccatctcatgcgcaactcgtcgctaggtggggctcgattcgataggtaacaaacctaattactattaactgcaagcatatgcatatattttgaatcaagcaatgatatatcttgtgtgagtagtttgggcaaagtcaggggggtcttgtatagaactgttagtctgctcagcttaattggaaacagaagattgcgatgccgtttcgatccggataggaaaagacatagaaacacagctgcggtgggcttgcacgaagcaaaacgtgcggcatgtgttggactggtgctaagagatgaggtatccataatataacgtccgaaattaaacaagtgactttcagtttcactaactcacaagcattacgaagatatacaccaaagcttttagaacaatgggtatggtgtatgagtatatataataaaaccatctgtgagcatgaaagaattacttagtttattactgaatcaaacagttggtgtcgtagtgaaagggagggagcagtctgcagcatggccaccactgaagaccacctgcggcaaacattgaggcctacatcagcggctttggcaatggtgtcattgaatcatgggccagcttgggcattgcgacggtaattttcctagacattcgtgggtatcagcggcgaggcctgagatgctggcatcgacaaaacacgacaacaatacgacgtggtggaaacaggtgaaggctaggagcgagtgatgatgtggtcttcgacgacggttggtggcggcccggaggagatcggtagtggccactaattgggaaggggagggagcacgggaagaaaggtgggaggtggaagagattaggagagggagtgcgtgcatgaatcaggggatgtgatcaagggaccgtgattaggggatccagatcgctctctcttaaaagggtgacctcgatacaaactcggtgacgacagacgaaaaatcatacggaagccttacgtatgttttaagtaggtatagatgtcatgtatcctatagatacagatctactactacgatatgtatttaatattttaatatgtgaccaaatgttatatttttgggacatgttttgatatatccaactgatatgcaactgatctatgcaatcatttaaagtatgatataatgatatatattaccgatatacaatatgtgcatatatcaatacaattaataacttatatgatctatacaagcatttaatatatgagatactactgtatcttacagatatgcaatatatgcatatatcaatgcaattaataacttataagatctatgcaagcatttaatgtatgagatactacttctccctccgtcccaaattagatggcatgtatttttcccctgttgtctcaaaacataaggcacattttcaattgttgcagcttctacccggtaatgccctctcatttacatgcatatgtgaataaatgctgatagagggcgagctgtgcatgcagccggaacgtgggcccgcaccgtgtggccgtttggattgacttatcagcttcgtaacagagcgcttcaatctctatacgagatttgcatgcttagttagttgatttgaatgcccgttcacatggatcctgctaaataggggtaaaaatagataaaactaaactgcatgcaaagtctttggtcttagcaaaataaatttcacaccctctaatttgggacggagggactactagcaaagatggatctgataccaacatgctttacatgatcatgaaagttgaaaggctgcaactttggtactccctctgtcccagattggagggcgagtattttttttccccgttgtctcaaaacataaggcgcattttcaaattttacaccttctacccgataatgccctttcatttacatgcatatgtgattaaatgccgctagagggcgagctggtgcatgtagccggaacgtgggccacaccgtgctgccgtttggattgacttatcaacagagtgcttcaatctatacaagatttgcatgcttggttagttgacttgattgcccgttcgaatggatcctattaaatagaggtaaaaatggataaaaccaaagcatgcaaagtccttggtcttagcaaaataaatttcacgccctctaatttgggacgaagggagtatatcttatagatatagtatatatcaatacaattaataacttctatgcaagcatttaatgtatgagatagtgttatatcttacaggtatgcaatatatgtatatatcaatgcaattaataatttctacacaagaatttaatgtataagatattgttatatcttacagatatacaatataatgtatgagatgcaatatcttacagatatgcaatatatgtatatatcgacgtaattaataacttctacgcaagcatttaatgtataagatattgttatatcttacaaatatgcaatataatgtatgagatgttatatcttacagatatgcaatatatgtatatatcgacgcaattaataacttctacgcaagcatctaatgtataagatactgttatatctaataaatatgcaatataatgtatgagatattattatatgttacatatatgcaatatatgtgtatatatcaatgcaattaatgacctatagatagtagcattcaatttccactatagacctcccctatttaaaacccaagcatcctaatcaaaccactcaccaccactatcaacacaactcttgcatcaccatctgagagaaaccagggagatacacacaagcaatagccatggcgagacaacaactcctaggtttgttcttggtcctcgccattatggtggcggtcgtgtggggcgaccctagcggcggctgcgaccaagaccggcaggacatgatccgggagtgcaagaagtacgaggggtggccggcggagcccaaaatcgagccgtcagaggcgtgctgcgccgtgtggcaaagggccaacatcccctgcctgtgcgccggcgtcaccaaggagaaggagaaggtgtggtgcatggagaaggtcgtctatgtcgccaagttctgcaagaagccgttccagcctggctaccagtgcggaagtaagtgaaacagatctgtagattttatcctattatttctacttgtatatatgtacatgtattggactatatgcctgatattgcttttgtatggttttgcaggctacactgttccatcgagcctagggcaataaatagtacgttgttactgatttttatttttccttgtgacagaagaagtacttctgggattagttttcatgtctcgtgacatgcacaatgtataacttctgtgatttgtgtggactgcaaaattgggaaaaactgagaattaataaaaacagaaacttcttctaattatattatctagttcgtgtatttactttcacttgtaaagtatagtagcaggccccggtccagtaatttatccaccatgcgattttgctgccagcatattctactgatgattaactaaaccatcttaagaataatcgaagtcagttattcgagaggcattgtttggctttaatccatcgctattagagagacatatggttcaatcatatgaatatatgcagcggtgtacatatatatatctttacttatacaactactagccattagccacaataggctacgtactcagcacttggtaccacgcctaaatcaaccaaatgagcaggcctcaattaaaccaacgttaagcaacacatcccaattccccgaaaacctgggtcgagcaaacattgtcaggccgcgccatctggtggtcaacaaactaaccaacacacacataaacaccggtgatcaattctcggtacaatgacaccaaagatatattatctaaaaaaaaatgacaccaaagatatatattacatccttcgtcttatattataagtcgtttgaattttttcttagtcaaatttctttaagtgcaatcgagtatataaaagattatactaatattttcaatacaaaataaacatattatcaaaaaatattttcaatgttaaatgtaatgaagctaatattgtgttgtagatgttgctactttttttataaacttaatcaaacataaagaactttgactaagaaaaaagtcaaacgccttataatataaaacggagggagtacaattaatcattactcatattaacaacatttagctataaccaaattactcatcacatacacgatcttatggatctctgtggtgagaacggacaacatgggaggggagagggatgatgatatataagtgatcgaccaaggtattgttgtgtatgctatgtatgtactatttccagaatacatctggatgttgacgtcattaaaatgaaatgtgatactgtcatagaaaatttgtttaataaaatggtcacagatggagatttcaagtgaaaccgcgtttatattataacaaaataacgttaaaagttttttttaagctcatgcagaacatctcattccatatgtatgtttactgaataagtacttctacggtggtctatactgatataattctacaaccggtattataattagtataaataatctaagtcattgatttatgagtttactaccaacagtaaaaaggtaatctacttctattacatgaggtggtagtttaaatagatataattcatttgataagaaaatatgagagttctagattaattctactatagtagggaccactgtcttaccatttccctaaattgcctatgatatgcctttgatggttgggcaaaccattttgttgttgtgactactgtgatgaactatatcatcccacacaaacatcattgatggttttctgaaagctagcctcatcattgtagcgcaacctttgagtgaggatataagagtaactatatggtggaaacactaacttagatgaaaaccggtgtaaactccaaacgaaaaatcatctaaattcactaaaagatgcctaaaggtagacaagaatatattacacgacaaatgtaaatatcttatccaaactcgctttcgtctgtgagatataaaaataaaaaaaatttgaaaaacgaagttaaatttggacatggattttttacatggttgtgtaacattaacttacctacatgtataatttattttgtgaatttagacgaaatttccattagggcttacacaaatgttcagcaaagttgagttttcactatatatttacccactgtatacctctgtcatgaaagcatgtgatttacaacaaaaggttattcaacacttttaaaatattttgattgcggtttcttttaaaaatttgaaaagaggagagatacagattgagacgcaaatcatatatttataaatttatcttaaaaaattatctgaaaataatatgttacaatgttcacggtccaataagaatttcttttttatgcatagaagtatacgcgtgtttatataagtgtttgcatatgtactatgttttaataataataataataataataataataataataatataaaatgttttcgtaagcttgaaagaaggcatttgggtgttatgcatgccggccggcccgtacgtacctgcacaatatattatgccaactactcacatcaagggtcaaagtggtgagttgtattcaaacaagcggtaatcccacgcgcattgttcgctcccctgcctgcctcccaacatgcgctccaaaaccttaaacaaattcgcactccagaagataaccagcgcgcgctgatctcgtcgtcttccttgcattggcgccgctcaactcatctccaactataaatacgcacacacaataacaccatctcacccatcggtcgagtctctcgcagctttaatctccttcaaagccaattcaattaatcagctcgatcatatcacattactgagagagggtgcaagctagctagcaacaagctgccatggctaataagctcgctgctctgctcgtctccttcgcgatgctcatggcggcggccgccggcttctacaccccgccaagcccttccacgtgcggactcaaggtcggttactaccacgacaagtgcccgcacgccgaggccatcgtcaggggcgccgtcggcgccgccatcctccgcgaccccggcgtcggcgccggcctcatccgcatgctcttccacgactgcttcgtcgaggtaaaatcatactccatccgtttttaaatatttgacgcaattgattttttaacacatatttgatcattcgtctcattaaaaacttttgtgaaatatataaaactatatatatatatatatatatatgtatatttaacaatgaatcaaattacaggaaatgaattaataattacttaaattttttaaataagataaacagttaaacatatttaaaaaatttaacggcgttaaatatttagaaactagaaagggagggagtatatataatggtgtcacgttaagtatgccaagtgtggccagtcacatgtcggaatgttactgtcatggctgcattgacacggtcttatgacttgagttgacgacatgaacgcgtgcagggatgtgatgcgtccgtgctgctcgacccgacgccggccaacccgcagccggagaagctcgccccgcccaacaaccccagcctccgcggcttcgaggtcatcgacgccgccaaaaccgccgtcgaggcggcatgcccgggcgtcgtctcctgcgccgacatcgtcgccttcgccgcgcgcgacgcctccttcttcctcagcaacagcagggtgtcgttcgacatgccgtcgggccgcctcgacgggcgctactccaacgcgtcgcgcaccctcgacttcctcccgccgcccaagttcaacctcggtcagctcgtcgccaacttcgccgccaaggggctcagcgtcgaggacatggtggtgctcgccggctcccacaccgtcggccgctcgcactgctcgtccttcgtccccgaccgcctcgccgtgccctacgacatcgacccgtcgttcgccgccacgctgaggggtcaatgcccggcgagcccgagctcaggcaacgatcccacggtggtgcaggacgttctagacgccgaacaagctggacaaccagtactacaagaacgtgctcgctcacaagggtctcttctcctccgacgtgtcgctcttatcgtcgccggccacgatgaacatggtggtgatcaacgccaacatccccgggtggtggcaggacaggttccataaggcaatggtgaagttgtccgccgtccaggtaaagaccgccggcaatggcgaggtcaggaggaactgccgggttgtgaattactagttgagagcctcagacaatcatgagcgtccaaagcgttcaccattccaagcctatctttgctctctgttaacagctgatatgctgatgcatcttgtttgtttcattccttcattattattgattttcatgtattgagtctgttgtatgagtgtagtgtgtttcaacatgaaagttaataaagtaaccatttgggaagttacatttacaactccatgtttgcttgcaggagggtgagattactgaaatttcagaatttttgaaccgaaattgcaatctctggtctcaatttccttattattatttaattaacccctctagtatttagagaggatttatttcacacctattatggtatataattattttccctcaatcccctctgatgactctcttttgggaattaatcaaagaatgtctgggttgaacttgcacaaccaggtacgcagactggggaacctgagctaaaagatgagccttggaatccttaggacccaatagcagtgaaaggaaggaatcaaggtacaccaacagtagcaaagttcccaaccacaccaacgagctgccaatagaagtgctttctgatacttagttattttgatcggcaatttcattgcgctatcttgacccaaaattaaatctttttactgtgggtactgggtagatgaactattgtataataggtggtagagtggagatattagctgtgttttggttgcaacaaaattgtgaagaatgttcagtattatgtttttattcctgttttagcaactttggctcatctaataaggtagtaaattaagtgataaaattatgccaacttccagagagctattaatatgtcctagtatttttttttatatttttccttgagctttttagtgctaagcatagttgtatgaattcacaaattcaattttatgaatgaaatcatgcatgtatgcaagaaaatccaaatacaagccaaaaacaattctagcatagaatatcaaacacctagtacttctcactacatcatttgtataactttccattacgtcattcatataactttattcctagtttatcatacgaaaattgaatttaatgtgtatttgaaatttacttaataacctgatctatttgtctaaaaaattttattataggatcatgtggctagtttacgtagtctataaagtttcgacatatttataagggacaattgatcatttgaccctattctaaagcttaactatcaattcaacctactattttaagtttgcttgtttgaccttgtgttgatgcgaattgaatttaatgtgtatttgaaatttacttaataaccttatctatttgtctaaaaaattttattataggatcatgtggctagtttacgtagtctataaagtttcgacatatttataagggacaattgatcatttgaccctattctaaagcttaactatcaattcaacctactattttaagtttgcttgtttgaccttgtgttgatgcgaaaaacaaacactggcctgagagatctgcttaactccagtgcaggtctaaaggttggtgagatgtaggcgtgccagtcagtttgatcctacaactgacaagatatgtaaacagtagatcaaacagccgatcggctgacaagccgatgtagtagttccagccgatgccaatgccagccgatagcaatagggttttgagctatcggctatatgtccaatgtatataatgatatgaaggcaatcggctgatgataatataatatagcaatataatccagtataaaccaattggctaacaatatgatagaataagcactgatccgaaggttaaagcatacatcggctgaaggtccgatgtcataaaatccaaacgattagataaatcaatgaaacctttgtcgtaatcggctaaatccaatacgtatgcaatccttgtaagccgatgcaacgtccagataactcatcggctgaaacctcgatgaagcttattggcaatcaagaagcaggctagagattatggttctaagcacgacttagtagatcaaacttaactgatgcaacactaagtatg

SEQ ID NO: 19483 - DNA, 11103 bp, Oryza sativa
atgtcataaaatccaaacgattagataaatcaatgaaacctttgtcgtaatcggctaaatccaatacgtatgcaatccttgtaagccgatgcaacgtccagataactcatcggctgaaacctcgatgaagcttattggcaatcaagaagcaggctagagattatggttctaagcacgacttagtagatcaaacttaactgatgcaacactaagtatgaaaagaagcataatatctagacaatcaagccgttgactgagttttcagggtggtagatgtctaagctaatctaatctagcaacacgatttagccgataccggcggaaaccctaaaacaagaaatagccgatagaactaaattgatatgctaagactagattaacagagacatatgataaataggtaggcaaatatacagtccaaaccagagcaatccaagaggtcgaatgtcctgatgcagccttgaacgacgccaacgtaaacgatacaattgtctgggccggcggaacgtaggacttatcccttcaccggagatcgaaagccgacgcagccccgcgtcaggtgccaaattctgccggatgataaataaaaacctcagtaaagagggtggcgatgcaccgagagtagttgtattgatcgatatattgatagattacaatgaccccgggtgtacatatttatacccatagggagatactagtccttatcggacaagaaagaaactaaagataaaaggaaaagataaagtccttattataggacactaaacacactttcctaaagataaaaggaaactaacaaactattcctaattaataggtaacttgccatgctgcattctctttgaactcggtctcttctggataagcttcccttagtagatcaaattccttaaccgaatatagtaagaatccgacaactgacgacttgataactctcatcggctaatctcaggacttcgaagccgatgctgactctaagccgatgattactccgggcttaccaaatttcactgttaaatgaaaaaaaaaatatgtatttacaagcccaaataactaaaatgtccatataacgacatttgccccttgtaaagaggtaaaattttctagtttaatttaaatttgaccatatcctcctttccaaaatatagttacttctaacattaaaattctgtgtcacaatgtgcaatttctcctcctactctcttatttcaatcaatcacaactatctactatttaattttttaacatacttcctcatctgaaccaatcataactatcccacacttaatttccccctctacataacctccgtaaaaaatccataagttattttaggacgaatgaagtatttgacaaagtcatttgtgatggtattttgttcacgagagtaggtgcttatgggacttccatttatttcttattcagtgctgattttttcataccaacattcacagaattaatgaaacattctcaaaatgtattttaacaattttaataatctatgtttccataatataatttctcagtacgttaaaggtaaagatcccatttcagggtgtgttcttgtggcaaaaccatatttttgcaatgtgttcaagcaaggcctcaatttttaatgtgatccttgtagttttacctttgaactacccaatcgaattttcctagctcagctatatattgtggcctttgtggagaaaggtcaagcttcagagtttggacttaccaaatcagcaacgtacgtaccaaccgatttatagcttgttaattgcgttgaggaagccagtataatagtcactgacactttgacaacttcaattcaactcgatttcttttctattttctgatttttcaacgacaacgactccccctactttgcaatgatatatagcgtagttgattgaggggagttaaggtagactattcggcattgacttgtccttgatcggtagctagaatataattgggattagatatcggcgctttcacttatatgtatgtgcagatatttgatcaaaaccaaccccattgacaatgcatacgcaaaatgcagcatgctccaaaacttgtcatgtcaacgccgtcgactaagctagaagaaacttttatcaaggtatataaatgtgtatgacagcacacataatatcgagccgatccatattattggacagaaactgtccactagacctaaacaatcatggtaatgctttgtccatgctaattgctgtgcactagctgtgcgttggctttttttatgttaattattttcgtttgaaaaggctagttgcttgacttgctcgtacatatttttttcgtatataaatgtcaagttacattttacttagaaaataatttggattagatggaactagggttaaaccaagtttaagaaaattgtagagtaagcggtcggttgtatagtgcactaattaagtagctgtgagaatgagatcaactcagaatttcatggaaaatttttctacatcttgctaaatggcataggcccaaataccactctcttggatagttggattttctttcccattaactcgcactaagactcttccatataccactattcacacttttatcattccatgtggcatcacttttgcaatccaacccctccccccccaaaaaaaacaaaaattgatgtagaggatgaggcaaaaagaccaaaatatccttgagaccaattgtaattaaggtgcatggtggcgtctatgttgtttcctccctggcgatggcatcgttgccaccttctttgagccagtgcccagcagggaacaccaccgacttcaactacaatccctatttgacacacgccatcatggcttgaggcccacgtccacgggcgtaaatcattgatattattcagctaccactcaagcggaactcgctgactcgcgaaagtgtgaaatcattgtcatgattaatatttgtgatgagcaattggctttacaaaatgatttaatcaacgaattggtttgaaaagatgtgtggatgttggtgtgagtgcgtgtgactaatgtgggtcaggttgtaatatctgtgcccaggaacggttgttttgtctgattgtgtgcaggtgacttgaggtcagccttggtcaatggtgaggaccgggactatgctcatggagaagcagaagtctagtacggtcaggataccatgtgagaaggtaactagagttcggattcttggaggtcaacttcagtcaacggtggggatcgggactaaactcagggaggagttgagatccagacggtcaaggataccgggtgacgaagttggatacgagatggcatacggtggatggacatcgtgtgggagagatcttcgcaacgggtttcacgaggtgtgcgtgcaacgtcggtgttcgcagaagaaaattgtggagtattatatggttgctacagtacttgaggtactgtagcggtgttactgtattgtgcatatatgtgtacactgtggcgtgtatgcgtgtatgtggatgcatgtacacgtgcatgtggctgcatgcatgtgtgttgatctgataggttggctcgaggctgtggcaagccgagtcggctcaggagaacaggaggacgtgtcgctgctgtgacggcgaggagagtccgacttgtctgtggccggtgtggctgcaggttttgggaaattgtaaaaggtatggaaattgtgtattgagtcctagtggaactagaagttctactcctactttaagtaggaggttttttggtataaatagagagggagcgtgaggcttcccggtatcgctttgagagcaattgagttgatagtttagttagggtttcgagtttaatcgagatttttgtaaggagtgctgttgttgcactttgtaaacacatagagaagcaataaagttgtcatttactttgagagttcttcgatttgtgtttcttcgggttcaggcggcaggaaggcggtctaatcggcggcgtgcgagcggttcgaccggcggcaacaggactacgtcgagatttccatcgatttgagggtaacttttatttccgctaaaagtttttgggtttttggttttccttaccattcacccccctctggtaggcttagtttcttgtgttcgatcctacagaaagttactgcttcattccccttctccatctccatatttgagcagaagtgaggggagaagtctccaacaattattagcccttagagagccgctactcctacttcagctctctgactcggctcagccaacctcgctaccaccggtggtgaagtggaggtcttccatgtcaacccgccatggcatcaccaaggttgtgcctatcaacgaggaggcacatgcatcatcggtatcccttgtgcttgggcagaggtgcttcgtcgacaatgacttatttgagcactctgtgatgatgcgatgtgatccactttctctcgaaggagcaatcgatccagaccaagggtttcctgcactgctcacccgtggcagtgggcacccatatattcgtcctccaccacattctttcgctcctacctcccccatcctgatttcttctcctgtgcatactctgacatcgagaggatgtggcagtgacgccaccatgtaccatacagctagacccaagggcatttagctcgatctttttgcctcatcctccatgtagaacaggggaagaattgtaaaagtaatgccacgtagatgattaaagggtaaatattctccatacagaagagttttagtggggaccaggtgtcaaaggaaacgaaagtccaagaaagtggtggtaattttttttcgagaaaaagtggtagtatttgggtacataacatttcagaagatggtaaataggaaattgtcccgaatttcatagagcacaatctctaccaaacccattataataatccaacatctcttcagaataattgaagtgtcaagcttgcaggtcacaataaatatgcgtttgagagacttaattggtttgactttcgtccctagacagcttaagaaaaataatccgtgttgatgcttcaaccatatgcaggtcgcatttgtgtttacgtacaacaaggtgccgctcgctccacacttacaacacacacggttccgagctgtccatgatcaagcacggtacccgtcaatttagcattccatttcattcagcacaaaacaacactttcactttgcagaaaccatctttgtcggtccaccaaaaatagtcccgatggcaataaaaaccgggactaaaaatattcccggttcaaaaggttagagctacttttttatctttagtcccggtaactaaagattatttttagtcccggttaaaaaaacggcaggcggtgtcaaacccctcctttatctttagtcccggttggtaacatctatttatagtccgggttattaaacaaccgggaaaagagattggcatgcgcggagaggacgaggcgtgcgcgcaagatcaaggaggaggacacgcatggatcagttaataagttatatctccttctactcccttacctttatctcctcttcctctcctctcctcactcaccacatctcttcctcttcctcctctggatccgccccctcccctctcctccccacttctcaggcggcctcgggcggcggcggcctcgcgcggcggatccaggaggggaggcggccgggcggcggcagtggcctcgcgcggagggccccgcccgacggaggcaggcggtggagaccagtgcggctgcacatattttttttttcttttttccttctctgtgttgaatgtgtgattcgatctgtgttgagaatgaactatgttgttgtgaatgattttgagaatgaactatgttgttgtgaatgatttgggatgaactatgttgttgtgaatgatttcagacgatgggcgtgagctatataaaatagaaaaaaaaacttagtcccgattggtgttaccaaagatatcgatctttagtcccagattcgtagtcccggttagaaaatcaggactaaagagggttatcaaccaggagtacaaaccatttctacaccagtgtttataaattttcaaactttcaaaaccttcatatcaaacctatatttaaaatggtaaaatctgatatatcatctctcaaaaacgatcacgctcgcgttcgccaaaaaaaaacgatcacgctcacgaaaacaatcaacttggcaaattcaccttaacgaaatccttgtaaaaaaatattaataatgatgtcggtccaaccggagtgttttcgtaagcctgaaaggaagcatttgaatagtttccatgcatgtatcgcctacctgcccatttaatttgatcatttttgccaacgaacacatcacaggtcaaactgctgcgttgtagtacgctatctaacaaacagaaatccaacgcgcattccgcgttcgcctgcctcccaacatgcatgcattgctctccaaactaaacaaacttgcaatccagaagccaattaaccttctccatctataaatacgcgtacacaagaacaccacttcatcacctcctcacaaagctagctagctccattgttcgatctcatctcccttagctagctactcgatcttaacagtgagcttccattactgagaagctttgtgcattcttagctactaccatggctaggctggctgctctgctcgtctccttagcgatgctcatggcggcggtgacggcagcccgggtagaaagagcgggcgccggcttctacacaccgccaagcccttccacctgcggcctcaagatcggctactaccacgacaagtgcccgcacgccgaggccatcgtcaagggcgtcgtcgccgccgccctccaccgcgaccccggcgtcggcgccggcctcatccgcatgctcttccacgactgcttcgtcgaggtacgtacgtacgtacattcatgtgtacgatatgattgctcgtttctgatcatctttgtggccgcgtgcatgacacttgacacgtctacatcgccattgccgacatgtgggtgcagggatgtgatgcctccgtgctgctcgacccgacgccggccaacccgcagccggagaagctcgccccgccaaacaaccccagcctccgcggcttcgaggtcatcgacgccgccaaggacgccgtcgaggcggcgtgcccgggcgtcgtctcctgcgccgacatcgtcgccttcgccgcgcgcgacgcctccttcttcctcagcgacagcagggtgtccttcgacattccgtcgggacgcctcgacgggcgctactccaacgcgtcgcgcgccctcgacttcctcccgccgccgaccttcaacctcggtcagctcgtcgccaacttcgccgccaaggggctcagcgtcgaggacatggtggtgctctccggcgcccacaccatcggcctctcacactgctcgtccttcgtctccgaccgcctcgccgtcgcctccgacatcgacccgtcgttcgccgctgtcctacgagcccaatgcccggcgagcccgagctcgagcaacgacccgacggtggtgcaggacgtggtgacgcccaacaagctggacaaccagtactacaagaacgtgctcgcgcacagggcgctcttcacctccgacgcgtcgctcctggcgtcgccggcgacggcaaagatggtggtggacaacgccaacatccccgggtggtgggaggacaggttcaagacggccatggtgaagatggccgccgtcgaggtgaagaccggcagcaacggcgaaatcaggagacactgccgggctgtcaattaaccaagttatcaacgttttcatgcttttatatctatatatatgctccttatcagttacatcttgttgttggattccttatacattgatttcgtgtcaaatgtcaaatgtgactttgcgagacgcctgtactatgattgtatcatgtttagttaaaaaaataataatgtttaccaagcaattacatatattgattacttcaaaaaaataacacatatattaatatttctgctctagagtgtcaatttcaacaactatatactccctacatgtatgacatcgttgactttttttatcaatgtttgaccatacgtcttatttaaattttttgtgtaaatataaaaatatttatgtcatggttgaaaaacatttgatgataaattaagtcataataaaataaataataattacataaagtttttgaataagacgaacgttagtcaaaaaaaaatcaacgatgttatacattataatacggagggagcacttctgctagatcaactagattggatgccctcaacattggagcagaatgttctgacgacagcactagattgcagaggaacaatatactacctccgtcccaaaataagtgcagccgtagatatccgtgtccaacgtttgaccgttcgtcttatttgaaaaatttgtgaaaaaaataaaaaaaaaattagtcacacataaagtactattcatgttttatcatctaataacaataaaaatactaatcataaaaaattttcaaataagacgaacgatcaaacgttgaacgtgaatagtgcaaaactgcacttatacactaataaccctactaaaccctgataacaaatataaacctttgtgcaaaagggtagatcaaattcccttaaggggatgtcccttgtttcttccatgccattcaaataattatttttttaagaagaaattgacaacatagatcaatgttgttctaaatttcctcaacaaacgatgttgttctaaatacaaggtgaaatacaatgttgttttttttttatttttttagtttttatttgcgagtttaaacttcggtatctgtcaagtgatatatatcacatattggtctatgttgcccttttttaagaaaaaaaattataactcttttaatggtacgcaagaaacaagggacatcaccttaagaaacaaaatgactttactcgccaacttactacttaacaccaccgcagttcaccgacattgaactgtggagcgagcgcggccgcgggagcgggagtggaaacagatgcttcctagctgtggtggctaatgccaagaaggccaccaccaaacccgaaattagggtaatcgtaccttgtcgccggagcgttgtgggcaatgctgggatggtgatcactaatggaagcttgagcttgagcttcagacggtgccggtgccgccatgtagctctacggccaatcgatagggaagctgggaatggcatgccgcccttcgtaggagtaacgcctaaatgcggggttgtggtgtacagaggagtaattctggttcatcatgctcgcaccgcagtagctgctgctgccactgctcccgtctgactatgtttcttgaggccatggaatggcgcctcctccaggtggaatgacgaaggtgggcaccggcggcgttgcttgtggcggtagatgcaagaacgccaacgccgtagtcaagtatgggacatccagcggtagtgtggcggccatggcttgttgcatctgcattgagtagtctgtgttgaaatttaagggtagatgatcatcgaggagtgtgagctatgtgtccatgaagacatctccttggggatggaggtgcgatggttcttctggcaacggtggcattggcaacgccggtgatctcttctcgagaaggaggtcagcattattctggttggcatttgtagattcctatggaggattgttgcctttcttcttcttcttcttcttcttcttcccctttctctccttgccgcccttcttaacaccggtggagtttttgttctgctcctccgccgatgtattaccttcattgctgccggaatcaggactaggtgctttcctcttcactgccttctcgttgttcttgccgcagttctgcttcttctgtattgtccatagggctggacgaaagcccgtgcctcgttagctcacttggcttgtgcctaactcggctcggctcggctcgactcgatatggttttgtaatgagccgagctgacattttagctcgttacacataacgagccagctcgagccggctcgcgagctgctcacgagcttaacgagctagacaaatagggagtaaaatcagactttagaaaatagcaggccataaccagtggcccatcgcccatcttggtggcatgcccagacggccagaccaaaatatagaatataaaaaaccctagaccggtcaatgcctcatcgattcctctgctctcccatcagtcgtatcctctcttcttcccgatccagatccaaagcgccgcatcgagccgccgcccgtgcgccactccctccaacccacccacgacaccgtcgagtctcccattccggcggcaagcatcgcgctccattccctccatctcgtggcgctgtgttccactccctccatcctacaacgtcgttacttgttccagcgaccagtgtcgaacttgctcgctcgatgcccatggtccatggagtagggagagcaggtagtgcttgtgccgcatgcacacgctgccacgcatccatgtatgtatgcatggatggatggaattatgttgcttgatactatgaatgtgagtttgtgaagaagtctattgcccaatttcttgtttgaatgggggacagccacatccatacgaaggatttttttttatggggcaattgtgttcttgcccttactttctatatcaattgtgattttacccctgtttttttagggtttgtggttttgcccctacttttttgaaatgaagtaaccgtctgcccttggtttcgacggtagttaggtgggcctgtaatttccgaattaaacgaaggaagaaaatggtattgtattttgtgaatgaccatagtacccttgtttcacttagggtcaaccacttgctggaagaccgatttccccaatccaaaaccgtagagcggcggcggcggcgatgcgcgagcacggactaccggcagcgccagcgcgcggcagggaggcgcggcggccccgtgggccagcttccgcggggccagcgcgcggcggagagaagcggggtcctcgcgcgcgggcagggaggcgcgacggcctcgtgcacgcgcagggaggcgcggcggcggccccgcggccagcgcgcagggagg

SEQ ID NO: 19484 - DNA, 16868 bp, Oryza sativa
  unsure (1)..(16868): unsure at all n locations
cggcgatactcctggattgtgctcgatgagtccgtggagacgcatgcagtgtgtttggctgcttgcacagtcctgctatgaattaaacaagttaggcctgcatggttgagggggctgctcctaatttcacttgtaatataaatgttgtcctgatcccgtttgtgatgaaattgcaagtgtcaaaattttgccaaaatatttgttctagttcggctccgatttaaattatttcacaaaatctcagttcaaaataattgtaagtttcatatacaaaataggggtaaaagcactactccctccgttccataatataaggcgcaactatttttttcagatgtttcataatataacgcgtgcatgcatgtatgcaattaattagtacctcttctccattaaattattgttttttaaaatccttcaccctaaagatctctaattgtattgggtgcatgcattttatttattaaggtaatacaaattaggaggtgataataattgtttcttggtgtttggattaagggtagttgtgccttatattttggaatgtagggagtagtaagcaagggtatgtatgtattttcatgtccgacttaacaccgttaaactgtccatccaaaccgggggtaaaactttccttcatttcaaaaaagcaggggcaaaaacacaaaccctaaaaaacaagggggtaaaatcacaattgaacttgaaagtagaggtaagaatgcaatagccccttattttattgtgatatgtgaatatatgatgttataagcattttttttctttgttgttgttttcgaattttatgaattttgtgttgtttttggatttttatgataatatgatttagacagaagagatgttccattgagctcatcatgtttaaagtgctgattgctaaacaaatgttttcagaatatgttcttccctgtctgctatctctgaagtgatgaaatggttgtattagcttacgagctaaacgagctagctcgagccaactcgagctagctggctcgttaacctaccgagccagagcgagccgagccgagccaagctagctcgatatccatccctaattgtccgtagcacccactcatccaactacaatgatcaaacaaagagatgttatatggtctctatcccactgtataaggtgtggtcgtacttggaatgggcgacgataaaactattcttttgacataatttagctttatcatcatattaatgatttgtagcaacaaaatagaaatcgaattcatatatcaatctaatgatattaatgttatcaaataaaatttaacttagtattagattagttgttagtcaaatatttctatttatagagttcaatcttaaaataagtgtgtgtctccttctgtggaacagaggaggcaataaaataggagagtattaaattgacatcttttcatgccaaactatttaattaaacaattgctattgaaacattgttcacaaatttatatactgtcaaaccgcgtgttctcaaaaccaatttgacatttttaaatgtacagactatttgacatttttaaatgtacagactatttttaatatattgtttgggtttgacatattagtaacagaacaaaaacttagaccggccaatttatgaaataaacaatcattttttgtggaattcaaatattttaaaatatctaaaactagacagtgattctactattgtagagtctttggtaaaacacatctctacatctagtcaccaatgagatggagatgtacttgatagtgtggtgataagaggtatgtgattttaaccataagttcatgtatatgttcaatacttaacacgctcacaatttctttttaaaatatttggaggaacgtctctccctccaaatctcgtttttatctatacaccaaaggaatccaatagacgagggtgatcaccaaccttatgggtgtttttgttctggacctcttccaaggatgcaacgctctcgtaactcgtacagtgtccagtcggtcggcttgttgtcatggttggcatagtacacgagcgtcctgacacgggcgaccacctcttcatcttcatcttcttctccggcgccggcggtgtagatgatcccgatagagccggtggccttctagctcccattgggaatccggaccggccgcgtgccaacgttgtacttcttctccctcttggtgaagaagaaccacctgccgtcgccccactccctgtactttgctgcacaattaattttcattaggaccaaagttagtttagaacaagcgaccggcaaattaactcagatcaacccagaagcaaagacatatacacacgtacctatgagaaatctggatagtccatgttatgctgctgctccatgtccgtgagatgatcggggcccatgttgtggatatagtactatgtgagatgatcggggcgttgctcgaggagattgatgaagatgggtagcaacggtggcaggccggcgatcttgtggcggaggaagtgaaggacgaggtcatcgtccgtgggctggaagtggaaagccaggggcagcttcagcgccaacttgttctgagcagagaactccatagtatctacgcatgccgacggaaagctccgatcatctgaatgaatcgggaaagattcttggatctgaagctacgaaactgactctgttccttcttcctgttgtttttatgtgtgtatagaggcagggcttgggaacgtaatggcgatagactttgagaagaaaatttggaagtagagacgcgaactgcagctgcgttgggaaaagccgcttctttttctctttgggaggagacacgttgcgggctttgcagcccaacccaaaaggctaaaatgctggcctttcaccgaaagtgagcccaaaaaaaaaatgcagcagcgaaacaatgccgactcccatcggtgcgcaccgcgcgcccccggttacctccgcaccgccgccgcgctcgccgccgtcgtccagagcctctcgacgagccccggccccggccgcggcccgggtcccagaccctccacgcgcagctactcgagtccggcctccgccccaccgacgacctcttcgttaagctcctcctcctccacctccgatgcggctcccaccacaacgcgcgcgcggtgttcgacggaatgccggcgccgacccacgccgcgcacaactacctcgccgcggggtactcccgcctgggcctccccgaggaggcgctcgggatcgtgaggcggctggcgaggtgcacggggaggctgaacgtgttcgtgctgtcgatggcgctcaagctgtccgcggcgctggcgctgccccgcgcggtgagggaggtccacgcccgcgtggtgaggtcggtcgtcgagtccgatgacgtcctcttcgcggcgctggtggacgcctacgtgaagaacgcgtcgcttcggtacgcgcggcgggtgttcgacgtaatgccggtgcggaccgtggtgtcctcgacggcgttgatcgtcgggtgtatgaacgaagggctgtacgaggacgctgaagagatattcaacacgatggacgagaaggacgtcgtggtgtacaacgccatggtcgaaggctacagcaagacggaggagacggcagagagctcgatggaggtgttcaagtcgatgcatcgggcgaggttccggccgaccgtgtcgacgttcgtgagcgttctcggcgcgtgctcgctcctgtcctcaccggagatcggcgagcaggtgcactgccaggtgatcaagagcagcctctcctccgacatcaaggccgggagcgcgctgctcgacatgtactccaagtgcggccgtgtcgacgacggccggaggatcttcgaccggatggcggagcggaacgtcatcacatggacctcgatgatcgacgggtacggcaagaacggcctctccgacgaggctctccagctgttcgagcagatgctgcggcggcacgacgacgccatccggccgaaccacgccacgttcctgagcgccctgtcggcgtgcgcgcgcgccgggctgctgtcccggggccaggaggtgttccagagcatggagcgcgagcacgcgctgaggccgcggatggagcactacgcgtgcatggtggacctgctcggcaggttcggcagcgtccgccgcgcccacgacttcatcagggggatgccggcgaggcccagctccgacgtgtgggcggcgctgctcggggcggccacgctgcacggggacgtggagacggccggcctcgccgcgagggaggtgttcgagctcagccgcgccgccgggaggcaaaggcccggcgcctacatggcgatgtcgaacacgctcgcggcggccgggaaatgggacggcgtgcgtcaggtccgggagatgatgcggcggcgaggggtactgaaagacgctgcctgcagctgggttggctccgagtgaaagttctccatccttttggatggtgtaatcatgtacattagctaaaacattctataaattttattgtctagtcttcttcctgcaagcaagcaatggcctgctcgtatgtaatattttgagcaggtcgtattcattgtttttgtcgcaaatttctaccgtttcagatgccatagatgcagaatttagctagaactttggtatattgaaattttgactggtaaaagatctcatctctataatgcatttatgcacacaaccaaaaggccggggagtatacaagcatcagacgcgggaatctactgacttcatatctaatacaccagggaataaaatatacaggcactaagaattttacagcatgtcgtagtatcttatgaccgcaattaagctactctgaagaaacgaactgaactccgcctgcatggaacttgcaagcacagtcatcatagacctctgataatttctaccgacagcagtctcctgttactaatctggaaattttgagcaggcggagcaagtcctgggatgtcgcggatgttcttgttatgtgggttgacaatctgttaaaaaaataaaatattgtgattaattgttattcaagttcaatcgtggcatagtaacaacagttagtggtatgatgcctaagaattgcaaaaacgaaatagaagtttgaactcaattggccaaaacaaaagtgccagatatgtcatttgtgtaagcagttggacaagtagcattaacaactaatcataactcggtttatagttaaaaaaatgtttcagagcattgtttcactcctaaagtagtgaaggacaaataagcaatatgctataagaatttttcatcaccaatgaaatttagttgtgtgtttgattggataatccactcataatcctcaggagatggaagtacatagaaaaaacctgaagaacataccttaacaacaataattgcaatcacaccacaaacaatcagaaaaagcaatgccataatgcatttgtcagttgcaacctgcaaggatttcaaatttcaggtactgctggacatgcaaaagcacaagcgcacgcagagggaagagagagggatgggggtacctgacggccaatctctttcaccagctggctagccttctttaacgaaaagtgaacagtatccagctcattgccaattctcttcatttgttctgtctgtaaagcaaaagagatttgttgtactagattgcatactaaacacacaagtataccagattgccaaaacaggcatgtcacaggaaaatcttgtatagtatgtaatgtagaaaaacttacttgctgtgatagcgctgaagcagtttgtgttccagtttcaatagtttgtgccacaacctacaagaaagatgtcctgtaaatttgacatgaaagaacattgacaagagtgagtgtagttcgtaaagcaaccatttttgaacggtcaatagcttgatcagtctgagtcatttgttctcttccagcatccatcagttgttggtttgtcatagctgcaagtttagacaggtgattacataagaactaacagagatatctagctttccatagtgtcattgtcagcgtgataagatcaatgagccagcaaaacccagtaataagatttttagtcttgaaataaattcttttagctcctcttcagtttttgagaaacttgtatcttgcaacctaccaggcaaaattaatcatcgtgaagcgaaaaggtatttatgaattatataacactattgccttcaaatcaaacaagataaataccatgcttcatttgcatttccatatagtggatgctgtaatgttacttaaccaaacagctcaaccatgttcgaaactaattgttttctctactttgttgttcaaaagaaaatctataatatagtctacttgtcattatagtatcaaaagttaagaaatcgatccatcacaatactttgtaatttcatatactctcaacatgattgcaagctctgcatcttatgctcagcaatcataaggcaattattacatttaagaagattattagcatggcattaaccacatttgaaaaagattcacatgattattttcacctgatgctatttggatgttgtcctcggcagcaggttcactacttccagcgcccatatcaaagagctcaaccctcttattattattacctaggctactttgatatctgcaacagatagtttgtgttagcattactagaagtaacaaaagacattacagaagaatattgcaggaggtacggatgttataaacaagagcattttttttcagtttaagaaactgggtttcctcccaatggaattggttatatataatacaacagagactaaactagaggttctgtgaaacatatttattcatcaagagaacttgctgacttacgtcttcctcaaggtgacataggaattcaactctttgatctgtacagttcataagaaacttttacatgagtatgcacagatgggctacaacaaatagcatatcaaagggaggtaccaaccatatattgctttctgtcatttagctgcttgtggacctcaggagggttgtttgactcctcatctttcaatatacgatcaaactctttgatcaaactggaaaggacgttttaaaaacagaatcagtgtatattcaacaaagcggaaactctcgtaaatccaacagattacatcttgttgtctgtttaattgtgaattaaaaataataatattaacaccgtatatcaacaaattatggtctagagggtcatacattatggaaagacttccatgctttcatttaggaataaaagaaagctgaaaggaggagcctatgaataggaaaataacaacagtataggcatcaaaaagaaaacaacaatttcgggatagcagactgaagaacgctcagcttaacctaccgcttgcactccttcatttttgctgtgagatcctccagctgtttagcttgcctacttgaatctttaatcttgtccatcttttgaaatccatttctgcaaaaagaaaaaaaataataggaaaattaaaattccctgcaagatcaagttagcaattaataaggcaggtagtacagaaatatttcaaatgtgaccaatatagattcaaacatatgtcgctatggtccaatgttatcaagagtacaattgactttggaccaactcgtactgtgcaattgttaggcatgctcataaggtcaatacgttagtgcttgaaacttgtcccttgggaaacttgtaactgtttcattggaattaaatacactcaaaataagaatggtttcatcaagaaaatatcatgtcccactgaatgcactaaagtttgttgtttcaagttccgacggtactcttatattttaaatctttagctgccatggcctcccagatgtgaatttgaatttgttgattttaagcatattgatttttggaatgtttgaccgcgcaacctataaagtgccatattaaaaaggatggagtgccctcaagattctgaaaagcagtaaggtagtatctatgtggtcacccaccttgcggaaatcatgtggcctaacaggccacttctgcagcctaactaccaactattcagttacaagttgagtactcattccttatacagccttatagagcccttttttttctttttttgaaaaaaaaagaatactgaattatacatcaggctgtcaaaaatatatgtttgtcggatactcaagcagtccaaaaagttcaatttgcaaggcgcgcatgttatcagacaatttggtatctaaatgttccgaaaacaagtcgaagtatactatcattatccaaattcatttagttaaaatcgttgaaatcgcaccggagcaaacaatctgacgatcgcttgggacagattaggcatccagttggctcaaaacaggagggagtaaagaagatagaaacaacgattgaaccagcgtgggttggcctcagcgcagagttgtgtgtgcgcatattaatagtactactagtaagtactgaacagaagagaagagtaacagtaacagtaacaggggagggagagatgtggctcactggagggcgcggaagatgtcctggacctcgccgtcgatctgctcgagctccgggctcatgggcacgtcgctcgccatggccaaaggcttcctccctcctccgagaccgccgcccccaaaccctactatagtagaactctactccagcggtgaagcaccaaccacgtagcnnnnnnnnnnnnnnnnnnnngccgcggaggggaggaaggagaagccgaacagggattggggattgggaggagaggaggagcctagggcttggctccgagtggtggcgtggcgtattagctggggtttagaatagaatccaatctgccgcaacacacaaagccaagaaacgagaggaaaggggacgggaaaaaaaaaactgaaagaaagaaagaaagcgacgcgctcaagcagcttacggttgacagcgaggactctcaagtcagataacgttgttaaacaacaagaaggtcgcaatctatcagagtgtcaggcccaactacctgctgtgctggctgcttattcttcttctgctgctgcgccaatggcatttttaggcccccattgaatcaaataaaaaaccatataaattatagaggattttatcctataagaaataatcctatagattcctttgaaacaaaggattaaaggattgttcctatgaaatgaatcttactaaagcaattttgaaggaaaataagcatgaggtttcaccatgttttcctcttcatgtgtctaagattccttcctgcgtttttcctgtgtgctaatcaaacaatagtttggagactttattgtgttttaaaatccatagtaatccaataaatatgacattttatttctatgttttttctactcctatgtttttttccaatcctgcgatttaagtgggcccttaatttttctttctttcttctactaattactccgttcctaccgttccattatatgtggtaatattttgagacggagaaaataatcttcttccgtacgaagggttttcacaaacttgcattttaggattttgcctgtctgaaacgtactaaatgactttttagccttgaatagtcagcataattaatatttttggtaacaacaacaatatcccaaatctcaaccttaccctttattttggataatgctcaaccttacccttgaaaacacaagctaaatccattaggcatggaagaaaaagaaaagaaacggttgaggcctttcacagcgctccacggtggatcggtgctacaccctgccacgcatgagtttcgctgaggtggagggggagaccgcacccacgctttgtacctcgtccccacacatagcgacgcagtacctgcccttcgacgcgagcacgcgcggctaggaggaggcgacggcgtgtgcggcggagtgggaggaggcgcggcgagaggagggcgaggcggagagacgagaggaatggctggaatcgtcgaatggatagggtcgaccctcgctctaggaggggtaggtgaggaaaatttctttgcccctcccgtgacctcgcgcattgttgggtaacgcccactgtgggcttggtactcttcatcagtgtctctatgcacataatatatgggtgcttgctctgtggggtgagtatctttgagctgtgactttgggctatgggtatgggccccatagcttgtagtgctattgccctgatatgttagggctattttggaacgtaagaatctaaaattactgaaataggaaaaaaattgtatatcttggtccattgaatcctgcggcagataaaaccataaaattactcaaaatagtagtagatgtttggaatttttgaaagaatttgaaaaaaaatgaggccagacctcatgctagaaatcctctaagggcccctttgatttgtaggaaaaatgtaggaattttggaggatttcaatcctatggaaaaaaatcctatgaaggcctttgagacaaaggattgaatcatatccaatcctttaaaattcctatggaatgggtaatcctatgcacattttggaggaaagttagcaagaggtctaaccttttggaacatttcctctgagtctatctctctcatctgattcctgcgtttttcctgtggtccaatcaaacggccattcctgtgtttttcctgtgttttgcaatcctctgttttacaattgtattcctgtcagaatcctgtgtttttcctattcctctgttttttcattcctacgattcaaaggggccctaaaatatgaagggtttttcctatcctaaggccccctttgaatcgcaggattgagaaaacgtagtaatatgaaaaacataggattttgataggaatgtaagtgtaaaacagaggattgcaaaacgcaggaaaaacacaggaatgaccgtttgattgaaccacaggaaaaacacatgaattggatgagagagatagactcaaaggaaagttagcaagaggttgaaactcttgctaaatttcctccaaaatctctataagattgtccattccataggaatttcaaaggattggataggattcaatcctttgtttcaaatggctttatagaaaattttcctatagaattaaaatcctctaaaattcctatgtttttcctccaaatcaaaggggccctaagaagttcttttgaatcaatcctacaagccaatatatcatatgtaagctggaaaaaaatctcaagaaaaaaaaggaaaggagggatagagtcgggtgtaatgggccatatcttatttttgggctcataaaagaacagtctcaccattgggcctccaatgataaacctcttctatccgttcgattccgttccgtcccggcggcagaaccgctgccactccgtcatgtttgagccggtgagggtgaaacactaaggagatgtttggatgctatactaattttaccactattgaccatacttttatgccatacttacctaagttgtggcttacaaatagtgacccgcaccttagctaacaaaataggattgtgccacactttgttgagttgatgacatatggagccataatggatgagaaggaatcttgccacaagtgtgactatgaacgaaacaatagactaacttggtaaaacttgcctaacatgaggtgcggcaacctctggagtaaaccaaacaacccctaaggtttttttttctttttgaggatgaagcagttaagtttagacgtggttatgtatgttatctatttgatagccgtcatctggtttatttctttgactataaaattcagttgtaaccccaatgatcctattaaatttgaattgttgcagttttgcatttctgctttatggccattcgacaatgaacctatgattttgaggagcttttctccgtttcagtacagccatctgaagggtgtccttgttacaggatacaaaggggccatagagcaacctgaatttcttgcacatatcgcggagctattaactgttgatacagtcgaagcaccgtggaatgatatctttggatacgtcatacgaatcaagcatcagcttagagcaccattttcgtcaaattgcagctagttaccttcatgaaaggctttcacctgcaacaaagctttgtgttgttaatttcttattgtgtttcttaatttcttcttcattggtgcacctgctatgctggacacatggcttcgacaggcttggtgtttctttgggtttttgcccagtcaaaaaaatgactctggataataccactggttagtcttgaacattttgtgggattctaatgatgaacattttgtactccgacactaaactctacaagaaggttacttgatggcaacttaattttgtttttatatttaagctattgttcatagacaaggagactctagagaatgcttttatgctcaaattgtagcatgtttacctgtctataggccagcttgaatttcttgttcgtatcgctgaaattaaaaacacccctgggctggagttatcaactgttgatacacttcaagcaatgtggaatgatgcctttggatataataaatcaaatattagctcagtgcatcaccatgctcgtcaagtcgcagcttaccttcgcaaaagacttgcacctacaataaaacttgtaatcaaatccactttctccgagaccttggatagaggaaaaccagaatgtccacagctaaagtcattctcaacccaagacgctaggcatagtttccataaactccatatcatcaagaaactagtactagaaactaatcttccaatgcaaacgccactattttatacttaaatttaatgctacttatctcacatgatgtcttggatgttatgtataaaccatgtcttattcaagacatggtttccttctctttcctcatttattcacttgctacgtcattttttattctatgtggcaacttatttaatactatggacaccatcctagtcattgggttaggaatgacctaactgcctcctcctcctgctgctgaggcaatggcccttaattttgtactacctccatcctagtttagttgtcactttgactttttctttgtaacatttgactattcgttttatttgaaaaattagtgcaaatataaaaattgataagttatacttagagtattattgataacaaagcaaatcacaaacaaaataaataataatttcatatatttttaataagagaaatgatcaaaagttaaaaaaaaactcaaagtgacaagtattttggaacggaggtagtatctgacaatgaattacctgattatttgctgatttactcaaccatggagtttcacttaatgcctgatgatatttgctttgtttgttctttgagatgtgtattgttgcattggccatataatacttgtccaatttgaactattgcaaattataataactaaaaattgtgtacaagtttaaaaatgtatacccatataattaattttaattctagcaattaatattaaactcgctaaaaccagaagttgacagttgacgctttatgttcaacttatttatataaatgttcctcttctaaatttgtacaaaagatgtactagatatgataaaatagcaataaattacagaaaatagcttaagaattatctaagctaattaattattacgtgttaaatactcaatatacacaacagttatgtcgcgcaaacaccatgcgtcttaaaaacctacatgtatttatccaaataattaacattctgatattacatataaaatataggtcatagttacgtaaatgcgtgacttaacaggctagttttcttgtgcagtttacttgatggccacttattttgttttttttaattaggctgattatttcaaaagaatgttttaagttgaaattgagtaacgagagagctatgtctcgctatgcagacctcggttgtcagccataatcacgaatagcgtcataaaaaaggaatgattagctgcaatgtcaccctcaggaaagaactttatctatctcctgttctgaaagaaatatgaaagtggagcctttttacaatgaaagcactaattttcactatttatgatcatacaagtgtttcagctagctgaggtaagtcaagggtcaatatatatatatatatatatatatatataaattttcattcggtccgtgtccccgaatcttggcaactaatggtacacacgtacgcaggcataatcaaatatagcgttcatgtgagtggccatgtgaagttatagtttggcatcaacttcttcagatgtttaacatgtatcttgtgagcctttcatacatcttcacgataaatcttcaactttgttagttatagaaaatagacaataacagactagctgattattaagcacatgaaggctgttgttaattagcagagttgtaatctgaaatcaactcctagcagtctgaaaaagatgaactgcgtgtcacactactagaaaaagttttttggcagcggccaaaaccgattttttcaggcggaggggaggcccgcctgtagcccaacgattgatgattttcgcagtcggggcaatggcaatggccccgcctgctaaaatgcgttgaaaaagcaaaaaaaaatcgcgggcgctgccgccacgcgccttgttgccgccgccctcccctggccggagccgcgccgggcgtcgtcgtcgtcgccgccgccccacgccgttgtcaccgccaccgcccccggtggcctcctccctccctcctccggccagatctgggagggaggggggaggggagccgccgccaccgcccctgccgacctgcccctccctcctccggccagatctgggagggaggtgggaggggagccgccgcagccgagccgtcgtcgccgccgccgccggtagagggagggaggggagggggcgcccagacgcatgttgaggggaggggaaagtgtttgaggaagagagagagctgagtgagggaaataagtgatggggaggggtggaggagaagataagacttataaatttttggggtaggtaccattttcgcagatgcggtttgagtggtccgcctgcgaaaatgattttcgcaggcgtcgcttaagtggtccgacagcaaacttcatcctgatttatatttttgtaggcggtcatttgactttaagggttatgtctgtctgtggaaatcagacatctacgttgagaaaaatatattttatagtagtgtcaggctgtcagcaacccatgaaatggttaacaaaaggctaagtaatgcgactcgacctaccagaccccaaagtaggttcgtaactcatcagtatactagttagcatctccacgagtatacttgattagcataagataaacaaacctgactgaaatcgagagtcttattaaaaagtactgactgaaatcaacttgtatttttgctcctgctctttataccaacagcgtcacacctcacacgcaaatttacacaaaatttgacaatcgaaggccaattcgaatactcctatctctgaccaaacgcacatcttaaatttggtcacaacagacaactacaactcctttatatatatacaagtccaatgcaaaagatccatgtagttaagctgcgtaagtagagtgctcattccgtctcataatacaagagattgcactgtttaaccactcgttttatttaaaaaattttagaattattatttatttttttacttactttattatccaaagtattttaagcacaattttttgttttttatatttgcataattttttttaaataagacgagcgatcaaagagtacaaataaaaaatcaaaatcccttaaatcatgggacggagggagcatatgttaagctggtaatgatctgatcaaaaaaatctatgcgtcgtcaaaattgatcgaatcgagagttcgtttgcaaaggcgacaggaagatacacacgctttgatgcatgcatgtccgtgtaaagatggtgttcttttttttttttatgacacgacacggacaagtgacgtggcgatcccttgtccccaccgatgggggaaaacaagcagctgcatccaccgttttggaccggctggggccggccaagtcgatccggcgtggcccatccatccgtccgagtcatcccgcaaaatccatcccccaacaagtggcagatggtgtgcatgcatcttcactcacacactctctacaaatgtctacatcgtcgatcaacttaaagtgaaacaaaattaccggagcatttatatgtgcttaattatggcatgtgctcggaagataaggttaggaatttcttcttcaatacataaagtggggtagctaattagcacatatttaattaagaatagttacgaaatgaatcaatacgattttaaattacttttctaacttctttttcttttacaaaacacactgtttagtttcctacaatcacacgatccagcagccacagagccagacatcatggagattatcccaaagacccacgcacgattcgccacgtcgacggtgaccccacctgtcagagacaccggcgccccccgctagattccttcctcaaacgtcccgtcgcggcggcatcgcataccacggggaccacgcgcaccccctactgtagtctgtaccctacgccatcccaggaatccgcgccctgggccccaccaccctccccccgctgacgaggtggggcccaccgccaccgcgctcttctagtagcccaaagctcctcccccgctgctgcttcttccacgcgctcacgcggctcccgttttcgcggctgcgttttctcgctttcgccgcagctcctcccttcgtcgtccgtacgacgccggccggccgatgcgccgccggtccaggggcgccgcggggtggtgctgttgtcggtagggagggagtgggggtgggtgg

SEQ ID NO: 19485 - DNA, 12744 bp, Oryza sativa
cggtacatgatggagttcggggcgcgccccacggagaggaacctgctgcggtcggcgcagttcctgcgcagggagctccccatccgcatcgcccgccgcgcgctcgacctcgactccctccccttcggcctctccaccaagcccgccatcctcaaggtgaccacccccctcctctcttttctttccccaccagagaggatgagaggaggatgaggagtgctccaccgctttgcgtttctctctagatttgggccaaccagtgcctcgacttttcgggaagattttttttttttgctctccttttggagaaatccgatttgggactgggattttctatgaagttcttttttttcccatttgctaaaagtagtagtactagctttctagtaggagtattggttaatctactgggatgtttatttgcgaccatttttaaaaataaaaactgttctgttaggatttagtgatatgttcttccaactcgattgttaaaattttaataaattatcaccccgctccattcctctttttggtgagttttttttggaggaggaacgggagagatggccagtgttgagacggcctcatttgttggggaataacaaattaaattggtccttctaaattatagtagtatctgttttttttacggaaaaccaaattttatctgttgtgttgctttcgtttaattacgcagatttttgtgagtggtgaccgtcaattctcgactaacactgtagagtagtttaaatgtcacactctttcatatcattcgcttgaaataacatcaccgaaatcttcttgttcaatcccagccagcttttcaaattttgctaaattttccatttgtttggtcgtttcagttcttcggaagtagtgtagcacagctgtgttttaggactagaggaatttgttaggttccttctcgccaacttgcttaaatcgctagtgtctttttttaaaagacgcattgactcctcgaaattatcagctcggccaatctaaaggccctgaacttgtcaaattgtaaattttctaggaggatttgcaaagttgagtcattatgttcttgccagggaaagatccatttgcaggactaacttttggtctttctccactgtgaaggtgagagattggtatttggactcattccgcgacttacggtgcttcccggaggtgaggaaccgggatgatgagcttgcattcaccgagatgatcaagatgattcgagtgcggcacaacaatgtggtgcccaccatggcgttgggtgtgcggcagctgaagaaagacctgggtggcacaaaggcctttccccctggcattgatgagatccatcagttcctcgaccgcttctacatgtcaaggattgggatccgcatgctgataggttagcagattccgcatgaagtatttattaaatgatgatggaaatggaatctatctactaatataatggccttacttttaggccattgatattccttggcccttgcctgctggataaaactggctaaaagccttgtcagcacttaacaatctggaaaatatagtttttctttgcacatgaatattttatttattttggtataacatgttggctatattagagcagcaatagctgtaatgtccaatcaggatgtctttttcctcagaatgtggtgattagaggatactcaatcatatcgttctagcttcttgtccagaaactaaagttaccacagagcagctatcaaccatttacggttacatgtcaataagaataatccttttttactttatttatgaatggaagaaattgtttttctttttttgatgtgaaagtgatgctaacataacaaataagtgacaattgctactgcacttttttttactgagttgtactaacttgcttgatttcagggcagcatgttgctttgcatgagcctgatccagaacctggtgttattggactcataagcaaaagattatcccccatgctggtggctcaacatgctactgaagatgcacgtgctatttgcatgagggaatatggatcagcccctgatgtgaacatatatggagacccagatttcacatttccgtaaatccctgatttaaatacttgctacatgtttttgtttaatttgatttaatagcacttcattgttagttcttctttgctattagaaatatttgttggccacctagtttctgttgtcatttaaatcttccatgacttctacgcaattgtcaactaagctgctctgcttactagtccatgcacaaatcacattttttggccttatttctgtttgtcagaaaccactctagctgaacaacctctatactgaattttaatcagaatatggctgaaggacaggaagtattaaaacagttgtcctgaactgctttgccttcttgatttcagatatgttaaactacatctacaactgatgatgtttgaattggtgaagaattccctccgtgcagtacaggaacgatatatgaactctgataagcatgcgcctcctgttagaatcatagtcgctgatggagcagaggacgtaacaatcaaggtatgactccttccccaagaattatgctgactttgaagtgttttctggactcaaatcatgctagcagatatcagttttcgcaatttttattgatgtgtaaacaatacacagtagtgattagaaattctgagctatttttaaatatggttttgagtttatttaaatagtatggtggtcactttggtcttgcagtttctgtttaaagaaagactggtgttgcaatagcatagcaagttctgctgcattttctaaagtgatcgttattctgtgctgatagtaataaggtcattactgttacagaaaattgggtcagtttttatgtgaaagcatcacccatttctccctttatttttcatgttcttctctctttcctagtttctccgcgtatgatagctttgttgtgactttttatatagatagttcttatgtatatgagattacaaaaagatattacgggtttatctatctttgatagtttaattatttgcagttacccaatgtatttattataggtacgcctatttcagttagaacctttttggtgcagattagtgatgaaggtggtggaatacccagaagtggtctctcgagaattttcacatatctctacagcacagcagaaaacccacctgatctggatggccgtaacgaaggagtgaccatggccgggtacggctatgggatcccgattagccgtctttatgctcgatattttggcggggacctgcagatcatttctatggaaggatatggtatgtccacagttcactttctatgtcctgtgaattgaagctcttcttttttatatggtaaagaagagtaatggccaaaagcccaaaacccttgggatttggaggctttcatctaccatgcgttctctctctataatcttcataaactgctgtgagaacttaccactcatgaaacatgatgcagatgttatactatcatcataattttgcataaacaagacagtttcatcatctaattgactgtcattacctcttttgtgtaggaaccgatgcttacctccacctatcacggctaggagattcggaggagcccttgcattaggagatctggaggaggaaaccctttgcctcagttctgataccactgctgtaattaggatgctattgcttttaccattgctgtgctggtatgcaaatacatagttcccaaggccagccagctctatgtgcttccagtttgctggagcgtgatcataattcagatttcagaatcccctctggttcacattgccattagaactcgttatccctcgccctcggtggctgcctgaaaaatgtgatgtacagttgtccgttttcggagttctgcatggggagtatcttttttttcagagttctgcttctgcgatttgggtaagcaaggatattgttagaaaaaaggaatttcttgttttgctcagataaaaaaaaatcgggggctgctagctcccaagtaaagtaacagcctgacatcttcggaccttaccttcctatcgcggcagccggtagccatgtgttcggcagtgaatgtttctactacggcaaattttgctacaggacatcgcgactttgtggttttagctgtaggacactgcacgtagtcacttttagaaaaagacactcaaaatgtggttatttgccaagggacaaaatgtggttatattttgtttatgcaataaaatattaatttctggttcaatagaagagataaacagtgtaaaaggtcaaaaatgccctcgggcccacttgtcatattcttcccccaccccaaacctccctccttgcctcctttacccccaccggcgacaacatccttaccccacccacggccacgagcaacgagctcggcactgggatgggcggccaacttggcgcagggggaggcggcgtgcgccgacagcgcccacggcggcggcctcgccgtagctttgccacgaatcgaactcacggggtcgagatgaagaagcggaagaggcgcggcagtggcacctccgccgactttgaccggagcgtcttcctcatcctgctcgccaccgccgccgtcggacagcgctaaccagtgaccccgagcagcctccgccaccgcttgtcgccgtcccaccgccccaagctgcgtccgccccccggcgctgtccaacgccctcctcagcgccgcccaccgccgccgcatcacgcgacgccctcgtcggcaccgcccgtccccgcgcgccaccgcccacgcccgtcaccatcccgccgcccgccgctgctgcatcacgcgacgccctcgtcggcgccgcccgtccccgcgcgccgccgtcttccgcgtgtgcctgcgcgccgccgccgcccacgcccgtcgccatcccgccgcatcacacgacgcccttgtcggcgccgtccgtccccgcgcgcccccgcccacgcctgtccccacgcgccgccgtcttccgcgtgtgcccgcgcgccgccgcccatcgcccacgcgccgccgcccacgcccgtccccacgcgccgctgcaacgcctcagtagcgacctcgctgttaaaggaggaagagaaagagagaagagggcaatttggtcatgccacttaaaaaagtaggcccctttctcgcttagtcagcacaaaaatattaatttaatgaatggagtgtcccctggcaaataaccacattttgagagtgtctttccccaaaagtgactccatccggtgttccacagctaaaaccaaaaagtccccatgccctgtagcaaaatttgccctactacttatcgttatctgtactcacgctttcaagctagtattaagagcaggtacaatagcagattattagccagctataaacatattttaatgagataaaagatgagagagaagagtaacaggctacagatttatagccagctgcaccgcggactccaagaggcaatgtgtgtataacaggtgggaccatgtattaatagtatagtaagcaactattgtatgaattggctatagatgaattggagctagtagtgggctatactattaaacttgctctaagggggtgtttaggtgcatgggtgtaaagttttggcgtgtcacatcgaatatacggatacacatttgaagtattaaatatagactaataacaaaacaaattacaggttccgtctgtaaactacgagacaaatttactaatcctaattaatccgacattagcaaatgtttactgtaacaacacattgtcaaatcatgtagcaattaggtttaaaagattcgtctcgcaatttatacgcaatttgtgtgattagtttttttcatttatatttaatactctatgaatgtgttcaaacatttgatgtgacatggtgaaaaattttgccagaggatctaaacatgccctaaacaaaaattatataggaaagttgtttaaaacaatcatattaattcatttctagaggtctttttatctgaagttacttaaccatgtgtcaatctgtcgctctattttatgtgtacgaagggttagtttccaatccatactgaagaacacagttatggatgcatttttagtcaaagcatatgtatcctttgttggcacactgacaacatgcatgcgctctaaaataccagcgtaggtcaagagttacacatggactctatccaatagcattatcacggttttatgtccaaccattattctagtagaatacatatattcaacacgaactatctccttagatcgtctataaaaaccgcctattcataattgtaactgtactcaaatttgatgaataaatttccactacatatctctcatgtaatacaatgaatttactataattaagttttatcacttatttattgtcggtagcacaatgtcaaagttttcggttactgatcattcaaacagtacaacagttgtattaatgttacactattcaaatctcccgccatgagtcaagtagtggatgagtaaatgacaacgtcaagcctgaacaacaaagagtattccttcttcgccagcaacattttacaagtattttcgttctacaacaacagatatactgagcctgggtacgcaaccacttgattagcacggaagccggccctgtcactgaagccgccaagttaccttgacacaactcatataggtgaagatcagtaaaacactagaacatagcagtgggcctgtttagaagaatttaagattctaaaagtaattggttggtaaccagtttttaagaatttaaaaaagctgagtttcccagcttctgactactagtttattttatggattctacaactacaccaataaaaaagtcacaacaaagctatcatacacgaagaaactaggagagagagaagaacatgaaacataaagggagaaatgggtgatgatttcacataaaaactacagcttctagaagttaaacggtttagtgagcatctaattatagaagaagctgcggtaactagaaactcccccggacagaccctgtgtctttgcgtagccgtgcccttatcgatttcttagtggggaagagttgatatgatccattcatcttccatcggacggcctacatcgactacagtacaggctcacctgtctccgactccgattccttctccgcggcggacagcgccggcgcaccaataaaaagaggccccacccggctggacgacgccttccggttttcccctcccccgcctgtctccggcgccggcgaaaccctaaccccggcagccacggcttgccacccgaggcaatgggggatcgcgcggcggcggcggcggaggcgaagacgtcggtgtggtgggacatcgacaggtgcggggttcccccgggctgccgcgacccgcaccgcgtcgcccacggcgtcatcgctgcgctcgccgccgcggggtgcgcgggccccgtctcgatcttcgcctacggcgacgccgcccgcgttgccccgacagtcctggccgccctctcctccaccggcatctccctcaaccacgtccccgccggtatgaatgctctctttccgtcaaatatagcagcatctgcacttgctcactgcgcgctactggtgtgaaatccgcatcatatttagaaggctattgatttttccacctccaataatttgcaggagctaaggatggaaccgacaagaagatgctcgtcgacatgctcttctgggcattcgacaacccgccgccgggcaattacttgcttatttcgggcgatcaggacttctccgacctgcttcacaggctcaggatgaagcgatacggtatcttgctggcgcagccctcaaatgtgtcatctcgagtgcttgctgcggcggcgaggactgtctggtcttgggaaaaacttgtggctggagagtctctgttggtagagtccacacatacgcatggattgccggattgcaatcctaaattaaatagcttggatgtatcgaagtgctcgcagaataagagcttggatgcgtcgaagtgttcgcagaataagagcttggatggatcgaagtgctcgcagagtaagagcttggatggatcgaagtgctcgaatagtaaagttcatgctgtgtgtggtaacggtgacagtaatgtgaaggcatgtgatcggtataaggtgaagcctcttcaaaagtatgtaaagaagactaatgcagtatcgagttccacaaataaccaaggtcaagtagtcgtggtcgatggattttctgatgattctgcaggaagcactggtagtgagcaagataagagttctgtttcgtcatcgtcatcaagttctgaatcattggaggtcgatctcccaagtctgctaggaactcctcctttggctgacctcccaagtctgctaggaactcctcctttggcacagtcatcagctcaggagcctgtggtgtctactagttctcaacaagttggaccattgaacatgacaggtaagaaacctagcacatcagtcaaatttgtaccaagaaagggaactgttgatcttggtctcagtaaacatcatcaccaaatgtttatgcaatcacaatcgtctgaagtaaagagtaagcttcattctgagtatgatatagctgaaaagaatgcaaagaagggtaaccaaagcaagtcaaatccaattcaaaggtatgtaaagaagacaaatattacatctagtcctgctagcaatcagcttgattcagatggaatgcctgagtgttccacggggaacactccaagtaaattgaatcagttgcctgtcttaccaccaccaaactctgaatcactggaggaaacaaaggtggatcactcgagatcgctaggtatttttaccttgccccagtcatcatctcaagcaccagtgctgtctactcatttgcataaagtggaagaaccacatgaactgattgttggcaagcagccctcttgcacatcaactgagctcgcatcaagagatggaaccaatgattctcgtgttagtattggacattatcattcaacctctatgcaatcccaatcttctctggcacaacatacgcttcattgtaactataatatgggtgataaggttggcaaggcaaaggcaagaaatcagcataaggtgacacagcgtcaacaatatataaagaaggcaaatattgtatctagttctgcacacaatgaaatagatttggttaaaggattttctggtaattctaaaggaagcatcttgagcaatccaagtaaatctgtgttaacatcgtcaatttctgaatctctggaggaggcaaaagcgaattgttcaactccgctgaaaaatcctcccttctccctgtcatcagttaataaacctgtcacacctactgatttgcagcacctgggatcagagttcatctttggtagtaatcatagcttatcaactgaatgcatgccaaaagatgggattttttattttggtgacattaatggtcagaatagtccagcatgtcagcaagcccattcttctcttttgccagaaatacataaatcaattcctcctagtgcagctggccattctaactcagtaaattcagatgttggcagctcatacccaacatcaactgggtttaatggtgttccttctgctcaaatacaaacatcgccaagcggcttaacctttcaaaacatgcttgatatttgctctgatttcagtagattgactatttctgagtgccctccaggaacaagtgagaaaaggccaccttttcaaggtattccttctaactatactgcttttggtatgccaaatacttctggacatcttagagttcctcatgagatcggatccactttccatcctggttctgtcgtcagcttccatccgagtcactctagtgctcgtcagtgtgcccgatctccttcctgcaacatgcaaaacactggcgatcatggagagacggaaggctctccaccaagttcttctgagcctgaagttactataagaaatatattacatgctttgcacatactgaaggctgagaagatattcccaacggaatcaaatattgcagactgtatacgttacagcgagatgaatatatcaggttttgatgttaagaaggctcttgagcttgccattcgacatcaagccgttatcatgaagaagttagtaaatgacatgccattgtttgttgcgaaagatgaaagcatttggaaatgcgtcaatgtgacaaatagcaatgcaaagcattcgaaggagacactagatgcggttcataagtacatatcatccactgatggttggtcagcaatgaagaattctcagtcaaggtgaggctttttaaaatccattcattcttttttgtgttgatcatttcatcttctgttctttgacacgccattacatgttctccctttattggtaggtaccaagctgcgactattttaaagaaatcgtgcttgcagcaacatgcccttggtgatgtcctccagattttgcaaattataattgtaaggaagaaatggcttttgcctcattcttcaggttggcagccgttgtccataaacacaacagtagttgatgcaactgctgtcgctgttggagaagctagatcttgattatgttctctgctgatgttggagggatgttttggtgcgctggtgaatggcgactacaaaatatcttcagcatctgcgttggtctgaaggttatctgaatgccgcaataatagtcaatctaaattctacggtaagcagttgggcggcaccagaagctgtcaagactttactagtcccttatgggaagattatgccccagatcaatggactgtgaagatgctggttttgcagcaattcagctatcaaattggttctatgtcatcagcaagatacacagtacaagagagagcttgtctctcttcctagttgtgtaggattaactcctagttgtatagaatttcctcctagttgtatagaagtgcctgggggcttagaagacgattggaaaaggcttatctgttactacgtggttgcagaactacattactgccctgatcttcagtgatgtggcagcccttggattagcaaaactccagtggttctattcccaggaactggtgccctcttagcttgatggtaagcatctgaaacgcacccagagcagctgcaaagactgcgaccgcaaagaagccagatcggtaacttgggtggatgtttcagttctcatcttgctttcacttctcttttgatgagtcctgtcatgtggtactaggtgttgggtgtgcaacttgtcatatggtgttgcaactgttcaaatgtacttcaccttttttttcgtcagtttctcgcataaataatgtcagtatccggggctttgtttggtgctttttgtgttctgatcgatgcaactctctgtaactgtactcctttctgtctgtagcaatcactattctctctacacatcacatcatcatcatatcataattcacagaggcatttcaagatgttccattccatgtgcagtgcagcactaactgatgaggaccaggcaactaattaaattttgcacaaaacagaaaagctttttgatgattctgataactcaattatttattcatactactaattcttatgtgacagaagcagagaatgtgagggagactgatgaatatttagcgacctgaatcagaatcacacaaggaataatcataataatacccctactgtcccaacccctcctgctaatcctatctgcaaaacaaacaccttcatcttccttccctgtcaggctaagcgacaatgtactatgaggtgctgacgtcactgcgtcgccggcggcgtggacttgagctcctccagcgccgtcctcacctggtcctgcagcaggtcgatgcgccggaggtacacctccagctccaggatccgctgctgcctccacctctcccctttcatcgggatccccggcgccggcggctccagcgacggcggcgccatcccggcggtgagcatggcgcgcaccatctccttgaacagcggcgccaggatgccgccctacgcgttcgccgccgacgacgccgccggcgaggcgggatccacgccgtggacgtgcgcggtggcggtgaccgccgcgccctgcgggaagaagtgcgggagcgcgtcctccgccttgacgggcgccggcgcgggagccggtgggtaaggctgcggcggctcggatgcgtctgcggcggtggcggtggcggcggcggcggcggccgtgcgcctgcggcggccgcggcgctgctgcgctcttgtggaggaaggggacctgacctccccgttggccggggcaggaacggcgacggcggcggcggcgttcgggagcgcgtcgtcgtcggagtcggcgtcgcggccgtgcttgtcggaggtggggcgccagatgccgcgggcgatctcgaagatggcctgctcgtgcggcgagcggaaggagaaggactggccggtggcgcggaggcggtcgacgcagttgcggtacttgcgcttgaggcggcggagcttctcgacgagcctggctcttggagaagtcgagctggaggcgccgccgcatgtcctcgtagaacgggtccgtgtcgtactggtgcgacgcgaacgccgtcccgcgctgcgccgtgaactccgcgaacgctcgcaggatcacgatctggtccttctccgtccacagccgctggaacagcggccgtcgctccccgcccgaccccgaccccgcgccaccgtcggcggccggacccgcc

SEQ ID NO: 19486 - DNA, 15346 bp, Oryza sativa
  unsure (1)..(15346): unsure at all n locations
tttgggttgttccgtgctttcacgtgaccaagaaagacgcacccaagggggggaaaaatcgtaggcacctggtcatgttctcatcggaatgatctccaccctccacgtcacatagcacaaatcttggagcaaacttccctaaaattaggtgtttgtttagggttttcaaaaacttggttttgatttgttctgctgtgggctcaatcaaaactatgatgttcagccaaaacaaaattttggttcatatccatattcgtagtattaagatgtattgtgtttgtttcttagtgatacagagagtagtacctactatttaaaatttttatgaaatgcacaaatttttcaggattttcacatgaacaagttcaattccttcattctaaaggatgccttatcttatactattacactcacacaaatttaaacttttatgagaacactatcttttcaactctatattttctatattgagaccaaaccaattctagaacctccaaaatgacttggcattatcaaaatatttgatagatcatcgaccatgaagcctcaaaaagacttcaaccttgtcaccaaaacctttttacagtcccatcctagatcctaaatatatctatgtccttgttcactcattggctccccagggcatatgggctttatttttaccaacaaacgctatacatataaaattatgttgtattcatataaaaaggtattggagaaacaatctattaactaaattggtatttcaattactcaaactagaaaggaaataagtcaaccgtcatttgcctatgttgacacatcgatgtgggaggccatgtgcgaggcaacatcttttgggcatcaatgtaaggtggtgtatcaacattgtaagcaaggagcggtgatatgagattagcggcgccgatttcgcaaagtgttgttagtgacttcggcgtgcacgtgagtgagatagcattggcagttggatacttagtcaacaactatgatttgagggctgagtcaccgaggcgcagtaggagataaaagtttgtgattgtggagaaggagtagagatgccaacgacggtaatagtatgttgatatagaaggattggataaaaggactaaagagaggaagatgcaagtagcggcaccgaatcttatataccgaattcaaggttggaaatcaggcatatgattggaccacgtggcatcttgagaatttgggttcagctcctctaaaaatatgccacgtgtcccatcgtcaccctcatccacctcttcttctcccctcccctcctatccggtgccttgcccactcccccgacgcttgcacgcactgctgcctcctccctcctcgggttctcctcactgcttgcttgtcattgtttctccgttccctcctctcatttctctgtaccaccatcgattattccttcctatctctagcgttgtcccaaaacccccctccctctgcccatgtcgccttcctcaccccctgtcctcctcacccttgtaatcgcccccatgctccccacccgcgcccaccaaggaggtctaccccatgccaccaacccattctccaaagccgagcccaaccgatgctcctccagcggcggttgtaacgacgccgagcgcagtttgtactgctcccgcttgggagaggacgagactgggagctgcactgcgaggacggtggtagggagcaccaagatcggaatgatgggaaggagaaagagaacaaaaggaggagagggagaggagcagccgcgttcacaccttctacccaagctcctcctcctcctccttgccaccattggcatccgccccgccgcaccggtcgtagatgcacggccacctcccgaacaccgtatctccggtgccgctgctccgtgctgtgagcctctacagtgaggcttgggcgggcaagggattcctccataccatctgcttccaccagtgccgatccaccaccagatccatacgctaccacctgtccacctcgacatggaggcattgtagtttatttgaagcagtcgcatgtagcaaggcatggcactggacatatttatataagataataacaaatatggatattaggacctccaaaccaattctcgaatctccaaaatgacttggcattatcaaatatttgatagatcaatcccgaagcctttaaaaagactgcaaccttgccaccaaaacccatttttagtcccatcctagatactacctctgtccctaaatatttgacgccgttgactttttagcacatgtttgaccgttcgtcttattcaaaaacttttgtgaaatatctacccctatatgtatatataaaagatatttaacaatgaatcaaatgataggaaaagaattaataattacttaattttttttgaataagacgaacggtcaaacatgtttaaaaaagtcaacggcgtcaaatatttagggacgtagggagtatatccttgttcactcattgggccctgaggacatatgggcttttatttttacaacaaactctatatgtacatataaagtttgttgtaaaaattcagtactaaccatataaaaaggtattggagaaacaatatattaactaagttgacatttcaattactcaaactagaaaggaaataagtcaaaagccctttgcctatgttgacacatcaatatgggaggccatgtgcgaggcaacatcttttgggggcatcaatgtaaggtaatgtatcaatattgtaagcaaggagtggtgctatgaaattagcaacgtcgattttgaaaaggtgttgttagcagcttcggtgtggatgtgggtgagatggtattggcagttggataatgagtcaacggttataatttgggggcagagtcaccgaggcacggtaggagacaaaagtttacgatgatggcgaaggagtagagatacccgatgatggtaatagtatgtagatatagaaggattagataaaaggactagggagagggagctgagagtagcggcactcaatagtgcagtgaagttggggtgtagtggactagtttgtgaattttttctatataaactattctttggtcttatagtgagtaacttacaaaactcaaaactagttaacggaaacgttgattgctctgcctgtccttgaccattctgctagaagctctgcgacaaataaatttcgcaaatctaaggtgctagtaggtgaatgtgtagcggaaagtttgaatatatggacctgtttggtacggctctaacagttgaatctagagtggagttgtggagttgagttgaaaccgtttggttaggctccaactctataagagatgaattggagttggagctatgtcaaacaagtcctatgtttgatgcaaattttatgttttgggaaaacaaagatataattaacatgtttcaaatttgcacagagcatgcattttctttggttataataagttgcatttcactgttgcagactagcagatagtagaaaacaaatgcgcaaaagcatacatttcactgtttcaaaaggttcctttcaggtctggtgcatcggcatcagtctctcggtgcataacacgccttgccatgctaagtgtcgagcaaccatatattaggcatgcattgccaatccaattcccacaattaagtgttcttaactcacaaactaaccacacttttttaccggagattatgatacagcagagtagccgatcgaagtttcgaaccaatgcccacagttcatcactattcccttctccatgaacacacgacctgcagcagcaagccagcacacacgttgctgccccaactccaactctgcaacaagaaacaactcacgctgtcactcacgcacgcatatcttccaaacaaagcaagcgaaaacctgcagccctctcttcacctccgcatgacatgcccaagcaagcaagcgtttgctcaccacaaaaaaatgagatggccgatcgagcaatgcagagcacgccccgatctagtaatcttagtcccagcttaaagcatgcaaaaagcccttgagatttcgatcggtatccacatcaccccaggacaagagtgcaagcaaaccaaccccagaaaaaccccaaaattaatccttccaagcaaccctctcaattactccccggacatcacctctaatccaaatagagtaatataattaaccccgcaaatatatattctcatgcaccaagcaaccacacgtacacctatataaatcatcacactcccagcattcaatctactcacacacacacgcaccaagaaagccaagaaccgatcagctttggtgttcgatcgatcaagacgaggcggcggcggggctgatcgagatggcggcgccgccggcgaggtcggtgagcgtggcggacagggcgctgcgaggggtggcggacctgatcaagctgctgccgagcggcacggtgttcctcttccagtttctcagcccgctcgtcaccaacaacggccactgcgccgncgcctacagcagggtcctcagcgccgccctcctcgcgctctgcggcgccttatgcgccttctcctccttcaccgacagctacgtcggctccgacggccgcgtctactacggcgtcgtcaccgccagggggctccgcacgttcgccgccgacccggacgccgccgcgcgggacctgtccgggtacaggctccgcgccggggacttagtccacgccgcgctctcgctcctcgttttcgccaccatcgccctcctcgacgccgacaccgtggcgtgcctctacccggcgctcgaggtcagcgagcgcaccatgatggccgtgctcccacccgtcgtcggcggcgtcgccagctacgccttcatggtgttccccaacaaccgccatggcatcggctaccagcccacccgcgccaccgaggacttcgagcacaagcactagatcgtcgtcgacgacgacgactaaattattaattaatttgggtgttttaattaattgatttcgaattcatcaaatcttaatttaaacattttatgtgtgtgcgtgcgtgcgtgcgtgcgtgtgttttgcaatgtcagggtttggtcctttggatttggagactcgagtcaaagtgtgaagtggctctgtgtacatgtgtgttcgattgtttttcatgtaatttgatactaggagctaccgctgaacataataaagtctacaattgtactgtttttttttaaaaaaaaattcactgtgcttcaacagaaaatttcgtatttgcttgtaaattgtggcaactcgatcgtgaggtttgcttctactcaacagcctgaaattctaatagctctcatctgtcgccgtcgattcgtgaccactgccgacccatctcgacctaattacgtactctatttagcacacatgactcttgtctttgtgttcatctttctcgctctacttatatatacatatacatatacataaacatatacatattttgttctgcttttgtagttttgtgcatgatattatttcgttcgtgttcgttgctgccacgccacaaccattccgatgtattgccgatacataataacaatcttttcaaaacctgagacatctcaaaaccttaatggcttgtttggcaacttgagggaaggggattgggagtttatacgagggaattgacggtgagattaagatgggaatttgatttttcatcccagtctcttgtttggtagaggtggtggaaattgataggaagtttagttggagattaagtcattaatgaaaacggatggctgagatttgtttagacgaagtaaaggaggaattccctcccaattaccaccccctacccaggtattgaaaaggagggagttcattctcaattccctatccccatcccaccaaaattcacatatctcccaaccaaacaaaacagttaatagcctcatccctctaaactcccaatcccttctaaaaacttcccccaaccaaacgggctgtaaatccttttcacacattcggaatatgacaacccagtttccaattcgaagtttttaaaaaatcttctcaaacaaactcaaacatattgggttgttacgttgggccccggcccacagaaaaagcccagtaggcggggcccagctccagcccacaatacctcgccactaaaccctctttcccctctaaaaccctccttctttctcctcccccttccgccgcgccattcgcctcccgcgaaaaccctagccgccgccgccgccgccgctggccaaaatgtccacgccaccggcgggcggcggcggcttcccggccaccgaccaaggcaagaccaagtcgaagaagaagagcaagaagcatcaggaggacacctcctcctccctggccgtcgccgcggcgtccgtggatgaggcggcggaggccaaggccgacggctacctgatcaagccgcagtcggtggcgccgccgctggacacgtcggcgtggccgctcctcctcaagaactacgaccgcctcaacgtccgcaccggccactacaccccgctccccgccggccactccccgctcaagcggcccatcgccgagtacctccgctacggcgtcatcaacctcgacaagccgtcgaacccttcctcgcacgaggtcgtcgcctggatcaagcgcctcctccgcgtcgagaagaccggccacagcggcacccttgaccccaaggtcaccggcaacctcatcgtttgcgtcgaccgcgccacccgcctcgtcaagtcccagcagggcgccggcaaggagtacgtctgcgtcgcgcgcttccacgccgccgtgcccgacaccgcccgcgtcgcgcgcgcgctcgaggcgctcacgggcgccgtcttccagcggcccccgctcatctccgccgtcaagcggcagctccgggtccgcaccatctacgagagcaagctcctcgagcacgacgccgaccgccacctcgccgtgttctggatctcctgcgaggccggcacctacgtgcggacgctctgcgttcacctcggcctgctgctcggcgtcggcgcgcatatgcaggagctccgccgtgtccggtcggggatcctcggcgagaccgacaacatggtgacgatgcacgatgtcatgcacgcgaggtgggcgatggacaacttcaacgatgagtcctacctgcggcgcatcgtcatgccgctgaaggtcctgctcactagctacaagaggcttgttgtgaaggattctgctgtgaatgctatatgctatggtgcgaagctcatgatccttgggttgcttcgattcgagaatgagattaaagtaggggagaaggtggttctcatgacaaccaagggggaagcgattgcgatcggcattgcggagatgaccacggctgttatggcgacttgtgaccatggagcggttgccaagattaagagggtggtgatggatagggacacatacccgaggaagtgggggcttgggcctgtggcgcttaagaagaaaaagatggttgctgaagggcttcttgacaagcatgggaagccaaatgaaaagacaccaagtgagtggcttcgcaatgccgtgcttccagctggtggtgatgcaatgattgccggcattgctgcagcacctgagccagagaagccaaaggtgaaagaggaggcagatgtggctgaagagaccaaggagaagaaaaagaagaagcataaggactgggcaggtgacaatgctgatgaggggaggaagaggaaggttggagatgatgatctctctgcttctgtgagtgcgaagaagattaaggttgaggaagaggctgatgcagtggaaggggaaaagagtgagaagaagaagaagaaaaagaaggacaaggctgaatcggcatatgccgatggagaggtgaaggctgagttgtctgatggggagaagggtggcagtgagaagaagaaaaagaagaagaagagcaaggaaggagaagctggggatgatgaagctgagaaaagtgagaagaaaaaggagaagaaaaagaagaatcgggatgcagaggtgacacaatagttggagagtgtaattttagccagatcgttgacattgtaggttgcagattggaggtgtctacactgacctctggcttgttgttcacttgcaaacaataatcattctagaggcctagtttagcatttttatatcactatccgtttactgctttggacatgaaatgcaaattaactaggccagcctttttatattgccccactcatgatggcctatttgtgttgctgttccagttatcacttagatgtgatgaattttgctccattgaagttattggtcttttgatttggtacatgctgctgcctcatttatgaaattacttgccttggtgatgaaataacattcatcttgatcttttgtagctatcaaaatgctagttttggtcagtggtgttgtcagttgtgtgacttacttggatggtgtatgatatctatcttggaaatgtgacaactttaaaatgcagctttgttgatattaattttggtctattgtgttgttccagttatcacttagatgtgatgaattttgctccattacagttttggtcttcaaatttggcgtatgctgctgccttgtttatgaaattacttgccatggtgatgaacagtattcatcttgatcttttaatagctatgaaaatgctagttttggttaggtgtgattcgacttgtggtattactcaggatggtgaatgatagtatctatcttggaagtgtaatagttatttgaaatgctagttttgttgatcttaatcttgaattatgggttttggcatgtaactctctttaatctggtggagatgctaggttggttttcagaatttctatatgtgctttcaggatttattacatcattgttggtcactttgatttatccattgcattaaaagttacagtagctatcattgactggcctaaatctgctttacatgtgaacatgtctaccatggcctaccttgtttcgttgtacaacactattagttggactgcaaccttttctgtttctgcagcctgtgataatgtgtgagcctccctccgaggcaattgatttaagtttgtcatccgcacatcatggtgcatcaggttttactcggcgaaggactggatttattctccttttccatttctgctgaacacaagaggtaagcctgctttacatttgtcataaggtttgtttgtttagcagtcattgagaaacgagctagagaatttctttgcgatgttcgttgagcattatctgtggtggtctgtactacatttgtcaccaaattcttgcaagaagatcaggagattcaggctagcacacacaaagaaaaaaaaaaccctgctttctgttcatttaggaacaaaactttactttattattggtagcttagctgaactttttgctatcaagtgcactgtttacagggaggaaacaacactactaacctcaacaaccctgctaacctctgcaccattgaaacagactaagctaagaactgaaacgatcaagaactcctatatttgacagttgttgccattttcattttcctacaagaaagtgtccttacattgcaggctcttgagaaagaatcgaagaatcgaagaagaagaagcagtgcgttccagagtatgtgatgtgcgttggctgctagtgattgacaattacccagacggcgtagatgatccccgggaagtagcccaagaatgtgagcaagaggcagatccagaactcgatctgatagtccatccaggcgagaagccaaaattgcatattagcatcgacgccaaatcaaaatgatcaagcagaatgcgaaatggggattctgaatatgcagatttcagagagagagattggaggaagcttacctcgcagccgaccttgaggaagacgccgaggggaggcaggatgatggcgatgacgaggtccacgaacgtcgccgtcctgtcggccatcgccggcggcctgtccgccatcgccggccgatcgaccacaaacaccggcaaaggcgacgcaaaggcggggagaggatgggaggagacgagacgacgcggtgtcagcgggagcaattcaccaagtttagggggacacaaaagcctaatccaatcgcccaaagtgcatgtcaatttttagcctcttactaattaactagtattgtggcccgcgcaaattgcgcagctagctaccaatattccttattttctattccaaattttcttttttttttctaaattgtatttttatatagattgtaaactcttatttcagtatttttttattttttatttttataaattaaagttataaattgtatttctatatagactcatatgtctacttctattttctttttttaatttcaaattttagttagttctaaattgtatactaatatggattctagttttttctttcaatattcctttttttaattcgaatttcagctatttaaaattgtatttatatatggactctattattctttttatctgatttcatatttcaattaattataaattgtacaccattatgaactttagccttctcttctaatatttattattttttaattatctatgtaaattgtttttctatatggactccgattaatatgagaatttctaggccatgacagcaaacacggagtctaattttcttaggctatctttagatccagggtgaaaatttttgccctgtcacatcggatatactgacacacatttgaagtattaaacatagtctaataacaaaacaaactacagaatctgcctgtaaaatacgaggcgaatttattaagcctaattaatccgtcattagtaaatgtttactgtagcatcacattatcaaatcatggcataattagactcaaaagattcatctcgcaatttacatgtaaactgtgcaattgattttttcgtccacatttaatgctccatacatgtgtccaaacatttgatgtgatgtttttcgccaaattttttggaatctaaagacaccctatattaaatctaaactgttataatctgaatctactatgacccaatggttattttttttctctttttcttgattagcatgggaatttctatttttcttgtccgttttcacttttttctatctttcttgtccgtttccaagttatttttgtccgtttactctttgtttttttgtccgtttccaagttttttttgtccgtttcagctcttaggtttttattttttgtccgtttccaagtatttttttgtccgattcgaattttttttgtccgtttctaagtttgtgttctttgcaaagtactcctccttctatttttctttttttctttcgattaacgtgggattttctaggccgtgagagcgaacgtggaagcttctttttctattactttatagatataatagatagatttgctactcctcagagtcagtactgacgctaaaaattatcgttgtttttattaccattcgacagcacagatgatggtgacgatggcaacagatgaacgatcgatccccttcactttcgtctgtgctggtatgctgattctgctcatggaggacaggatgcagtcatcagcttggctagtggaaacatgaggcgtgtccgagagaaaagcatcaattgccactacattatctgtcgccatttgccgatacagtcgtgtgcgtttctcagtctcgaaacgacacctaggacttttaggacagaaacaaaagggcaaacggcgcctccgttttttcttggctcactcaatcacctcgcttacatcgccattctgtcatggcatttggcaaaacagtagcacacactaatctctctttgagcaagtttaatattatatccaactattagcttcaaatcatctatagtcaatttaatagccaattcatataatagttacctataaacatatactaactaataatagctggtcttacgtaccatacgcacatcgtgtcatgaagtccgtactgcagttatctacaaatctattatctccttaaaatatatttatagctagcttgtagtccgacaacctactcttatcactaaccacagtcttctcctagcttataccttgttccaaagctgcttttccttgttcttatcacacgtcttttgacatatggcgcacgcacctctcctcgcttttcacggctcgcacggcatcaatagtccctccgttctaaaatacattccaaataaatcaatctacgtgatacttcctgatacatcaaatctaaaaataagcatttaaatttattacctcctccatcccaaaatatttgacgtcgttgacttttttaaaagtgtttgactgttcgtcttttttaaaaaaattaagtaattattaattatttttcctatcatttgatttattgttgaatatacttttatgtatatatataggtttatacatttcataaaaaaatttaataagacgaacggtcaaacatatttaaaaaagtcaacgacgtcaaatatttaggggagaagggagtatattaaaatgtgtcagctgtagtgtaggaggttaatttatttcggaattgaacgaagactacttaatccaataccaacggccaacctccgacattgtacttgtcagttgtcactctgctcagctgcggtcgccaacgaggggctgcaatggccatgcccatgccgatgccgccgccggggccgggcggcgacgcgccaccggcgccgacgatgatgcccggcatggcgatgccgatgacgacgggcatgtccttcacctggggccaccgggcggtgggtgctcttcccgcggtggccgggcgaccgcgccggcgtcggcatgtacttcctctgcctcctcctcgtgctcgccctcgccgcgctcgccgaggccctctccgcggcgtcgcgccggctagacctcgacctcgacctctcccgctcgccggccggcggcggcggcggcgacaacagctgctcgccgcgggcgtccacgcggccaggatggggctcgcctacctggtgatgctcgccgtcatgtctttcaacgccggcgtgctcctcgccgccgtcgccggccacgccgccgggttcctcctcgcccggagcggcctcctcggctctcgcgccgccgcgccggaaatcgacggcgccgccgccgccgccgccgccacgtcgaatggttcttctctccatccatcgtcagagccgaaaccttaaaaaatatgtaattctcttcatgctgtcccgtaattaccagataatgaaagttgtagtcaaaggagattatattaaaaaaagactgcaaaattgtactgcatcaaaatggtttattactgatcgatcgtctctcgatctgaatttcgttttcactcctgaaatccaagaacttgtcaggcttgtcctgcagcttcagtttttgacttgtcaaaattacaagataagtgcaagtattaatcacactgacttgctggctagtggctacactcttgagctggtagtacagtatctactaataattggcagctaggttactgtagctgtcgtagattggctcaagctagctgcggccatggcgaccttgctgctgctgcccgtggcggcggcggcggcggcgtgggtgtggtgggggcggtacgcgtggcgggcgcgggcggtggcgaggaggctggcggcgcagggggtgcggggcccgcggcgcggcgggttgctgcggggttgcaacgacaaggtgcggcggcggaaggcggaggcgaagccgaacggcgtgcccatggacgtcggcgaccacgactacctccgccgcgtcgtcccgcacttcgtcgcctgaaaggagctgtacggtacgcacccccctcttggccctgtggcaacaagagcaagaagaaattaatcctgtgcttaattgaattaattctttggataattcatagaattttcgatctctatatctacagaatcaaatagtaataaagaaatactacttggtttccactgaaaattttccgcgtctcacaactgagaaacaacaatataaagaacagcaacaataaagcctcgatcttccgttgcctaacatgtcatatcgaatctaaccattacatcggattccagccactccggtcatcaccggcatcgacaattgaatgaatgatcaaactccatcacaagaaatttctggggtttttttttttgttgttaaaagcacaaggacatgaagaataattatattgttttcatatagcctttttttaacgaaagatgttttcatgccttctttgctaggatcttgtctcaggcgggcaagcctcaagcccgggggatatattggacatagtagaaatgtaaatcatctattctttgggtatcaaagatgaatatactattaattaaaaagatgttgagcagtgcagagtggaaagttttatgccataatattatacctgtcgatagaaacagaacatatatatccctgttcttttcggatgaatggattaacgaacaatgtttcccaaactcctaaacaatatgtcttttaagacattttgtgtatatgactttcttagaatattttctaaatctatttttcaactttgtaatagttaatttatttgtttgcaccctcaaataattattacaaatcattcggctatttagcccttcaagccacacaagatcatatgacaagtgagagacacacaagatcatataacaagggagaacatgtaacaaaaatggggagagaaaaacctagcagaaatgaccatgcctagaagagaaaaaaatgccatagttaaataagtcaccaaatactccctgttcaatgcagaaaaatagcctattcaactatatatcttgtaaataaatttcagtgatttatatgaacctccaacctgtacttcttgactgtgggagtgagaatatgcaattctgaagccattccacttcagcaactatatatatactaactcttcaaattatatgttttcatttgaatggtgtgtaggaacgccatttctgtactggtttggccctcaaccccgaatctgcgtctccgattacaacttggttaagcaaatcctttcgaagaaatatggccatttcgtgaagaacgacgcacacccagctattctgtcaatgatcggcaaagggctggtgctggtggaaggcgcagattgggtgcggcatcgtagggtgctcaccccagctttcaccatggacaagctaaaggtaaatggtcattctaacctggctccaatttctagcaatggattcctagttccttcagaaaatctactcagattttgtttgggagaagcttcctattcctaattctaatcaaatttatttcactgttctgcatttaggtgatgacaaaaaca

SEQ ID NO: 19487 - DNA, 9497 bp, Oryza sativa
  unsure (1)..(9497): unsure at all n locations
nnnnnnnnnnnnnnnnnnnnnnnnnnnnnnnnnnnnnnnnnnnnnnnnnnnnnnnnnattatatgttttcatttgaatggtgtgtaggaacgccatttctgtactggtttggccctcagccccgaatctgcgtctccgattacaacttggttaagcaaatcctttcgaagaaatatggccatttcgtgaagaacgacgcacacccagctattctgtcaatgatcggcaaagggctggtgctggtggaaggcgcagattgggtgcggcatcgtagggtgctcaccccagctttcaccatggacaagctaaaggtaaatggtcattctaacctggctccaatttctagcaatggattcctagttccttcagaaaatctactcagattttgtttgggagaagcttcctattcctaattctaatcaaatttatttcactgttctgcatttaggtgatgacaaaaacaatggccagttgtgctgaatgcttgatccaggggtggttagatcatgcatcgaacagcaagagcatagaaatagaagtggaattcagcaaacagttccaagatttgacggcagatgttatatgccgtacagcatttgggagtaatagtgagaagggaaaagaagtgttccatgcacagaaacaactgcaggccattgccatagcaacaatactcaatctgcaattaccaggattcaagtaaatctatctattcatatttcaccagtacttttttttcttggtacaaccttactgctaacgaatggcttctttttgattgtaggtatctccctaccaaaaggaacagatgcaagtggaagctagaaaacaagttaaggaacacgctcatgcaaattatacagtccagaattacctcagaaggaaatggatacggcgatgatcttcttggcgtgatgctcaatgcttgcttctcaacagagcaaggagaaaaacgagatgagctgatcctgtgcgtggatgagatcatagatgaatgcaagacattcttctttgcagggcatgaaaccacatcgcatttgcttacatggacaatgttcttgctcagtgtgtatccagaatggcaggatcggctgagagaggaggtcctgagagagtgtagaaaggaaaatccaaatgcagacatgcttagcaaactgaaagaggtaagaatataccgtgcatggattgcgcaaattaaaacagaatttagttcttgaaagtatgttttggaggctacggtttgacaagcgtttctgttttctattgttgtggcatgtcagttgaattattcttagtatctcattgtggcaatttgtagctgtagctaacattgaagtttgatattgcagatgacaatggtgctacttgagacactgagactctatcccccagttattttcatgtttagaaaacctatcaccgatatgcaactgggaaggctccacttacctagaggcactgcgattgtgatacctattccaattctgcaccgagacaaggaggtttggggtgacgatgccgatgagttcaacccgctgagatttgcaaatggggtcacaagagcagcaaagatcccacatgctcatctgggattctcaataggaccaaggtcatgcatcggtcaaaactttgcaatgttagaagcaaagttggtgatggccatgatcctgcagaagttctcctttgctctttcgccaaagtatgtccacgcacctgcagatctgataacacttcagccaaagtttggtcttcccatactcctgaaggctctggatgcatgagataatagttttgtatgtagctactattagtatgatttataaaatatgtatattacggggttgctagagcttcgggcgttatagttcttatccaccagaaagtacaccataaaactagaagatatgctgaagaaaggctgcaatctacattgttcagtgtattctgcatgtccagtctcttattatctataaaacttgtcaaggatatgcccagattatgtgtagaagatataaaaccttcaaagtctaatctgaattttggatggaccacctgatagcttggtctagcagctaaagatagaaagcccagttactgcctgatttggagctctatatattggcctgtatgacaacagtggaaaagcaaaggttgcccactcaatagcatttatgcagtaagtccaaattgtcctttcagctttgggtgctccattgattgccacaagtcatatctaatattcaattcgtctgtatgtgaacaacatatttcttatgtgaaaatgaagtacaaccaatacatggtgtgtacatctcgagaaaaagagagatggatgacacctgtttgaatggattgcacatgacatgaatagtccagcagctatggctgtcaaactgatctgtcctgaactagtgattaaagaacaggacaagtgataacgaatgcagggttgttcaattgttagcacactgttgtgtcatatggtttaaaacacctctagaaaatattaaaacaggagaatcaaaacatccatgtcaatcaattggtaagggtaaaggttgagtgctactaggaattctatgagaaggtgtagacagctgcagtgctcagcctgaggctgtgtttagttcatgaaaaaagttgaaagtttggggaaagttggaagtttatgtgtgtaggaaaattttggatgtgatatgatgtgatggaaagttggaagtttggggtagttgggggtgaactaaacacggcctgagtcccttaacagaatccaattatgattcttctagtgaagacacaataaatgaagagatgcacacatgtctcggcctcaacagagcccatatttgatacattaccttctctctcttttttttaagaaacgacagtaggagttctaccagaatttaattgaccctgtttataaggaaaaccagatcaaaaaccatacaactgcacagttttgctacagggaacccggcgaaaccccacagaagacaaagcaaaaaaacctgtggcaaaacaaccacgaaccataatggtgaccgagagaggagcaagaccttcaaggcgaaacctccaaggagggaagtaacgacggaagccgctaccaacgcccgcctaaaaaggacagggttttcacccaaagggaaagagagtcagcaaggcaacacctccatggaggatacggcacccgcaggcgtcgatgttgccgatcctggaataccaggcagggcttttgcccgagactcccttgaaaggtgcaggacctccaagaaactagagcagagtgctgagagttatcgttgcccagctcatcggctaaacccgatgcattaccttctctgctgagccatgtagattggtggctgttattttcattccacttacggtaatgcagtgtccctttcagttcatcaagggacagaggatagcatacctgataccttcatttgctacttgatgttgattgtgccatgacgtcctactatctgcatggcgtcatgcatgacctcatcttctgtatctcctgtacgatttcaattgcatacatacaaactaaaaaaatgtctctactctgaaagtggccgcacaacccaaaaagaccaggtaaatgcatacgagaaatttgtaaagtaaataattctctgttccattatttttcttctagaaaaaaggcagcaggatctctgccccaatatttgagatagaaacagcatggattctaaactgagattaatacacaagtaggcactgtacggtgtacgattagaaaaaacagaatgcacaagagaacagagttcttccccagttctttaatgacataaaacacaaactatgaagctagaaggatgtgcaacaaggcaaaacctggttctggtgtttccatgtagttatcctcgatgtcactcttacagcttcatcttctgattgccatagcctcaaaggtcgtatctcctctttcacactatcgttaagaagtgatagaaaggaaattcagcatggtttctagaacaaaaggattagattcatgactacaaattaatacacaagtaggcactgtagcatgtacgataaaaaacagaatgcacaagaatagaaaacagagtccttctgggcaatatgccttttctctaaaaaaatatagtccttccccaatctgttagcgacaaaaggacacaaaatataaagctagaaggatacacaaaatattgtagaaatccgtcgtgtctcactctcacaattttaccttctttttttcataacctcaaaggttggatctctctatcacactattggtaagaacccctttcatgtagtttccctggtaaattgaactatgctgttgctctgacatgaagaagttaattttgaatgtgcttacaccgaagtctttttttttttcatttccactcagccaactactagaacaatgtagagagagagagagagagagagcaaaaaattagtttcgcaaggaccaccttcagggctagaaggctaggacagacacatgtaaggaccaacttttttcttatgtcatcttttgtataaatacaccataaaaactataaatggccgaggatatgcaaatactccccagttccttgaaaaaaccatatctctactactataaaagcattgccatcctcctccctccccatcacattgcgtgcacaaccagcaatcctcgagaaaaccagaaaaaaaaaatcaaatggttggttaaaaaaaacccagaaaaggcggttagttaaaaaaacaaccggttggatcctatctcagtcatgcagctcattctcatatgggcctgttacaatgcacgggcatggtactagtgactataaatattgcaccaccttcctttcctctcctctccataatccaccacctctttgccatggcctctcttgctctggttttccttgccctcttgttgcctaccatctcatggctatgggactacatcattgtgccccatatatggaggccttacattgcagccaagaggctcagggagcaaggaatccgtggaccaccctacaagttcttgaaaggctgcaatgaggatgtgaagaaaatgaaggatgctgcagatgatctggttcttgatgttcatgaccacaattacctcccaagggttatgccatagtacctgaaatggagatctcaatatggtactagatctgctcaatgcttttttttttaatatgctgttgttttagtgcttggttagcaatgctgtatggtggccaagcaacctgactgacaattttcaaagctaaatgctcatccttcactataaaactaagaatagatcactaatgtggatggtaagcaacattgcaaatgtgaattgttgcaggagagccctttgtatactggtttggggcaaagcctcgaatctgcatcttcaactatgagtgggccaggcagattctttcaagcaagtcaggacactttctgaagaatgacactaccccaacagtgttggcgttgcttggcaagggactagtactggtcgaaggaattgattgggagcgccatcgcagagtaatcaaccctgctttcaccatggataagataaaggtaatcttatctcaatcgtcttaacatgtaggtgtgctagtgctacagaactgagtatggaaatgcaccccagaaactataataggttgagcagaaaactcgaggcaacttaaactaggttgttatatgtttgcatgtccatttgcaatttcacatgacagttcgtttgtagtaagaaaacaccagataaaaagaaaccaaaatatcgaaaccataatgaaaaaaaaatcaaaacaagacaatagaaaatatatcatacccaacacatttaattgcaacaaaattaatattagtatcgcttcactttgatatccatgcagatgatgacaaaaacaatggtagcttgtgctcaaaacatggtgaaggaattggaagatcaagcatccagcaacaagaatggagaaactcaagtggaattggacaaacaattccaagagttaacagcagatatcatatctcatacggccttcggaagcagctataagttaggaatagaagcgttccatgcacagaaagagctccaggaaattgctgtaaaatctctcctcaacgtgcagataccaggattcaggtaatatatctaatactcccttccaaagcttgtagaatgtgaaattaaatcccacgaacatgcaaccatattttggctcattcattcatatatttacttcttttttttttttagttcagctaccttcctacaaaagggaattggaggaaattgacacttgaaaagaagcttaggggcactctcatgcagatcatacaatcccgattatcatcaaaaggaagtggatacggaagcgatctccttggtttgatgcttgaggcttgcattgcaacagatcagggaagggagcaacatcagctcagcttaagcatcgatgaaattatacatgagtgcaaaacattcttctttgctggtcatgaaaccacgtcacttcttcttacctggacagtgtttttgctcagtgtgtatccagaatggcaggcaagactccggttggaagctttgagggaatgtggaaaagaaaatccaaatggtgacaaccttagcaaactgaaagaggcaagaaaactagtacctatgttgccttttataatctattttgatatcttttttttcttgtgatatgtaactccatgtgtatcattctaataataatggttcatgtatggctaactacaacataacatatatatatatatatatattgcagatgtcaatggtattccttgagaccctaaggctctatggtcctgctcttttccttcaaagaaaacctctaacagatattacagtaggagaaacaaaaatacccaaagaccatgcaattatcataccttcagcaattatgcaccgggacaaggagatttggggtgacgatacagatgaattcaatccattaagatttcagaacggggtcacaagagcagccaaagttccacatgccctactggcattctcaatagggccaaggtcttgcatcggtcagaattttgcgatgttggaagccaagtcagttatggctatgatcctaaaaaagttctcattcacactttcccctaactatgttcatgcacctgtagacctgttaactcttcagcctaagtttggtcttcctgttgttctaaggctactggatgcatgaagttagatgatttacatgttaccaaacttaaatggaatctgtatgccaaaggttgctactgacctacggcactatacattgtaccccacagtggatgtatccttataaaataaaatagctcgggccatgattcaatgtgaattactgttctggtgcaaggttggtaccattttagcataatactccgtatatagatttagtatggatattatactatcattgcgcgctacactttcggggcaacatatttttttttctgaggtatctttgtgatgctacttatgattgcaggtctcctctgaaaaccacacaaattatttcaaattcttatttgcacataaagtaatcgaatacgcaaatcccttgtaaattcacttccatagcaaaacaattgcaaaattgaaggttagtaatcttgtagataattttctgcaagcactgctatcgttgcaaaataccagcagtagctgtgcaggtttctgctacctttggcttatgaaggaagaaatatataacctatatatagatcagctgatttttcatgtggttttgatcccaaggccactggattagattccatagagttgcttgttcaatttgataatttcacatggtaaggaactcagcgcgtaaagcgatgaacacttttgatttctgaagtgggcaagtatatatatgatttggaacaaagagagagacatgagcagcatcaagtacatccaagcagggcatccgggagctcacctccggcgtgggcgatcgagaaggatcaaccaccacggggccgctccattgccggccctcgaccgctgcgccccttgctgttggggatgtagcgcaccttgcccagccatgtcagacgcgcctcgccgggcggctaccaccaccatcaccagccggccggccggccagctccagtcccccggcgcccggcatcctactgacgtcgacccccctcccgacgacccgaccgccacgcgcgcagcggcgcggcggcggcggcgagaaatcaggttgcttgggtcatcagttcggcacgatgacggggaaaggaaaaatcgatttgacgccttgtgccgcggaacaaatttgcgatttgtcacggattatttaccctgtctttaaaaataagttttcttaaaaaaaattgagggagactattctactttttttaaaaaaactgttatctttgtggagttttttttttaaaatatttaatttatctatatagttatatagataatcggtaataataatttagtgaatagtgtatgtttcaatctaatagatggaaagctaaacttagggtgcgatggttttaacttttcaggattagattctcctcgtttttcgttagcacgtttttcaagctgctaaccggtatatttcgtgcgaaaactttctataaagaagttgttaaaaaatccaacaaatttattcataaaaaaattatattataatacttaattaattatatgctaatattatttctcgttttgcatgcggctaaacagtccaccgccaccgctgaaacgttctcacccttactcgaaaagtactagaaagtatatagctaatagctccctgtttgttgtagcagaacgagaagggctgcttcaacccctagggatccctcaccgcctcttcgaccactccatggtgaactcctcgtgaccatgcaaatcctagccaactttggaggggtttttgtcaaaaaaaaaacttcttcaaatgttcagctgtgtcgatccattgtgaggatggtgactcggctatgatccagggcgaactgccatgttcggtcgcatccttcctgtgcaaatatcttgacattcctctctccacccataaattgaggaagatagacctgcacccattgttgataaagtaacttgacgactgctcctatagtaagcggagaaaatggtgccaatcggtatcatgaaggtgaagggagtcctaagctcaatttcaatctatttattggtttcaagtggatgcaccaaaatggttccttaaaggaattggcaaaatctaccatggattcctctaggctggatgggcaaatgcacagggtgggcattgccatgttgccaggtcaaaagtttgtgccatagtcaactatggcagccttggtatcctaaatcttgggctcatgggtgaagcccttcattcatgatagatttggctataacgcacatcaccgttgaagctttggtagggactagtgatcccaagcttgcatgcctgcaggtc

SEQ ID NO: 19488 - DNA, 611 bp, Oryza sativa
atacatccactgtggggtacaatgtatagtgccgtaggtcagtagcaacctttggcatacagattccatttaagtttggtaacatgtaaatcatctaacttcatgcatccagtagccttagaacaacaggaagaccaaacttaggctgaagagttaacaggtctacaggtgcatgaacatagttaggggaaagtgtgaatgagaacttttttaggatcatagccataactgacttggcttccaacatcgcaaaattctgaccgatgcaagaccttggccctattgagaatgccagtagggcatgtggaactttggctgctcttgtgaccccgttctgaaatcttaatggattgaattcatctgtatcgtcaccccaaatctccttgtcccggtgcataattgctgaaggtatgataattgcatggtctttgggtatttttgtttctcctactgtaatatctgttagaggttttctttgaaggaaaagagcaggaccatagagccttagggtctcaaggaataccattgacatctgcaatatatatatatatatatatgttatgttgtagttagccatacatgaaccattattattagaatgatacacatgg

SEQ ID NO: 19489 - DNA, 770 bp, Oryza sativa
  unsure (1)..(770): unsure at all n locations
cagctaaatgacagaaagcaatatatggttggtacctccctttgatatgctatttgttgtagcccatctgtgcatactcatgtaaaagtttcttatgaactgtacagatcaaagagttgaattcctatgtcaccttgaggaagacgtaagtcagcaagttctcttgatgaataaatatgtttcacagaacctctagtttagtctctgttgtattatatataaccaattccattgggaggaaacccagtttcttaaactgaaaaaaaatgctcttgtttataacatccgtacctcctgcaatattcttctgtaatgtcttttgttacttctagtaatgctaacacaaactatctgttgcagatatcaaagtagcctaggtaataataataagagggttgagctctttgatatgggcgctggaagtagtgaacctgctgccgaggacaacatccaaatagcatcaggtgaaaataatcatgtgaatctttttcaaatgtggttaatgccatgctaataatcttcttaaatgtaataattgccttatgattgctgagcataagatgcagagcttgcaatcatgttgagagtatatgaaattacaaagtattgtgatggatcgatttcttaacttttgatactataatgacaagtagactatattatagattttcttttgaacaacaaagtagagaaaacaattagtttcgaacatggtnnnnnnnnnnnnnnnnnnnnnnnnnnnnnnnnnnnnnnnnnnnnnnnnnnnnnnn

SEQ ID NO: 19490 - DNA, 208 bp, Oryza sativa
ctcctgaggagttatctcctcaaagacaacaccaagcagttggcaagtcacctggataaaaaaaaaattatgaacttctgcaaattttaagaaaccaaatatgtatttcatttatttcaagtctgccagtatttatgattacaatttacagtgtcaagttaaatcactaaagcatttgctctttgtaactaagagtattatgtcagat

SEQ ID NO: 19491 - DNA, 659 bp, Oryza sativa
  unsure (1)..(659): unsure at all n locations
nnnnnnnnnnnnnnnnnnnnnnnnnnnnnnnnnnnnnnnnnnnnnnnnnnnnnnnattcttctgtaatgtcttttgttacttctagtaatgctaacacaaactatctgttgcagatatcaaagtagcctaggtaataataataagagggttgagctctttgatatgggcgctggaagtagtgaacctgctgccgaggacaacatccaaatagcatcaggtgaaaataatcatgtgaatctttttcaaatgtggttaatgccatgctaataatcttcttaaatgtaataattgccttatgattgctgagcataagatgcagagcttgcaatcatgttgagagtatatgaaattacaaagtattgtgatggatcgatttcttaacttttgatactataatgacaagtagactatattatagattttcttttgaacaacaaagtagagaaaacaattagtttcgaacatggttgagctgtttggttaagtaacattacagcatccactatatggaaatgcaaatgaagcatggtatttatcttgtttgatttgaaggcaatagtgttatataattcataaataccttttcgcttcacgatgattaattttgcctggtaggttgcaagatacaagtttctcaaaaactgaagaggagctaaaa

SEQ ID NO: 19492 - DNA, 1471 bp, Oryza sativa
attgtacttgctaattaaacatatcaaagagaggataaaaagcgtaagcaaaattgtcagtaggcaccctctgttgtcttctttgttaagaatctccatcaagttgtccacaccattataccggacgccggtcacgatcccgtcggggttggacagcgtaagctcaaatatgccatttttaatctcaacctgcatgcgcatgcaatggtgcaacgcgggccaaccaatcaatcattcaatcaatcatgtcaacaatgaatcgatcgaacatgcgcaggcagagctgaccagcagcagcacacttacatatcggtcgctgaccttaacgctgacgccggcggtggcgccggccggtgaggtcgccggtggatggcccatgcagcacggcaataggttcttgcagcttcagaattcaacacagatggacgtgtgcatgcatgagcatgagaccaccaaaccaggaaaccagcagcatatatagtatagcaatgactggcaatgccggccaagtgtgtggagtggacatggccatgcagtgcagatgcagcagtagcaacagaagaaagaagaatgcagaagcagcagtagtacctaagtttccccatgagcaagctgatggatggatggattgatcaatcagtggatggccagctgcttgtggagttggcttgattagatgagtggttatcccttggtttggaaagcaagcatgtgcctgcactggagttgagttgagttcaagccaaggaggaggacagcaatggcgccgatacttcttggtggttggtcagtacagcctgctgctgctgcgagtgcgaggtgaagggatcaaaagcttcagaggcttgacttgttgagaggtgagacctgcagcaaaaggaaggtgtcaaagataactactgcttcaagaattgatttctttgcttatatttagtggggtcagcaactgatttgacctaattaactaacagcttgttggagcttttgagtgaagtatgtgccttgccaccatctggcaacttcttcagtggaagctgttcgctgcaaaccttcaaataaaaaggggtgtttgatgcaaagggcttattatttagaggctttcagctcaaaacaaaagcataaaatcgtgtcctatgtattcctatacttatgaaaaattcaaatcaatgagaaaaggtgagttttaacacagattagtacgccaacattagaatctgacactagtactagtctactagatgatgaactagttggtgtatgtccgaactctgtggcattgacacgtggaacatgccgatagccacagcatcccaagtgtcaccatctagtagtcccgtgaggcagagaggaagagaaaacacaagttcagaaaagagaaaacgacaggaagagaagactttcattggagcaagcatagagatattggcaggcattgggggaaagcgtttggcctcttgtccttggaacggaa

SEQ ID NO: 19493 - DNA, 2997 bp, Oryza sativa
  unsure (1)..(2997): unsure at all n locations
catagacatactgcgtcttggagtccgtgctacagctggctacaaatctgtagcccgctgctcttctctctcctgatttatcttcttaaaatatgtttgcagctggcttatagcctgctattgtacctgctctgacagacagcatctgggaggtgaactggcaggattctgtttgtctaccctccaaatgatgccatatcttacaaatcctctgtataaatagacctcagcacatagctagacacatcaaaccaaaactttcccttcctcatctctcagattcaacagagagacaaagttttagccacagacatggctttccaccaaagatcaattagcttgccttctaggcctctctccaaagttgaagaggagcttcacagcatagaggcatgcatctcttcaccctccctgaccattgagatgatctctgatggtttgaggaggcttgaggacatctacagctccattgaggagatcatgtgcctgcctagcaaccaagtttgctcatctgggcagaggaggttgttggatggagagatggaatgctcccttgagctactggatctctgcaacgctatgaatgaggtcttcaccgagttgaaggccatcatccaagatctgcaagtgtttctcagaaaaggagatgacgcagttcttcaagccaagatccagtcgtacatccacttggtgaagaaggcaaagaagcattccaagaagactttgaagaaaggttgtgttagacaaggagtgcaggatagtcaagctcttgagcgaggctagagagaacaccacatctctattcgagtcaacaatgcacctcttgttgaagcaaatcgagatgccaaaattgtccctcatctccagggcattccagaagaaaaacccagtgatttgcaatgaggagcagttgcaggtgttagagtgctgcatcacagatcttgaggctggagcaggacttctgttcaggagattggtccagagcagggttactctcctgaacattcttagctcatagatgctcgtcaagatctgtcactcttaagaccctgtgattggcatccgccttttaaaggatttgctgatccttagtatatggttagacttatagtgtacagaaaaaagttatacatgaaagaaacagaaattttgatctaattcttgtcgtgcgctcaatcctcacatattattgagatatataatgtgattatgcaacacgatgccagtattattgcctttgtgatgaatataatttgcacaacccaacacatgaactatgaaatatatgtgccaagtaatatagttttcctttattttattatttttatactccaaatgattgctgatatactgatatgccatatggcctcacacatttttcttctagacatgaatatttggaagcaaacaatttgcgctggtccacaactgcctagttgtttatatattcatgtggccatgttacttcacacccgcctaagccaataattagtacatgatcttagttttggtgcatctcacgctacattcatgaaacatgccaggcccaagctacaaagctaaaagcttgcaatcagcacaatattttgtgggtgtgtgttcttagaggtggatcagtgttgatccctccttttatatttgttttctttcttcttaatgcaatgaagcacaacacacctgtgttttcaaggaaaaaaaagttacatcctaaatttgctgcatgatcacatagcttacctagtattgtgttcttgtgtatatattatttttactgttttggagcactgatacacatcttgataataaagcacgttttaattaagttcagaagtaaagagaatttcttttaagcacagaaaaacagtataattatagtgtgcacagcaagacacagattatcttgagacacatctcaagtttatctcagcaaccacaatttaaccatgcaatgtccatgaaactcataactcattggctcaccaggtatgtgcctcgacttggagaaagacatatacttattgagaaagaacaagattttgtcaacttcttgattgattacactgtctatgcaagctttggtacaaaaacataattttcacagaagactgatgttcatcattattgactgttacatgaacagttagcacagatagttccaattcacttttgaaatgctttactacgaaatagtcacatagccaatgctagtttctatgccagtggatcttgcccccatagctaaaataggccagctaccataaacaaagttgagcgggcaagcagcatggattgcacataatagaacacatgttgaaattaacacgagtattaagaaatagattatgcatgtataaaagatactactctggtagcactctactaaaattatcccatgagagcatgcaattatgtctaacatccacaagtagagtgaactaacctgctggttcttgttgccaatagttgggacatgacaatgtgatagctcacttggaagatagatagcagtgcataacaaattattataacatacgagagattccatatgctgctgccagatctcaaaccttgagagacagcatcggggaggtgaactggcaggattctgtttgtctaccatccaaatgatgctctgcattgcacatcaactgaataaataggcctcagcaaaaagctagacatatcaaaccataagtttcctttccttcttatctcttggattcatcacaaagcgccagagtttttgaaacagacatggctttccaccaaagatcaattagtttgccttctaggcctctcttcaaagttgaagaggagcttcacagcatagaggcatgcatctcttcacccttcctgaccattgagatgatctctgatggtttgaggaggcttgaggacatctacagctncattgaggagatcatgtgcctgcctagcaaccaagttgctcattttggcagaagagggtgttggatgagagatgaatgctccttgagc

SEQ ID NO: 19494 - DNA, 57689 bp, Oryza sativa
aagcattccaagaagactttgaagaaggttgtgtcagacaaggaggagtgcaggatagtcaagctcttgagcgaggctagagagaacactacatctctattcgagtcaacaatgcacctcttgtcgaagcaaatcgagatgccaaaattgtccctcatctccagggcattccagaagaaaaacacaatgatttgcaatgatgagcagttgcaggtgttagagtgctgcatcggggaccttgaggctggagcaggacttctgttcaggagattggtccagagcagggttactctcctgaacattcttagcttatagatattcctcaagatctgaaactcttaagaccttgtgattggcatccgtcttttaaaggatttgctgatccttaccatttgtatatgttataggcttactgtacagaaaagaaaacatacatgaaagagagttttgatctaattctttccatcccctgagtcctcacgtatctctgaggtacatcatgtgattatgcaagcgatattattaatgtctttgtgatgaatataaatcgcacaacatggcaaatgaattataaaatatatgtgccacataaacgaaaatcttttcattttttttgctggcaaattgatctgtgatgtgccatagggctatcaaatggccatgtgggtcatgccactctgataccatttgttgcctcattagcaagcaaaggatctttatgcagtagatcttgctgccacagctacaacaggccagctcccatacacgaggatgagcgtgcaaactgcattaattgcacataatataacagtagttggaattaacaaaagcataaaaagatagatagtgcacgtatcagcaataccacggtggtagcaataaattaaaataatcctggagagcatgcaattatgtcaagatccacaagtagagtgaactaacctgctggttcttgctgccgatagttgagacatgacaatgtgatatctcccttggaagaaagatggcagtgcattaaaaattagaacaacacacaagagattccatatgctgtttaatgttgctgccagatctcaaacaatgatagacagcgtcagggagctgaactggaaggattctttttgtctaccatccaaatgatgctgtgtatagcacatccactgaataaataggtctcagcacaaagctagacacatcaaaccataagtttcctttccttctcatctattggattcaacacaaagaggcaacatttttagcaacagacatggctttccaccaaagatcaattagcttgccttccaggcctatctccaaagttgaagaggagctgcacagcattgaggcatggatctcttcaccctccctgaccatcgagacaatctctgatggtttcaggaggcttggggacatctacagctccattgaggagatcatgtgcctgcctagcaaccaagtttgctcatccgagcagaggaggttgttggatggagagatggaatgctcccttgagctgctggatctctgcaacgctatgaacgaggtcttcaccgagttgaaggccatcatccaagatctgcaagtgtctctcaggaaaggagatggtgcagttcttcaagccaagatccagtcatacatccgcttggtgaagaaggcaaagaaacactccaagaagactctgacgaaggttgtctcagacaaggaggactgcaggatagtcaagctgttgagcgaggctagggagatcactacctctctatttgagtcaacaacgcacctcttgtcgaagcaaattgctacgccaaaattgtctctcatttctaaggcattccagaagaaaaacccagtgatttgcaatgaggaccagttgcaggtgttagagtgctccatcagagatcttgaggctggagcaggacttctgttcaggagattggtccagagcagggttactctcctcaacattcttagctcatagatgctcctcaagatctgtcactcctaaaacctgcgattggcgtccaccttttaaaggatttgctgatccttaccttgtatatgtcatagatttatagtgtacagaaaaaaagttatacatgaaagaaacagaaattttgatctaattgtgcgctcaatcctcatgatgtgattatgcaacaagatgccaaaagccgttgtgatgaatataatttgcgcaagccggcacatgaattatcaaatatatgtgccgcgttagcaattctactttcatttcttttatattttatagtcaaattgataatgatgtgccatagggctgtgaaatgcccatgtgggccatgtaactctgatgctgtttgttgcctcactagcaagcaaaggatgcatgtactgtggatcttgctgctgcagccgaaacagaccagctccaatacacgaggttaagcgtgtaagcagcatggattgcacttattagaacacaagttgaaactaacaagagcattaataattagataacacgcatgtcaactataatactctggtatcacgctattaaaataatcccttgagagcatgcaattattccaagaaccaccggtagagtgaactaacctgctgattcttgctgccgataattgggacatgacaatgcgatagctcacttggaagatagacggcaatgcattaaaacattgaacaacaaagagacttgcaacagccagatctcaaaaccatgacagacagcatcagggagttgaactgccagtattctatttgtctaccatccaattgatgtagtgtcttgcacatcctctgtataaataggtctaaccacaaagctagacacatcaaaccaagactttcctctccttctcagctctcagactcaacagagagacagagcttagcaacacacatggctttccaccaaagatcagttagcttgcgttccaggcctctctccaaagttgaagaggagctgcacagcgtagaggcatgcatctcttcaccctccctgaccatcgaggcaatctccgatggtctgagggggctcggggacatctactgctcaattgaggagatcatgtgcctgcctagcaaccaagtttgctcaccacagcaaaggaagttgttggatggagagatggaatgctcccttgagctactggatatgtgcaacactatgagcgaggtcttcaccgagttgaaggccatcatccaagatctgcaagtgtctctcagaaaaggagatgatgcagttcttcaagccaagatccagtcatacatccgcttggtgaagaaggcaaagaaacattccaagaagactctgaagaaggttgtctcgaacaaggaggactgcaggatagtcaagctattgagagaggctagagagattactacctctctattcgagtcaactacacacctcttgtcgaagcaaattgctatgcctaaattgtctctcatctccaaggcattccagaagaaaatcccagtgatttgcaatgaggagcagttgcaggtgttagagtgctgcatcagagatcttgaggctggagcagggcttctgttcaggagattggtccaaagcagggttactctcctgaacattcttagctcatagatactcaagatctgtcactcttaataccctgtgattggcatccgccttttaaaggatttgctgatccttccatctgtatatgccatagaatagaattactgtacaggaaaataaaatatacatgaaagagatacaaagttttgatctaattcttgccgtgtgctcaggcttcacatattgctgagatacaagatgtgattacgcaatgtgctgtcagtattattgcctttgggattaatatacaacggacaatccaacaaatgagttatgaaatatatgtgccatgctagtgatattattttcatttcttttgtatttttacagtcaaattaatccatagggatatacatgctatacctctagacatgaggattgcagacaaatacccatagtgtcctagttgtttatatattctattgaagacttttttttttatattcatgtggccatgttacctcacacctgtttaagtccattaattagtgcccaatcagtgtttggtgcattttgcattacattcatgaaacctgccaggcccaacctacatggattaaagcttgcaattagcacagtgactacctgccaatgtccgttgcattatcgcacgacctagcatggtatgcatcctttttattttatttatattttttggacacatatatatgcatcaagttcagaagtattttttttcccctaaaaaaatgtttaaacatagatgagttatggttcaaaataaaatatgtcagacgagtgagaaaactgcacgcagattggagaaatccaaactgccgcaaaatgatttgcaaaaccatgtcgcagatgcttccatggaagcctgaatcacatccactcatgaactcagccatcaacaatagagaagaataaaaatgattcacaaggcattgcggcacacagattacggagaaataaagtggtagatgcatgcatacctcggctggaccccctgggttctggagggtaaacagcggccgcggatttctcccatcgtcctgggggaatccatgggggcggacatcgccgccgccgccgccggtggcgccggagcggactctctctcccctccgccctttctcgccggagccttctccggtggtgggagtctgggagacgagacgagacgagtaggcagtagtaatttcttctgggccgtgggcttacttgtatttgggcctggtgggtttttccggtatctcatattaggcccactacaaaattgggcccaacacaatcaaaatcaaaatgaacatcgctgaataaaaagtgattcaaaattaagggcactggaggatgccccgtgcgttgctgcgggacttggttaacattaatttgttagataggaggtacaatctcaagaagaaacggaagaaacaaatggctttcttggagaaattctttttagcaaccctatccaaattttgtaaataatttaggtagcacattcaaagcataagctacgaagaagcagaatgggcattcggccataaagctcttttatacggattgatgagccggatacatgtagatgtgtgtggagatgggccaatatgtttacgtgggctacatttggtactgagtaggcggagagactcacccgatgcttgatggattgggctctatgctgcgttccatccaacggctgagaagcaatctaacgcattcatccaacggtttacaattgatgatgacgtggaagtatgaggtttgagcttttggtattgactttatagaaagaagggattactaccaaaatcaacttttcctaaattggcaataccaaaactatggtagaataagataaatgtattgttgctaaaattacctatttgataataaactaaatgcaactatatatttgtcaattttattaaacaatccatagactaaatgcaactatatatttatcaattttattaaataatctatagtttaaaatggcatcaatctgaatacactctaatagccaaatttgcctcgctaatactactgcgtatattagctgcttggaattgttcatgacagcttcgaatgcaagctctcaactagagatcgatgaacacacgcgatgcaggatttttgcatccgttgcatcgcggcacagcattgtacgcatcgtccaactagaagatccttgctgccggctggtaattcagccattttttgccgggtcggcgcaagtacaccgaccaaattttattaagacagaaagaatttatagattttacatgatattatactgtcgagtcgggaataacccccaaaaaggataattcagccatagaaaacaccttttattcatctccatcatctctccttatttttttaaaaaaataagtaattattatttatgacgtgacttggcttatcactagattacttaatgtatgacttatattttcatatgtttgtattaaattttaaacaagacgaatgattaagtatatgtttaagagttagcagtttcatccattaaaaacacgtgaaaagcacgaggaagtaactctgaacagtgaacttaactgtatcaggaactttatcctggatgtaagttgtaacagccctgaccgccctatgggcttccctgacaacactcttgcccatgggataacaccttctagaattttcagaacacctaacaccgttttttttttcttttttagataagggtattttttttacccggcatctacatccaaccggatatatacggccattgaaatagggaacttagccccggaaacaacccaatctaaaattcgctccatagaagatttgaactcagaaccttggggtactactcaggtcactgtaaccactaggctacatgccctttcataaagggtgtccaatgtaaggcactcgagtgacaccgcgttcttgaggatataacatgttagctcaatcaagttcttcgcggagctgaaccctgtcatcttcacactcttgaggtagcaatggcggtgttccggcatctgcctcaaaggcgaggaatctccaagaaccgattcatgcttcatatgctcttgtgatacctgataatgataaaagataagtcaaataaagtatacatatccaagagatcagtgatcagatagaggagtatatctttgcaggatggaatgagcgaagagtgccttacattcaagatcaatgtctccaaggaaggagacgcgtcaaggaaagaaacaagagaaaaataatcatacgacgtgttaaaggaggctgctgagctaacggaaatggtgaggtgcttaaggtagaggaattttgtaggcagcattggtgtattgaccacctgcacaatgtatgtcatgtctcaaattaattagaattaataatcctataatatacaactactcttaatatgcataataaaacgcctaatgttttagagatcgatacctcatcattggagtaaatggcaagagtctcaagatttggcataacggatggcagctcggcacgagcataacagacaacctttggatggatcatgcttaatctcttcacttgcaatgggtctccaagtgagagttttacatttccgctgaagcttaaactggaaagatttggagcattgctctctatcactcgcagcctacagcatccagcaaccaccaggcagctcaatttttgcagcacgcaaggtatcttcaggcaaattatctcctcacagttgctgaggttcaactgctccaaagcaatagtagaattggaaagaaagcactccaactcatcctcggtaacatgtacaaaatgcagactcagacttgttagttgttaggtttctcaaggtgccaagttcagctgtggggcgaaaggcacaatagccaagtttaagataccgaattgagcttcgaatcccactggataaaactgagcatgggaaattgtactctgctgtaatactagtacatagcataacaatgagctcttcagtcatcggtgtaacagcaagtttaagccaacggtcgaggcagagaagggaaatgccctctaattgaagcttcaatatcttcacaccagagcctgagcggtttcttagaatgccatcaattatgtcgctggcattcactatatgtgaatgtagtgaatgtacttccgggagaaacacttccctagtcaaggtgagattgggacgacatctccaggaatgaagaaaggcacgagataggcaagcagcacgagcagcatcacgcagtggcattagggaatgtacatggcaccagatgtcctgcatacgagcatatgcgagtagagttcaatgccgaaagagccaaatggttacttggacagtagaaagaaaaacagaagtaccacatggagtaggagggttatattctacccaggtataccttttggcatgattaattgcaagtgatatgcagatttacaagagttgataattaattgatagtgcagtggaatgtatcagaaaggtcagaatttcatgccgccctacgtacctcaggaaggtctggaattgttgctttgacagcttgagaatcatcaccatcttgttgactagagggcaagcccgagcccttttctagtattcattgaagcaatggatccaactgcaacgcaaccaagcacagagacttactcaatatatatatattgataatagttacaataatagtccatatatatcccagaccattatctaaaaatatatatcccagatattgatatggattggaacaaggggaaaaattaagaaggaactcaaggaaacagcaaccgattgagcaaaacgaaagtatcaatcagagggaacccaccgaggggcaaagatactttttttttttttgagaacagatcaactaacccatggttaaaaacgataggcaccagaggggcgaacctatagccccaagttatttttttctgcaaacaaattgcatatgctatcagcataaataatactcaaggttaaggcagagagaaaagctcccagatcaacaagtagagaatgtaatgttatgggaaagagagaaaaatgaggcgctcaccggccggcggcgaggacgccggcgccgctggtcgcgagattggaggtcggcgcaggcggcgggccgaggagtcgaggccgagggagcagcgagtcggaggccaatacaacgtcttgtttgggctttcatggtttgagtccaggacggtgaaaggctcaaacacaaattttgcaggagtttgctctgcgtgtatctgtatttcaattcaagttatgtatatccctttcactaaacaaatataactaacaagtttctgtctttcttattcgcaacatgttttgctgataaattcattcaacgaatgctggtatgtcgtatcaacatgctgattgttcgcctgacaactcgagcctttattttccaagcaccgggaggaggcatgaaattaatgataaaaaaatagctatacaaatttttggtctcttctcttgataacaaacaatatcagcaattcagcacatagttgcgtttagcaatcttgtcaagcccccttgcattccaaattaaaatgaacgtaggattcattggggacattgacagggaggatcacactacaggatacacattcaaattaacacaggcaggtcaggtcagaagatagtccagaatccacaagataagagttgcctgcgacaaggaattgtaggtgttagaactgaacattgttaatctagacaatggaattaagaacctgttcaggaaattgattcaaagtagagtttcactttccgactcctacttcagcttgaaggtagatttgcgagctctaatcccctgtgcttggcacccgcgttttagagaattcgccgatcgttgaaatagtctcccaatgtttatataaacatgagaaaaatgtgtagaaatatactcactgaaaaataaaaacaggattcagtccatcttctattgttgattacactgtctatgcacatgctttagtaccaaaaggtaaaaaacttaatttccttagaagattgatgctcatcaatattgactgtcacaaaaaaaaaaaacagatgacattaaagttcaccttcgaaatgctttaatgtgaaatgggcaaatcgcccatgtcactcagatgacaaatgctgcctcagcagcaagcaacgatcttgctccaccaataaaaataacagggcagctccaacacaagatgttgagcgtgtaagcggcacggattgcacataatacaacacatgttgtaatcaacgagagcacaagaactagaaaaacgcatgtcaacagtaatacttgttagcactctaataagataatcccttgagagcatgcaaatgtgtcaagatcaaccggtagggtgaactaacctgctggttgttgctgccaatagttgggacatgacaatgcgatagcacattgagaagatagatgtcagttcactaaaaaatcgaacagcatacgagtgattccatatgctgctgccagatctcaaaccattgatagacagcatttgggaggtgaactggcaggattctgcttgtctgccatgcaaatgaagctgtgtcttgcacatgatctgtataagtactcctcagcacaaggctagacacaccaaacgaaactttcatttccttctcatcttcttggcctcaacacagaaatacagacctttagcaacaggcatggctttccaccaaagatcaattagcttgccttctaggcctctctccaaagttgaagaggagctgcacagcctagaagcatgcgtctcatcaccgtccatgaccatcgagatgatttctgatgttttgaggaggcttgatgacatctacaactccattgagcagatcatgtgcctgcctagcaaccaaatttgctcatcccagcagaggaagttgttggatggagagatggaatgctccctcgagctactggatatctgcaatgctatgagtgaggtcttcactgagttgaaggccatcatccaagatctgcaagtgtctctcagaaaaggagataatgcagttgccaagatccattcatacatccgcttggtgaagaaggcaaagaaacatttcaagaagactgtgaaggtagcctcagacaaggaagactgcaagattgtaaagcggttgagcaaggctagagagatcactacctctctcctcgagtcaacaatgcacctcttgtcgaagcaaatccagatgccaaaattgtctctcatctccaaggcattccagaagaaaaacccagtgatttgcaatgaggaacagttgcaggtgttaagagtgctgcatcggagatcttgaggctggggctggacttgtgttcaggagattggtccagagcagggttactctcctgaacattcttagctcatagacgctcctcaaaatctgacactctttaagaccgggcgattggcatccaccttttaaaggatttgctaatccttcccatttgtatatatcatagacttactggccagaaaagaaaagatacatgaaagagacagttttgatctagttctttccatgtgctttgtcctcacatatctctgatatacatgatgtgattatgcaagtgatattagtattaatgcctttgggtgatgaatatacatacaaccaagcacatgaattatgaaatatatataccatgttagctttcctattctttcctcaatcaaaccaacccttctcttctccacaggcactcaatccctatttgagacagcaagaaattactttcaaattgatctgtgatgtgccatagggctatgaaaatggccatgtgagtcatgacactctgattccatttgctgcctcggtagcaagcaaaggattcttgtgcagtggatcttgctaccacagctgcaacaggccagctcccatacacaaggttgagagtgcaagcggcattgattgcaaatgatagaacacatattgaaattaacaagagaacaaaaaattaaaaaaaaatacatgtatcatgtatcgacaataccattctggtagcactcaattaaaataatcccttgagagcatgcaattatgtcaagatccacaagtagagtgaactaacctgctggtttatgctgccaatagttgagacatgacaatgtgatgactctcttggaataaagaggcagtgcattaaaaataagaataacatatgagatatttcatatgctgtttattgctgctgccagatctcagaccatgatagacagcatcagggagctgaactggcaggattctgtttgtttaccatccaaatgatgctgtgtctagcacatccactgaataaataggcctcagcacaaagctagacacatcaaagacataagttttcctttccttctcatctgtcgatccaacacagagaggcaacatttttagcaatagacatggctttccaccaaagatcaactagtttaccttctagacctctctccagagttgaagaggagctgcacagcattgaggcatggatctcttcaccctccctgaccatcgagatgatctctcatggtttgaggagccttgtggacatctacagcactattgagaagatcatgtgcctacctagcaaccaagtttgctcatcacagcaaaggaagttgttggatagagagatggaatgctcccttgagctactggatctctgcaatggtatgaatgaggtcttcaccgagttgaaggccatcatccaagatctgcaagtgtctctcagaaaaggagataatgcagctgttcaaaccaagatccagtcatacatccgactggtgaagaaggcgaaaaagcattccaagaagactgtcaagaaggttgtgtcagacaaggaggagtgcaagatagtgaagctgttgagcgaggctagagagatcacaacctctctattcgagtcaacaattcacctcttgtcgaagcaaattgcgatgccaaaattgtctctcatctccaaggcattccagaagaaaaactcagttatctgcaatgaggagcaattgcaggtgttagagtgctgcatcagagatcttgaggctggagctgcgcttctgttcaggagattggtccagagcagggttactctcctgaacaatcttagctcatagatactcctcaagatctgacacacttaagagtttgtgattggcatccaccttttaaaggatttgctgatcctttccaattgtatatgttatacaattactgtacagaaaaaaaatatgcatgaaagagaacagttttgatctaattcttgaattcttgtcgtgcacccaatcctcacatattgctgagatacatgatgtgattatgcaaatcaatgtcaatattactgactctgtgattaatatacattgcacaacccatcacctaaattatgaaatataagtgccacgttagtgatattagtattactcttatttcttttcttttttacagtcaaattgatctatgatgtgcaataaggctatgaaatgtccatgtgggttactgactctgatgccgtttgttgcctcactagcaagcaaaggatccatgtacagtggatcttgcagctgcaggtaaaacaggccagctccaatacacaaggttaagcgtgtatgcagcatggattgcacataatagaacgctagttgaaattaacaagagaattaaaaattagataacactattaaataatcacttgagagcgtgcaattatgccaagagccaccggtagagtgaactaacctgctggttcttgctgccaatagttgagacatgacaatgtgacacctcacttggaagatagatggcagtgcattaaaacaataaataacaaagaggccatatgctacagccagatctcagctgaactgccaggattccgtttgtctaccatccaattgattctatgttttgcacatcctttgtataaataggtctcagcacaaagctagacacatcaaaccaaactttcctctcaactctcagactcaccagagacagagtttagcaatagacatggctttccaccaaagatcaattagcttgccttctaggcctctctccaaagttgaagaggagctgcacagcatagaggcatgcatctcctcaccctccctgaccatcgagacgatctctgatggtttgaggaggcttggggacatctacagctccattgaggagatcatgtgcctgcctagcaaccaagtttgctcatccgagcagaggaggttgttggatggagagatggaatgctcccttgagctactggatctctgcaacgctatgaacgaggtcttcaccgagttgaaggccatcatccaagatctgcaagtgtctctcagaaaaggagatgatgcagttcttcaagccaagatccagtcgtacatccgcttggtgaagaaggcaaagaaacatttcaagactgtgaagaaggttgcctcaaacaaggaggactgcaagatagtcaaactgttgagtgaggctagagagatcactacctctctattccagtcaacagtgcatctcttgtcaaagcaaatcgagatgccaaaattgtccctcatctccagggcattccagaagaaaaacctggtggtttgcaatgaggagcagttgcaggtgttagagtgctgcatcggagatcttgaggctggagcagggcttctgttcaggagattggtccaaagcagggttactctcctgaacattcttagcccatagatacccctcaagatctgtcactcttaagaccctgcgattggcgtccaccttttaaaggatttgctgatccttccatctgtatatgccatagacttactgtacagaaaaaaaatacatgaaagagatacaaagttttgatctaattcttgccatgtgtgctgtcctcacatattactgagaatctgagatacatgatgtgattacccaatgttctgtcagtattactgcctttgttatgaatatacatcgaacaatccgcaaatgaatatgtgccatgttagtgatattgttttcatttcttttctattttacagtcaaattgatctgtgatgggccgtagggatatacatgctctacctctaaacatgaacattacacgaaaatacccacaacatcctagtttgcatattctattgaggccatgtggttatgttacctcacaccggtctaagtccattaattagtcctcattcctcaatcagtgtttggtgcatcttgcactacacacatgaaacatgccaggcccaaactacagagattaaagcttgcaattagcacaatgtattagctgccaaagttcgctgcatgatcgcacgacctagcttggtaagctcttgtgtgtacatccattttatttattcattttggaggactcatatgcatcacattcagaagttttcttaaaaaacaaaaatgtttaaatactataattgtagcgtagacagcataatctgcaattctgcagcaaatatgccggacgagtgggaaaactgcaagcagatttgagaaattcaaagctgcacgaagcgatttcgaaaccatgcgtacgcttatcgctgtggattgctgattcactcatgaactcaggcatcaacagtagaaccaagatgactcacggggcattgcattgcagcacacaggttacaggaaaataaagtggtagatgcatgaatacctcagctgccccccctgggtgctggagactatacagcatgcggccgctccctggggctgccgtcgccgtcgccgtcgccgactcgccagagcgggctctacccctccactctttcttgccttctccggtggtggtgagttgtgggaggcgacgagtaggcagtatctcctgggccccatcagatcaaaagcaaaattaacaaccaattttgcctcaccctcacatacaccacacaacttgcatatgcttacagtagattagatgttttggatgattggatgccccatttcctcgcaggctcgacgatgatttcacaatccaatctgacagtacttgtgcgtgtgttcgtgcaacggttgctgcctgcagcagctgctacatgacagcctcgcatgccaactctcaactagagatcgatgaacacactacacaagcgtgcaggatttatacatctgctcgctggagaggagacagggcagtcatccagtcgtacgccgagcggccaagaaggcacagagacacatcaggaggatcaccggcggtggcagcagcaagcctgcagcttctgaagccagagagatcgccgtcgcagcgctcgaaacagcagcagcaaagctcttgccgaagcagatcgccaccatgtcgagttcaagcaggtggtcccagctcgtctccaagaagaagagagatgcctcctgcgaggagagcagttgcaggtgttggagttggacattgctggtcttaacaacggtgttgaggttctcttcaggagactcatccagagcagggtctcccttctcaacacactgacactggtagatgatgagatagatcatagatcatgcaaacactagctcctttgtgatctgcgtccgccttttagaggatctgctgatcatgaaacaattttgccatgagtacaatgagacaaaatgatgaattgtacagtcattttgagaaaagaattcttgttggtccatgttctcttgtcgattcactgtatgtactttgatgagaactttattccatgcctatgacatcaggcctagtacaagattatgttcacttggcaaagtattttcttttccaagaagtgccactatgaaaacaggatagacgaagatccctttttttagataataatgggataaacgtagattcatgctgacatacacaaacttgatttaccaatagcgtgctgtagaccagcttgtaattagcataaccagtgcccaataaaacaatacttaacaaccattaacacgaatggaaccactaactagtcagcctgcttactccattaaacaagtgttagagcatgcgtgcacacctgtgattgtgaggacccagcaatgaactgccaagctgattctttgtcccaacaactggaacatcacaatgtgataagcctagttaggagcacctaatgcatcggaagaaaattgcacagcatgtggatcatcttgaggttgcaacaaccagatgctaaatgccctggtagagacatgccagcaatgatgcacgggtggtcagaacaagataagcatggcgtgttgcattggaacctggatgggaagtcaaccatagttttttcttccagaaagaatcatcaggcagcagccagcttcatttctctcatcatttaactgcgtgctcacctcgcatcttgatctgaatctgacattaaactaaccactcgtgcagatgagtttgccgctgataattcagacatgacaggcttgttatgctcaaatgtgagagttagaaatgcctcttatattgaggagacataaaaaagcatcagtttgtcttggagatgggtggctttgttgcagcagcacaaccatcaatattgatgagattctttctgttgcttctgtttcttccgttataaatagagacagactatgctgggctttcaccattgagcagtttcttctcttctcttccgtttccagagaaaaaaaaaaggaaacaccacacaccatctatagaaaccatggcatttagatctgcaagcgctccttccagccctcgttctaacaaaaccaatgttgaggaacagcttcagagcttgaaggcaaccatcacttcacccgctgaaaccattgaaacaatgcttgatggtttcagcaggattggagctgtgtacaacaacattgaggagatcatatgcttgccaagcagccaagctcaactttgtcagaatcagcagaggaaagcagtagagcaagagctcgagcattcccttgtgctgctcgacctctgcaactctatccaagagagtgtttccaagctcaagacaagcattcaggagatgcagttggttcacaagagaagggatgctacagttgttcaggccaacatccagtatttcattcgtctgaccaagaaggtgcaaaagcagtccaagaagatcagcaagaagtctgcttcagctgagcaggagggctccagggtgatcaagctgttggccgaagctagagaggtcgccatctcaatgcttgagtcctcttcacatctcttgtcaaagaagatcacaacatcaaattctagcaagtggtcacttgtctccaaggcatttcagaagacaaggcttgcatgccaggaggagcaattacaggcgttggagttcgccatcgttgatctcgagagcggagttgagactttgttcaggagattgatccagatcagagtttctcttctgaatgctctaagcttgtagatagacgatgaaccaactctggctccctctgatctgcatccgccttttataggatctgctgatcatcaaaacaattttccaatgtgtatatgagaggaaatgacaaatgtcaaaatgtacagtacatcagttagtcaaaaggaaaaaaaatattttggcccatgctcagttgtcaatttttactgattttgaagcttgtatgtatgaccatttttcctttccaggaacttatttaacctcacactgaggacggccaaacaatcacctgaattttggggtacttaagctaaagtttattgatagaaaaaaaacttaaattatcaataagatgctcacttttcctggatgttatagaaacaatagtacagaaagtttgaaaaattcctttgaagccagcattctttactagagatgatgagatggccatgctttcctcattcacaggaatattattatacaatatatcttgacatcatgccagctggtaattagcataacctatgcctaataaaccaaccaattaacaattaatagcacacatagagaacccatacgactcgccaagcgtgctccattaaacaagtgttagagcatgcatttttgtcaagggccagcactagagtaagctgccatgctgattcttgatcccaagaactggaacatcacaatgtgatagagctagtcaggagcacctaacgcatcgtataaaaatacgcaccatgtggatcatattgagattgcaacagccagatgctaaatgcactagtaaacatgccagctatgatgcacgggtggtcagagaagataagcacagcatcatgtgttggaacctggaagtgaagccaattagttgtccctcccaccaagaatcatcaaattaaccagctcctttctctcataagatcactggcatgttcaccgatctcactacactgatccggatttgacattaaactactcactcgtgcagatgagtttgccattgatacagcaggcatgacagactgatcatgaactcaaatattagagatagaaatgcatcttataccaaggagacaaaaaaaagcatctgtttgtcatggagatgggtggccttgttgcagcagcacggctttcaatatcaatgagattcttgctgttgcttccactactttcgttataaatacatacaaaccatagcagggtcaacaacattgaaacacggtttctcctgttctcttccatttcttcagaaaaaaaggaagcactgcactatccatagaggccatggcatccatgcttagatctgcaagtgtgccttccagcccctgctccaatgaagccaatgttgaagaacagcttcagagcttgagagcaaccatctcttcaccctctgcaaccgtcgaaacaatgcttgatggtttcagcaggattggaggtgtatacaggaacattgaggagatcatgtgctttcccagcagccaagttctcctttgccaaccacagcagaggaaagcagcagagcaagagcttgagcgctctcttatcttgcttgacctctgcaatgccatgcaagagagtttctgtgaactcaaggcaagcatccaggacatgcagttggctatcaagagagccgatgatgccgctgttcaagccaaggtccagtccttcatccgtctgaccaagaaggcacaaaagcagtcgaagaagattagcaagaagtctgcttcagatgatcaggagggatgcagggtgctcaagctgtcagctgaagctagagaggttgcaatttcaatggttgagtcctcgttgcatctcttgttgaagcagattgtgatgccgaattctagcaggtggtctcttgtatccaaggctttccagaaggcaaggattgcatgccaggaggagcaattgcaggcgctggagttggacatcagtgatctcgagagcggagttgagactttattcaggagattgatccagagcagagtttctcttctgaatgctctgagcttgtagatgatacaccaactcttgttctttgtgatccgcgtccatcttttagaggatttgctgatcatcaaaacaattttgagaagtgtatatacacaataggtactgacaaaatgtacaagaatactgaaaagaaaaaaaattatctatgttcagttgtcaactttactgtcttagctttctgcatgaccataaatcccttccagaaaatcttatttatcctcacttagaatggccaaactatcacttgtattttggagttcttatgttaaagttcacttagaggtaaaaacataacttataaacaagatgctcaccattactggttgttgtagaaataatagtacagaaagtttgaaatttccttctgaagctgcaccctttcctataaaataatgagatggttgtgcttttctcatccacaggaagtttatagtacagtccatcttgctgtcatgactaatagcacactagcagataattagcataattgtccaataaaccaactatctaacagttaatataacacatcgaacccataccactttcccagcattctccattaaacaaatggtagctcatgcatttatgtgaatgcgcagcactagagtaagctgacatgctgattcttgatcccatgaactgaaacatcacaatgtgatcggcctagttaggagcacctaatgcataacagaaaattgcacagcatgtggatcatcttgagattgcaacagccagatgttaaatgcactagaagaaacatgccagcgatgatacacgggtgatcagcacaaggtgaagtcaactagttcttccttacaccaagaatcatcaatcagctccttatctcatcatttcactgcatactcacagatctcaatacatcaatctggatttgacattaaactactcactcgtgcagaagagcttgtcattgacaatgcagacatgacaggctgatcatgaactcaaatattaagagtgcaccgaagggacataaaaaaacatctctttgtcatggagatgggtagctttgtaccagctgcatagctttcattatggatgagattcttgctgttgcttctatttcttcacttataaatagagagaaaccatagctgagtttacaccattgagcaaggtttcttctcttctcttccgtttccagaaaaaaagggaggtgctacaacatccatagaagccatggcatccatgctcagatctgcaagtgtgccttccagcccttgctccaattaaagcaatgttgaagaacagcttcagagcttgaaggcaaccatctcttcaccctctgcaactgtcgaaacaatgcttgatggtttcagcagaattggaggagagtacaacaacattgaagagatcatgtgctttcccagcagccaagttttcctttggcagccacagcagaggaaagcagcagagcaagagcttgagcgctctcttgtcttgcttgacctctgcaatgccatgcaagagagtatttctgaactcaaggcaagcatccaggacatgcagttggctatcaagagagctgatgatgccactgttcaagccaaggtccagtctttaatccgtctgagcaagaaggcacaaaagcagtcgaagaagattagcaagaagtctgcttcagatgatcaggagggatgcagggtgctcaagctgtcagctgaagctagagaggttgcaatctcaatgcttgagtcctcattgcatctcttgttgaagcagattgtgatgccgaattctagcaggtggtctcttgtatccaaggctttccagaaggcaaggattgcatgccaggaggagcaattgctggcgctggagttggacatcagtgatattgagagcagagttgagactttgttcaggagattgatccagaacagagtttctcttctgaatgctctgagcttgtagatgatacaccaactcctgttccctttgatccgcgtccgccttttagaggatctgctgatcatcaaaacaattttgtgtatatagagtatatatgatagaaaatgacaaaatgtacaggaaatcatcaatcgaaaagaaaagtttttagtccatgctcagttgtctattttactgttatttgaaccttaaatgcatgctcacgactcctttccagaaactgctctgtttcacctcactgaggacagccaagcaaaaccatgaatttttagagttctgaaatttaatattatttataaaatacataattttctatcagatgctcactgttgatcgatgttatagaaaacaacgatacataaagtccaaagtttttcttttaagtctgcactcttcactatgaaacaatgggatgataatttatttcttctttttccaataacaagcgaatttttgtgtttgctaagaaatgaaatacatacaatggttagtacaggattgagatccgagttgtgcaaaaataagcatatcaaagggactgcaggcaaagttggaggaaatcacagcagcagatatcaagtgaccaagacataaaagcaacaatagtaggttgttatatcaggattgtttatgtggtggtttttgttgtcctgatgtcaaactggagattccagtcttttgcttttacctgtatgctgtaagacttatgttcgctttctaagttaagctgggttgatctgttgatatatggtctaaaaaatatcagaaagtttctcggcgacctactcctgccattctccattggcatgcttttctcatgcacatcaaggtttttttatacagtagatcttgctgtcatgactaatagcatgccagccggtaattagcacaacctgtgcctgaaaaaccaactacttaaaaaattaataacaagcatagaaccatactactagctagcattctcagttaaacaaatattagaatacacatggatgtgaaatcctgcactagaataagctgccatgataattcttgataccaaaaaatgaaacatgaaaaggtgatatggctagttaggagtgcttaatgcatcaatagaaaatcgaacagcatgtggaccaacatgagaaacataccagcgtccagaacagataagcatgtgtgtcacgttggaggcttggagcttggagatgaagtcaattagctgttccttccaccagaaaacatcaccagctcctttctcgccatttcagtgcatgcttgtcaatctcaccacatgtccacattgatctggatctggcattaaactaatcactcatgcagatgagattgctgctgacggttcctacatcacaggttaatcacaagaaaaaacatcaacttgtcgaggagatgggtgccattgttgcagaagaacaaccttcattattgacaagatcctttctgttgcaatgcttatttcgttatagataagagataaaccgtaggcaggtctacaccattgcaaaacagtttctctactctttctctcccattatcagcaaaaggagagcattgtggcttcagctaaaaccatggcattccacctcagatctgcaagcatgtcttcaagtcctcgctccggagaaaccaacattgaaaaatagatgcagagctcgatggtgatcatctcttcaccctctgcaactgtcgaaacaatcttcagtgacctcaagatgattgaatgagtgtacaaaaaatattgaggtaatcgtgcataccaagcaaccaattcatctttcatcagaatcagaaaaggaaagccatggagcaagagctcgaggattcccttgtgctcctcgatcttttgcaaagccatccaagagatttttttctgagctcaagacaagcattaagaagatgcaaaaaaatccaatcgttcatccatttgaccaagaaggcgcgaaagaaatacaagaagttcaggaagaagtatgcttcagctggctaggggagctgcagggtgaagctagagaggtttatatctcaatgattgagtccttattgcatctcccatcaaagcaaattgagataccaacttctagcaagtagtttttgtctccaagacattgcaaaagaaaagagttttatgcaacgaggaaccactatagacataggagttgaacattattgatcaggaggttgttccagagcaaagtttcacttttcaatgctctaagcttgtagatagattataccaattcttatcccagatgattagttcccagcttttataggatttgctgataatcatgtgtaaatgaaaaggaattgtacagaaatttactcaatgagaaacaaaaaaaaaaatcatttaatttcctgctatttatttaactgtttaagcatgctttgatgcatagcaacgtatgggaccagatcattcagataaaattcaaaagtaatataataatttactcagatggtgatattattattgactgttatagaagtaattagcagtttagcacacgtgtgcagtggatctagttatccatagctaacaagtcagctccaagcctccaatgcacgaggttgagggcgcaagcagcatgtaatttgcagtataaagtacctctgataatatcagttatacaacaactaaatagcaagcatgatgccaataatacgctgtttaaactccattaaaaaaaacgttttgtgcatgcaatcatgtcaagatccactaacagagtgagctaacctgccgattcttgctgctaatagtagggacatcacaatgtgatagctcatttggaagataaatggcagtgtattaaacaattgaacagcacaccaaagattccatatgttgttgccagatctcaaacaatgatagacagcatctgggagctcaactggcaggattctgtttgtctaccatacaaaggatgctgtgtcttgcacaccaactgaataaataggcctcaccacaaagctagacacatcaaaccagaacttccctttccttctcatctcttggatccaacacaaagagttaagagttctagcaacagacatggctttccaccaaagatcaattagcttgccttcaaggcctctctccaaggttgaagatgagttgcacagcatagaggcatacgtctcatcaccctccaagaccaccaagatgatctctgatggtttgaggaggcttggtgacacatatagctccattgaggagaccatgtgcctgcctagcaaccaagtttgctcatcacagcaaaggaagttgtttgacagagagatggaatactcccttgagctactggatctctgcaacactatgaacgaggtcttcaccgagttgaagtccatcatccaagatctgcaagtgtctctcagaaaaggagatgatgcagttgttcaagccaagatccagtcatacatccggctggtgaagaaggcaaagaagcattccaagaagactgtgaagaaggttgcctcagacaaggaggactccaagatggtcaagctgttgagcaatgctagagagatcactacctctctattcgagtcaacattggacctcttgtctaagcaaattgcgatgccaaaattctctctcatctccaaggcattccagaagaaaaatgcggtgatctgcaatgaggagcagttgcaggtgttagagtgctgcatcgcagatcttgaggcaggagcaggactgctgttcaggagattggtccagaccagggttactctcctcaacattcttggctcatagatactcctcaatatgtgacactcttaagaccctgcgattggcatccgtattttaaaggatttgctgatccttcccatttgtatttattataggcttactgtacagaaaagaaaacatacatgaaagagacaaagttttgatctaactcttgttgtgcactcggttcagacatatctctgagatacatgatgtgattatgcaagcgatattagtattattgccttgttatcgaatacacatagcaacggctcatgaattatgaaacatatgttccacacaagcaaaattattttcttttcttttttgcagtcaaattgatctgtgatgtgccatagggccatgaaatggccatatgggctgtgtcactctgataccatttgtagcctcactagcaagcaaaggatccatgtatagtggatcttgctgctgcagttagaataggccagctccaatacacgaggttaagcatgtgagcagcaggtattgtacataatagagcacttgtagcaagcaaaggatccgtgtgcagtggatcttgctgccacagctaaaacagtccagctaccatacatgaggttgagcgtgcaagtaccactgattgcacaaaatagaacacatgttgaaattaacaagagcataaaaaaagataaaacacatataaaaaataccactctggaagcaatcaattaaaataatgccttgagtgcatgcaattatgtagagtgaactaacctgctgtttcttcctgccaacagttgagacatgacaatgtgataagtccttggaaggtagatggcagtatattaaagtattgaacatacgagagatcccatatgctgtttattgctgctgccagacctccacccattgtggacagcatcaggaagctgaactggcaggattctgtttgtctaccaaccagatgatgctttttcttgcacatcaactgaataaataggcctcagcacaaagctagactcatcaaaccataagttacatttcctcctcatctcttggtttcaacacaaagaggcagagttctagcaacagacatggctttccaccaaagatcaattagcttgccttcaaggcctctctccaaggttgaagatgagttgcacagcatagaggcatgtgtctcatcaccctccaagaccatcgagatgatctctgatggtttgaggaggcttggtgatatatatagctccattgaggagatcatgtgcctacctagcaaccaagtttgctcatcacagcaaaggaagttgtttgacagagagatggaatgctcccttgagctactagatctctgcaacgctatgaacgaggtcttcaccgagttgaagtccatcatccaagatctgcaagtgtctctcagaaaagaagatgatgcagttgttcaagccaagatcctgtcatacatcgggctggtgaagaaggcaaagaagcattccaagaagactgtgaagaaggttgcctcagacatggaggactccaagaaggtcaagctgttgagcaacgctagacagatcactacctctctatttgaatcaacactggacctcttgtcaaagcaaattgtgttgccaaaattgtctctcatctccaaggcgttccagaagaagaactcggtgatctgcaatgaggagcagttgcaggcattagagtgctgcatcggagatcttgaggctggagcagtacttctgttcaggagattggtccagagcagggttactctcctcaacattcttagctcatagatgagtcaagatctgacactcttaagaccctgcgatcggcatctgtcttttaaaggatttgctgatccttcccatttgtatatgttataggctcactgtacagaaaagaaaacacacatgaaagagacaaaattttgatctaattcttgccctgcactcagtcctgacatatctctgagatacatgatgtgattatgcaagcgatatcaatattattgcctttgtgattaatatactttgcatgacaagggcatggcacatgaattatgaaatatatgtaacgatattactttgatttcttttctttttacagtcaaattgatctatggtataccatggggcaatgaaatggccaagtgggtcatgtcactacgatgacatttgttgcctcactagcaagcaaaggatccatgtaaagtggatcttgctgctgcagctaaaacaagccaactacaatacatgagattaagcgtgcaggcagcatggatctagctgcagcagctaaaacacgccagctaccaaacacgggactaagcgtgcaagagcctctgattgcacataatagaacaatcagttgttaacaagagcataaaaaatagataacacatgtaataacaataacactgttgtagcaatcaattaaaataatcccttgagagcatgcaattatgccaaaaaccacaggtagagctaactaacctgttggttcttgctgctgatagttgagacatgacaatgtgataactctcttggaagatagatgccagtacattaaaaatgagaacagaacacgagagattccatatgctgtttattgctgctgccagatctcataccatgatagacagcatcagggagctgaactggaatgattctgtttgtctaccaaccaaatggtgctgtgtctagcacatcccctgaataaataggcctcagcacaaagctagacacatcataccatcagtttcctttccttctcatctcttggattcagcacaaagaggcagagctagcaacagacatggctttccaccaaagatcaattagcttgccttctaggcctctctccaaagttgaagatgagttgcacagcatagaggcatgcatctcatcaccctccacgaccatcgaggtggtctctgatggtttgaggcggcttggggacatctacagctccattgtggagatcatgtgcctgcctagcaaccaaatttgctcatcccaacagaggaggttgttggatggagaaatggaatgctcccttcagctactggatctctgcaactctatgagtgaggtcttcaccgagttgaaggtcatcatccaagatctgcaagtacatctcagaaaaggagatggtgcagttgttcaagccaagatccagtcattcatccgcttgatgaagaacgcgaagaagcattccaagaagactgtgaagaaggttgtctcagacaacgactgcaggatagtgaagctgatgagcgaggctagagagatcactacctcactattcgagtcaatattgtacctcttgtcaaagcaaattacaatgccaaaatcatctctcatccccaaggcattccagaagaaaaacctggtgatttgcaatgaggagcagttgcaggcattagagtgctgcatcggagatcttgaggctggagcaggacttctgttcaggagattgatccagaccagggttactctcctcaacattcttagctcatagatactcctcaagatctgacactcttaagaccctgcgattggcatccgtcttttaaaggatttgctgatccttcccatttgtatatgttataggcttactgtacagcaaagaaaatacatgaaaagagacaaagttttgatccaattcttgtcgtgcacttgatcctcgcgtgttgcagagttacatgatgggttatgcaattcaatgtcaatataattgccatggcatatgacttatgaaatatatgggcaagttagcgatattactttcatttcttttatttcttacaggcaaattgatatatgatgcgccatagggctatgaaaaatggccatgtgggtcatgccagtctgatgccgtttgttgcctcactagcaagcaactgatccatgtaaagtggatcttgctgctgcaggtaaaacaggccagctccaatacacaaggttaagcgtgtaagcggcatggattgtacacaatagaacacttgttgaaattaacaaaagcattaaaaaatagataacacacttggcaataataatactctggtaacactttattaaaataatcccttgataacatgcaataatgccaaaatccaccggtagactgaacaaacctgctggcttttgctgccaatagttgggacatgacaatgtgatagctgacttggaagatagacgcagtgcattaaaatattgagcatacaagactatatgctgcagccagatctcaaaccatgatagatagcatcgggaggtgaactggcaggattctgtttgtctaccatccaattgatgctgtgtgttgcacatctctgtataaataggcctcagcacaaagctagaaacatcaaaccaaaacttccctctctttctcatctctcagactcaatagggagacagagttctagcgacagaaatggctttccgccagagatcaattagtttgccttctaggcctcactctaaggttgaagaggagctgtgcatcctagatgcatgcatctcttcaccctccacgacccttgatacaatgtgtgagggtttgaggaggcttgccaacatctatagctctattgaggagatcatgtgccttcctagcaaccaagctttctcctcccaacgaagaaaattgttggatggagaaatggaatgctcccttgagctattggatctatgcaacgtgatgcatgaggacttcacagagttgaaggccatcattcaagatatgcaagtggccctgagaaaaggagatgatgcagctgttcaatccaagacccaatcatactaccgcttgttgaagaaggcaaagaaacatttcaagactgcaaagaaggttacttatgaaaaggaggattgcaggatggccaggctattgagggaggctagagatatatcaacctctatgctggagtccacactgcatctcctgtcaaagcaaatcgaaatgcccaaacaatcacttgtttccaaggcattcaacaagaagaaagtagttatttgcgaggaggagcaattgcaggtgttagagtgcagcatcagagatcttgagagcggagcaggacatctgttcaggaaattggtccagagcagagtttctctcctcaacattcttagctcatagatactccagaatcttcactcgacacccagcgattggcatccgccttttaaaggatctgctgatctttcacattgtatatatataagtagaaatgtacagaaaactccatacataatagtgaacaaaagttttggccaaactcagtgtcatgaaaatccttgcatgcttctgatttcaacctctatgcgattatccatgtcagtactgttgcccttgtgcagttgtgctttgctccgaacatagtctgcaaaagaaaagacagcatgtgatctgtgaaatacgtgcggaattatttgatgacgccaacaaaaaaaaaatgttcgatgaatgcagaatcacaaggaattatccattggccctgaacattcgcttgtctactcaggtctcaacaggatggccgcgaaggattcggctgggaacgcaaggcattgcgaagataccgcagataccgtgtgctattgagttagggttagtgggatacctccgccagaactgatggagacctccgcgatcttgtcgggggctgccttccagggcgggggtagcggcgggaagggtggtcgcggcctcaccggcagccggcggcgagcggcgcatctcctcgctcctcttcttcttctccggtggggggtggtggcgagtggtgagacgaagacacgtggattggggaacgagtggggtactgagtggattcatgggcttcctgtgggccggatggtctcgctatccttcagtttggcccatgaaactacattgccaacaacaattctttttctgtaaaaatttgaacaactctgcatagttagaaaactatttatatcttgtagtatactcttatatagggtctgtttagattggtgtcgaaataaactttaccaaaattttagcaaattgtcaacattgccaaagttttggtagaattggcttattaatgttgccaaaattatatacacattgtcaatatttggtaacaaactaaacgtagctacataattgtcaattttaccaaataatgctatggttggaaatgtcatcaatctgaacatgcccatagatatggttgaaggggtggagtcatttgcagccccattgtttctcttattcatatgcttatccgaatcgcttatttttaaggaaaattgttatatacgtgtccttagcgatttaaaaacaaatgttgtgaaataaactacgatgaaaaaaacaaacaaatcaaattcaaaatttagttctaaaattcaaattttataatcataagtcaaacaatactccctccgtttcacaatgtaagttattctagcatttctcacattcatattgatgttaatgaatctagatagatatatgtctagattcattagtatcaatatgaatgtaggaaatgctagaatgacttacattgtgaaacggaggaagtaagacatttgaagtcggcgcggctataaatatagatttttctttctttttgcattgtaaagcgcttctttttttcatgttcagaattaagggtttacttaagtacatcattaatcaagtcttaaaagcaaatgcaggaaacaattaataattttgttcctatcatttgatttattattaaatatacttttatgtatacatatagttttacacatttcacaaaagtttttaaataagacgaacggtcaaacatgtttaaaaaagtcaacggtatcaaacatttaggggaaaaaacatttagggaaaaggagggagtagatcaaaatagcgtactaatgttcctgaacgaacgcgaggacaagcgagttggtttgcaacttcgcattatcgcatattagacgcccttgtggattatttgcggacgattaataaaaaaaaagttagcaaacatgacagcccgataagcttagttattgttcaacacacggatcatctcgagattgaggtgaaacaaaccagccatgcgcacgaaggcaattatggatggaatcatcgtgtagtaatacagaaagcgtaagccaaccaaatacactgcgatatctgcttccaacggacagatagatgggagcgtatcctatgcacacagaccctcgcatgtacacaccgtgtacagcaactaaaaattatcacaaaaaattaatacatgtactttcaatagtattacatctacgtgcaaagtcacatcttcaaattcattctacatagagaataacaaaaaagataaaattctgacaaaattgcaaccttaaaacaatcagattttttgtttttttgttacggctaaaatataatgaatttaacgttaagattttaaccctaggtgtaatacaattgaaagtatgtgtatgattttttctaaattttttattgacattttttagttggtgtgcacgtgtgtacacgtgagggcctgtgtgtataggatatgtttccaagatagatatgcacacgaggcaaagtcaaactctttgcacggttgcaacagcaaccacagctcatctcttctcactgcattgcattggcattgcttgctcatcacagatctcacacgatctggacctggcattaaactgaagtttcacgcgctcgtgcagatgagtgtttgtctccagtttcaggtgagacatgacagctagtcatctactagtattatctcacaagttcattcaatcagtagagatgctgcctcttgcatcgagcaaagcatataatgatagagattaaagaaacagaaacctgttgcttctgtagttctgttgcagcacaagtgatcgtcaattatcaatgagattctttctgtctgctggtccagcaatgagacctgcttctccttccttggttatatatacagagaagccatggtttggtgtcgacaacattgcgaagcagtcttgagttatctcctcttctcttccaattccagagagaaacaagtcatcagcttccatcccagccatggcattccacctcagatccgcgagtgcgccttccagccctcgctctgccaaaaccgacgtcgaagaacagctgcagagcctcgaggagatcgtctcctcaccctctgcaacaattgaaacaatgtgcaatggtttcaggagacttacagatgtgtacagctgcatggatgagatgatgtgcttgcccagcttcaggcttcagcagaggagagctgtggagcaagagctggagcggtctctcgccttgcttgacctctgcaacgccatgcaagagagcttctctgagctcaaggcgagcacccaggagatgcagttggccatcaagaggggtgatgatgcagcagttcagtccaaggttcaggcttacacccgcctgaccaagaaggcgcagaaacagttcaagaagatcaacaagaagtctgcttcagaagaccaggagggttgcagggtggtcaagctgctggctgatgccagagagatcgctctctcggtgcttgaatcaactttgcacctcctgtcaaagcagattgcgatgccaagtcaaagcaagtggtctcttgtctccaaggcattccagaagacaagggttacatgccaggaggagcaattacaggcgttggagttggacatcgttgatcttgagagcggagttgagactttgttcaggagattgatccagagcagagtttctcttttgaatgctcttagcttgtagatagatcatacaccaactctgatcccctgtgattggcgtccgccttttagaggatttgctgatcattgaaacaatttttggatgtatagtagtgtacataaatgagaggaaatgtacagaattcactcgaatgaaaaacaaaggatttttccttctgtcttatttcactgtcttacttcccttttcccctcaatcgacatggatggcaggtgaacaatcatctatcattttgaatacttcagctgaagcttgttcaagagggcacatagcaatttaatcagaattttcttcatctatcttggttgttataataaagaaattagtataattgcactgttcaaatattttattcgcaaagcttttaccgtgagatggacacgtcattgctattcacatgagatgtgcctcaagaacaggcgcaagacccttcttcaatggatattgccatgcatataattgatagcagcatgacagattgccagttagccggctgatatagttcttgataaattgttccgcaagaagatggtggatattgccatgcatataattgatagcagcatgacagattgccagttagccggctgatatagttcttgataaattgttccgcaagaagatggagtagcacagatggcaagttggaaacaacacaactcgattagcattctccattaaagaagtgctgcagcatgcatgtatgacaaggctctgcactatgactacgagttagctgccatgctgattcctgctggcaataacacactatgatatctgcgaccagcaacagatgacacatgatgtcaagtcaactccttctttgcacggttgcaacagcaaaaacagctcatctcctctcactgcactgcattgctttactcaccaatctcacgatatggatctgatattaaactaaactgacacgctcgtgcagatgagtttgtcttcagtttctggccagcgaggcatgatagccacctcaatgcaagctcaattagagaagagatgctttgtgcattgagcaaagcatacaaatattaaagaaacagaaacctgtcgtgcagatggtggcttctggtgcagcacaaggcttcgccaattattagagagattctttctgtctgctggtccagtaatgagactgcttctccctccttcgttatatatagagaagccatggtttgctgttgacaacattgcaaagcagtctgttctcttccatttctagagagaaacgagtcatcagcttccatcccaaccatggtattccacctcagatccgcgagcgtgccttccagcccttgctccaatgaaaccaacatcgaagaacagctggcgagcctcagggagatcatctgttcaccctctgcaaccatggaaacaatgtgcaatggtttcaggaggcttacagatgtgtacagctgcatggatgagatcatgtgcttgcccagcagccaagctagcctttgcaagcatcagcagaggagagaagtggagaaagagctggagcggtctctcaccttgcttgacctctgcaacgccatgcaagagagcttctctgagctcaaggcaaccacccaggagatgcagttggccatcaagagaggagaagatgcagcagttcagaccaatgttcagtcttacacccgcctgaccaagaaggcacataaacagtgcaagaagatcaacaagaagcctgctagttcagctgatcaggagagctgcagggtggtcaagctgatggctgatgccagagagatcactttctcagtgcttgaatcaactttgcatctcctgtcaaagcagattgcggtgccgagttccagcaagtggtctcttaaggcattccagaagacaagggttacatgccaggaggagcaattacaggtgttggagttggacatcgttgatcttcagagcggagttgagactttgttcaggagattgatccagagcagagtttctcttttgaatgctcttagcttgtagatagatcatacaccaactctaatcccctgtgattggcatccgccttttcgaggatttgctgatcattgaatcaattttgtcatgtgtacataaatgagaggaaatgtacagaaatttatgcgattgaaaaacaaaggatttattccttttgtttaatttcactgtcttccttttccccctcattccacatggatgtcaactgaacaatcacctgacattttgagttcttcagatgaaacttgttcacgaaaggaaatagtaacttaataagaattttcttcatcgatcttggctgttataatatagagatcagtagtaatgcagagttcaaatattagatttacaaagctttaccgtgagatgcccatgtaattactattcacatgtgacgtgcctcaagtacaggcacaagatccttctgcagtggatcttgccttgcatatagcaccatgacagattgccagctcgtacggttgttgataaattattctgcaatcagatgggcagcacagatggcaagttgcaataacactactcgattagcaatctccattggataaatgctggagcttgcacgtatgacaaaggctcaacgctagagtaagctgccatgctgattcctgctgccaataactggaacatgacattgtgattcagttaggcggcctaattgaccagaaatttggacagcacgtggaatcatcttgagattgcaacagatgctaaatgctgtgagcacagcaggcaagccagtgatgcaatgctgcaagatcagtgagcagattctaccagataagaaacacggtttggagcctggagagagaagtcaactgctgctcctgtgagcaaggctcatccttctcatgatctggatctgaatattacattagactatacacttgtgcaggtgaacttgccgccaataatcaggacatgacagcattgtaagctgagctagagatgcctctacacttggttgggaaacataaaaaaacatcagcctgtcgaggagatgggtggcgtctgttgcagcagcaaagcacttcattattattgagatttcattgttgtctacacggtgagggatgccattgcttctgcctctttgtctatatagaggaaagctatagccgggtcgacaccattgcagcacagcattcttctcatcttcacttccacagagaagagaaaaaggataagcttccactgcagccatggcattccacctcagatctgcgagtgtgccatccagcccttgctccaatgaaaccaacgctgaagaactgctgcagagtctaaaggtgaccatttcctcacccagttcaaccatcgagacgatgagcagtggctggaagaagcttgggagtatctacaactgcatcgatgagatcatgtgtctgcccagcagccaagctctcctttgccaaccactgcagaggaaagcagtggagcaagagttagaaggctctctcgtcgtgctagacctctgcaacgccattcacgagagcttttccgggctcaaggcatgcatccaggacatgcagctggctgtcaagagaggagatgatgcagctgtccaagccaagatacagtcttacatccgcctcgccaagaaggggcgaaaacagttcaagcatatcagcaagaagtcttcttcagcagatcaggagagctgcagggtgatcaagctgttggctgaagctagagagatagctctgtcaatgctcgagtcgtcatcacatctcctgtcgaagcagattgctttgccatgctctagcaaatggtctcttgtctccaagacattccagaaaagaaggcttgtctgcgaggaggagcaattgcaggtgttggagttagacattgttgatctagagactggagtcgagaatctgttcagaaaatcaatccagagcagagtttctcttctcaacattctcagcttgtagatagatcatacaccaactctgattccatgcgattagtatccgccttttagaggatttgctgatcactggaacaaaattttgatgtgtacatatatgaaaggaattgtacagaaactcagttgagaaacaaaaacaaagtatttgtccacttcctattgttgattacactgtttatgaatgtttgatataaatacctaattttctaacaatatgctcatcattattgactgttagagaagcagttagcagaattttcaagttcagcttcgaaatgatttactatgatacggcctcgctattcagatgctatgtgctaactcaacaagaagcaaaggatccttgagcagtggatcttgctaccagagctaagacaagccagctccaatgcacgaggttgaatgtgtgagcggcatggattgcacataataaaacaatatttaaattagcaagcacactaaaaactagaagacacacctatcaccaacaatactcagtaccactcccttaaagtaacatcttgaaaacgcaataatgtcaagatccaccaatagagtgaactaaccttctgattcttgcttccaatagttggaacatgacaatgtgatagttcattgggaggatatgtagtgcactaatatatgcagctacacatgagtgacagaatagattctatatgctgctaccagatctcagaccttgatagacagcatctgggagatgaactggagggattctacttgtctgtaaaccaaacgatgctgtcccgtgcagttcctctgtataaataggccttggcagaaggccaaacacatcaaaccaaagcttggactctccttcccatctcctcagccacaacacaacaagaattacatcaacagatatggcttgccaccaaagatcaattagcttgccttctaggactcactccaaagttgaagaagagcttcacatcgtagaggcatccatctcttcaacctcgatgaccattgagatcctctccgatggtttaaagaggcttgaggatatctacagctctgttgagggcatcatgtgcctgcctagcaaccaaatttgctcatcccagcaaaggaagttgttggatggagaaatggaatgctcccttgagctactggatctctgcaatgctatgcatgaggtgtttgctgagttgaaggccatcatccaagatatgcaagtatctcttagaaaaggagatgatgcagttgttcaagctaagatccagtcatacattcgcttgatgaagaaggcaaaaaagcatttcaagaagactgtgaagaaggttacctcagacaaggaggatgacaagatggtcaagctcttgagcaaggctagagagatcacaacctctgtacttgagtcatcaatggacctcttatcgaagcaaatcgcaacaccaaaaatgtctatcatctccaaggcattcctgaagaaaaactcagttgtttgcagtgaggaacagttgcaggtgttagagtgctgcatcggagatcttgaggctggggctggacttgtgttcaggagattggtccagagcagggttactctccttaacattcttagctcatagatactcctctgtcattcttgatagcatgtgatcggtatccgccttttaaaggatttgccgatccttcccatttgtatatgtagtgtacagaaatgttcatacatgaagagacaaaagttttgatctaatttgtgttgtgcattcaatgttcacatactactgaggttcacaatgtcattattccatgagatgtctgcactattgcctttctagtgaaaaaaacaaaatgttggcatagttcatgttgccaatttactatgacagaaccaccaatctcactaatatcaaaatggtatcatatatatacgtgaagtcaacaaatatgcaggacatttgaacagatgaaaatacatcaatagaaaaagtatatccgtgcttcagtaacaaaagtatattttttgtcttatgagaaaatacattttggtgcatctatctgggatggtagtgcagattttttttttcagggatagagattaagcttagttatctgatttacaaatagtagtgttgtttcaacaactcataatgattgtgatttgtacactgatacactccttatgaggtggatctggcctatataggaaatatgccagctccagccgcaaggtctaaaatagaagtaaacaccagagttggtctgatatgtgccaatcataaaggggaaaagaaatcaaactttaacccccacccccacccccacccccaggtaataagcaaaacattcatttggaatataaaatgtgcggtacactatttgaggctagaaagctttgctgcttatggctcctttgaggatttgaaattgatctgttgcaacacaaatctaggacattaacacacaaaatttatggtattaagtagcaagattgtatttatcactggatgtcatggcctcatttgtttcctcttcataggtaagccaggtaggccttctccaaaggtccaaggaaatttcatgtgcatctctttctttaattgttatgcaatttttattgtttgtcatagtacagattaaaaacaataattcatctttagtctatcccaagataatacaatacattctggttcactagtcatgctaaaacgcgtgattatagaaaagcagaagctgactgtgaattcatgaatttaggtctgatctacacaaactccaggtctttgatagttgaatagttgagatcctatatacatgacctgatagttcaatagttgggattctgtagacataacctaatagcatgcacttcttgcacataccacaacaacagatatacaagaaaatttgtattcactcatctgtgttttgaagcacagatctgcatcagaaaatatatccataggtttgtagatatccttcttgtcaaaagaatatgtcagtttgcttggactgtgccttgagatccttcaatttttttaaaatgttagtgaagtaatcttgcaaatacttctctaaggtgagaatatcctttgaatctaccccaagaagctggtatgtatcattcattggaactgagaaaattgtgtcactggagaggacctgaattataacaattaaatactagttattaattttcataagccttgacaattttataattactgaaaaatcaagtgcactatttagataagtctagagtgtaacctctgagaatgccagtctgtcagccacatcatttgtccactggaagaaccgtgtcaactgacgagtaaatctcaacactgcaacagggacagtagtaacgttggcatcttggccagccaaccgctcacacagtgtaatcacctgagtaaaaaaacaatacaatagttgagtaaatgatagtattccaactctcagaagccatcatttggtacattctgacattgaaaacgaaattaagagcaggaaatacaagattagtactcccatctcttgaagaattcatgacattttggacaacaatatagtctccacatgcaactttgacctttacatttatatgaatatgcttgtgaacataaattagtatattgcaattttttccattgaacacgcagaagagctctgtgctatttcattaagaataaataatatagtactacaaggggagggttaggggttaaaagcccttcctatccccaaaatataccacataaacacacacacacactggaaaactaaaacagatgcgccacagaaaattccagcaaaaattttcatgacaggctttcatggaagccaaatatgtacatatgacaagcctaataccatttgatatgttggtggacaaagataaggaagttcagctgcacattttgcaaaacgacatatatttctgacagagggagtatatttccagtcaagaataaacatgctgtgcaatttattcatggaaaccaaatatgtatttacatccttaaaaaaagaattgacgtcattagaacagtgtacagtatactacctcttgagttgtccaggcacgtggtccggcaaaagttaagagcttcttgctagccttctcattccgcatggcaataaacgtcagtcgagcaacgtcctacaatcacacgagggatgttgtatcaaaggaagggactttgaagagataatgttacaaataggtcacatattcatctttcaatggagaaggagaaagataaacctgggtatccatgtaagcaatccgggtaggagcatcagttccccatactgacttctcttctagtatgggcacagcatattgcccaattaggccctactcagaccaacatttgacagaattcgtttcaggaaacaattaactacccttgtttatattcgaaaacaaatcaatttcctggccaaatatatagaaccccacagaaggaacacatttacctgcatgaaaccacacaaacggatgatgagataatccagaccggcatcctgaataaacttctctgtacaatgcttgatttccatcaagggaacctccgggtgcttgtcacagttatgaatagagtagaacacatacttttgaattcccatggccttagcacattgtattagagcaacctttccttcccaatctacctaaatagaacaactattagcaaaacggaaaccaaattcactcaacgactctacagcatatatgtcacaggactcacagtataaggactacatcacaattacgtgatatattaaaagcaatgtgattagctttagtcacgactcaacaatagtgcaaatacacttcagcaagaatcaacttcaggacaggaatacagaagtatcacattatgcttaaagaaatgctaacaacataccgtccgaatgggctcttcgggacgccctgtagcacaatcgatgacggtatgaataccaacaagcgtcgcgggaatggtctctggcttgctgagatcggcctaaatcagcaaacagaaatgggcatgaggcggataaacattgaacagtgaggttgatatagcagcaaggaaaacagtggaaacctacattgaccacagtggcgccccagtcgcggaggaaatcggccggcgccgggcggggcctgacgaggcagcgcacgtggtagccctcgtccagcgcccgcctgaccacctgccgtcccagcgtcccggtggcgccgaccaccaggatgctggtcggcctgacgggcgtgccctgcgcaatgctggtcgggaccgccgtctgcgcgttgcaggtcaccaccagcctgcagcctggagaaccccccaaacttcgtttacctcacacgatcatccgcaactgcaggcgaggggaaggcggaaacgggataggtattgtacctttggcggtgcccgaagaagggggtggtggtggtggctcgcccgcgcggtagcggaccggaaaaggcgggcccggcgggcggggaaggcgagctgcgagggcagcgcggcgaggctggtcgacgacgccatttgcgcgcgcgagagagagagcgtggagaagtggcggcgtgggtcgtcggggttgggtttttggttggggggagaggcgggcgaggagtggcggagaggggatgcggagtagccgatggccgtcgcgccacgtctaccgccatcccgtcatccgttctgtccacgtcaccctcctgtttcctctgtctctcttttttttttcttcaccgcagacgtggactctgtgcaggaatgctaattggcgcgcacgcgccggcccacacggcccaatagacggcaagacacggttattttttttttccgaatttttccatatatgtgtaaactttcaacccagatttgaatacttttaactctaacttgaaaactttcaacttcaacttgaaatctttcaacttcgacttgaaaactttcaactcatatttgaaaactttcaactcagatttaaaaaattttaacttgagattcaaaaacttttaactcagattcgaaaactttcaactcgagatttaaaaactttcaattacagatttgaaaatttttaagttaagatttgaaaaaatatgaaaactttcgactcagatttaaaaactttcaactcaaaattcgaaaacttttgactccgattcgaaaactttcaactcaaatttgaaaacttacaactcagattcaaaaactttcaactcgagatttgaatactttcaaatcaaatttaaaaattttcaagttaagatttaaaaactttcaactcaaaacattttataaaaaaataagtgtgctaaagattaaaaaaagtaataagaaagaaaacgaaaaaaaccgaaaacaatcgcaaaagaaaaagaaaaaacaaatcgcgaaaaaaaagggctgatgggccttaggccgggagcagctggtgcgcgcgccaactagcaacccccgactctgggctggtttggtttgtggcctaaattaggcttaccaatttttggcaatttcaatagtgtttagtgtctatttggtttgaagccaaattttggcatgcctaagaaaataggccatttcaatagtgaacttaggctattttggcttcaatccaaacacaactttgccttaccaaaattagtcatgccaaaacttgccaaattttggtactaataaaatttggtaaggcctatttagaccacaaaccaaaccaaccctctgcttccttttttttaaccgtttttatacggaatacgtggacaaacagtttacagttagacggagtcattagagcacccgcgatggtaaagtaaagtgttctctataaaacatgtacatctcagcaatatactagattaatagtaaaccacctcaatagtatgtctacatgggtatctatagctctctcatgcattgcctcgtttttctctatagactatctctatgttagtagatagcttcgctctctctctcttcatttaatatcttccaagtagaaaaatatgctgacatggatctcttgtagagagcttatagataatcattgcgggtgccttagtatccaagtaatatacaggtggctatattacatttgcgatgacaaaattaatgagttagagaagaaatgggtgaagggagagtgagtaggtcacttaaataatcatcggtttctacagcactcaaagacacttaaaggctagataaaacgcatcaggtcagcttttattgacccatgtgatgtagagatactgagatagtggtgacatcattgcacaaacaacaatattgcctcctttgggacaacaaacatgagagtgtatgcatcacgccaagagttacccaatgttgtacattgtttgttctgtttttcatggttgtcatcaacaatgttctcatttgtagcgggtccatgtcagtaaccgtgcataggcgcgcgcgcttgaattggcaatagaatagtcgctcgcttctctctctctagtccttctcttcttacataagcaggctattatcttgcttactctaaagtgacggtgcttgatatagagtagtggtggtactctgtttttagactttgcaataatactctctgtcaataatgatcagcggcggagctagggcccggcgaccctgggcacttgcccgggcttcggcgccgcaagcatcatttgattagtgctaatttatggtgcttagccacggcatgaagcagtataagcacactatttggttgggacacttaataacgtgtataagtattagagaacatacttagccacagcatacaataactagcatgctgcatgcagtagtataagtacgttttaataatctgttagacataatcatctagggtataacctgaagcaccagaattatttactagctagattgttgtacccattacttgagtgtaagctattagacatctgcaacctgaaagcaaagtaaattttctagcaccattataatttttctcttttcgggataataaattactaagtcccatagcctgcaaaaacacaaccatgttttcctctaaattagaatagataaaaaagttgttgtatggtacacaatctatgaagttatgtgtgatttgttatatatccgttggcgtaacaggctcacacaaatttctagatccgcattggcactgataatgattctggacgtcgtccactcgttctaaccttgagaaagcccggactcctctcacctgctgctttcttctcataaagaacaagtgctgaaattttgagaaggaaatgtgtgacacctcgaaaatcgaaataattgatggaaaaaagttttgaaaagctagagctagcaagctgttggccgatatatctttgatggtcgatggctgttgggtttgtgggcttgtgctaggcgtcccagctactcaggctgtaaggggtttccggcctatgtgcggcccatattgcatgggccgcaagtccggaacggactgtaacttccttgcgggcccacactaggcgatcgtagatgggccgggccgtattggggagccgaatcctatttgaacggcctacctacctttcccaacgctcacgtctaaccaaatcttttccgcttcgcatacgtagaaaacgtaaaccattgaccatatcggacacggtctcaagaagttcgtttccatgtgtacgaaacgtattctttttctcgataagaagtgtagaaggcgccaggtcgccgtagtctcgctcgtctccgtgcattccgcgatctccgtgcccgtcgaccaccgtggtgctcgccggcgacggacggagcgagaatgcagggcggatctagcggcatcgtctacggcggcctcaagtaccaggcaagccttctcgaaccttctagaacagtctcccgtaggggggcgcccctcacccttgcaccccactcttgcaggcgcggtgcatcgccgacgtgcgcgcggccgccgggtcgaccaccttcctcgccggaaccctcagtctcaaggaggagaacgaggtgcgtctcctggaggagggggggagggctctccgccccaactcgtcttcttccatcgactctggctctgccctgtgtgttgcagcaattcgagcaattgtagaagagaacgttgtgattggatctctaactcgttgttgctgccaagtaggtgcacctgatccggttttcaccggcggagagcgagctggtgtgcgacgggctgttctaccatccaaacgagatctgggaccttaagtcttgccccttcgatcatagggtcttctccacagtctacacgtctggtaaagaaagaattcccctctttgttactctctttctgccggtgcattgggcatttcatctagttgtaaatttctaaaaatttctttatgttatgatatggatggaaggcgagggctatggtgcatctgtttggaagatcccggagctgcacgggcagtcgaattcgccgccacttgagcagcttttcacgcttgatgagcacacgggcaaaataagatggtgcgcgctcttgtttctgttgatgttctgtgctcgcttgttctggtgccgtttagtcttattgctgtagagtattttgccgcttgttgattttatacatactggtaagtagtaaccagagtctagttgaagaatgcaactgtatgctgatgatttgcaaagcccaaaaagggtctcttattttggggattagtcgactcacaaaaacgatgactgtgattttaccaatgctactttatgaagcacattgtcatgagaaggttatacaccatatagggttcagcggatatttcaagttttcctagcataccttacttgtttacaacacatagctacaattcgaaggccaaagcaacataagaattaattttggctcgtccgaggttctctatagggagcacacaatagatgaaattttaatatttttatttaccaataccattttttgatctaaagttttagataagttatgacctttcttcacagtcttataacaatgtataagctcctttaatacattgttatttctggtggataccatgctcagactgtatctgtaagctggcttatctttgcagtgttctctggtggccactagggaagcacgacaagttaattagtattgatgacagaaatattttcctctggaatatagatgcatcaaataagtcagccaaggtgtgcccagcatccttctgttttaccaatagtacatcgacataattacgtgatattacattgtttctaagcattatcttcgcacttcagtgtcaactttatggaaacttacagttctgtatctctgttagcagaagttctgaacttaatcttgtcctaacttgaattcctaagttacaggtgatgcaaaaggggtctgctgacatgcttcccaatttacgtggtggatcttgggatccacacgatcacaattcaattgctgcaattactgattcctcacttcactgctgggatctccgttctatgaagttaataccttcacaatcttgacatattagatttgttgatctagtgtctgtggtttagatgctgaaatgttccacttatatctttatctgtgaacttgttcttttcaggaaatcaaatgcaattgagcatgcgcattttcgggatgtggattataaccccaagaaacagcacttaattgtgagtggtgatacttgccgtacttcatttcaagtgtttcagatcaagccatagttcgtttgcttaagtcatggttatgaattagtactgaagagaaaaacactgttgtattacttccgttttctttgttacctgtcaacttcgtttcgtctttgttttgattaaggatcctgcagagattatttttcttacattagtaggtactgtgtggtatcagctgtgccgctacttgctagccgttacttcttttattgttcaatgaaactaaacactcggatttgattgtgttatctagctgaatcattgaaccctatttcagaggttgttgaatcagacaattgtgcaattaacggttatagtgataggtactgtttatttttattcagtttaatttatttatggttccaataaaagatcctttatgcattgtagacaacagcagaagatgaatttggtatccgtttgtgggatctcagaatgcttaagtatcctctgaagaatctccctgggcattcgcattggtatatttctatatcctgttttactcagattagaatcctttcgattcaatgtttagttagtcgacccttgtgaattttgcaggacatgggctgttcggcacaatcctgagcatgaccagttgattctggtctctccctctctctctatttcttcaagtggtttgcatattgtgatgtactgttttattgtgtactgactacattgtaactcctgtagagtgctggaacagattcaactgtcaatttgtggtttgctaaagttggcactgatgactcaggacctgaaaggtttctattccttgtgtattttcttgtttggttactttgtttgttataatcttgatgcccacattcttgcttatcagtcctcctggttcacccacaagagaagaagaaccattactaaattcatacactgattatgaagatagcatatacggtaccctcaggaattcctacctgtgtttataattctacgttataattttgacaaggaatcacacagcgtattaaaaaattgtaggtattgcatggagctcccatgatccgtcattatttgcttctttatcttatgacggaagggtaagtacctgcagcatttgtatgcttatttgaaatatttgtcttgtgattttttaaagccagtttatctgatatctgaatcttgactctaatgatctgtgataatttcctctaatggtcaggttgttttagaatcagtcaagccctacttgcagagaaaatgaagctgcatgttctctccgttgtaagggcacataactccacttctttgctcggtatgttgttgatgcgattaccaatagtaccttctcttgttctaacagaccttcccttttctgctcaagcagacttgtttgttgtgcatattattggtgttgtagattttctccttgccatcctatatactgtactctggtacatggagttgatgcgatggcctgattcgacagcttgtgaccccagaacaatagcaagccaataatgtttcagtaaccatcttggcagaaatccagtgtctcatatgatctgccactcttgtgattcaggccagctgtaattgcaaaattcagcctggtacaattgccaaatactgctcctcgagtgattcttgaatgtcatatatctgagaaaggttggtgtcaattgttgcgttatgtggtgaagtacaaccgatctgaattttgtagaactgttgagattgacaagatctgagcttctgtttttcattcgatttttcactgtatgagtggttcccttactttagcaaagattaatatttcgtctgtatgttacaaaatcattcagggaatgagcaaattaacttcaaattgttttgggcatgagccacctacgaacttgtcatgcgttcaggacggcaggctcacatgctttcagcatttctttttcgcgaagattttgtcgacagtttctttttaaatcatatgtgttcgctgataccccctccgtttcaaaatatttgactccgttgatttttttagcacatgtttgaccgttcgtcttattaaaaaaatttgtgaaatatgtaaaactatatgtatatatgaaagtatatttaacaataaatcaaatgatatgaaaataataaataattacttaatttttttaataagacgaatggtcaaacacgtactaaaaaatcattttgaaacgaagggataaatttgttttagaaaatgatcaaccttttttaatgaaaaaaaacaaatcaacattttgcttgttttttttagtctggtcccatctgtcgccaaaatcctgaacggattgggattcggtgacatcaaatgagaatgtcacgggagaatgtcaccgaatccctcggtgtcacgggagaatgtcaccaaatcccaatccaacccgaacacacgcagacattcacgtttcctccatgtgtcatcaatgatggtagagaaattcgtgcttcaattactccattaaagggcaagttttaaccggaggattacagaaaaatttcgaccaatttgtactagctaatgtgaatacatctcctttacaaatgtacacaaaagtctcaattcctacagaaatcgacaataaatacctgtatccttttttagatgaaatatcttgtattcaaattgcatcgtttaatcgttacagttatatgtgctatgaaaaaaggaaaagaatttgaaaattagtacaaaatttgcaatacggaaatccagtttaatttaatactgcactgccgtacactggaacagtatcaccttctcgaaagttcaaacccactcatcgaaattccacaagtctcccatgtcgccgccgtctcggcgaccaccccaccaccaccgccgccgctgccgtcgcggcactacctccctagcctagcctgagatctccgggctccggaggatggcccagcctcgacggcgcggcggcggaggccacaacaagtgcccgcgcccggccctgctgccggcgggggcgctcctgctcttcctcctcgccgccgtcgcgctgctctacgtctccccgccgccgctcatcgatcacccggccctcgcttcctctcgccgccgctcccctcatgcccccctggtggtgttgcactagtaccccttcctacctgctccccacgcttatcccgatctaatttgtcttgctctgtgcattccgagtgcagctgaacagctccggcggcggaagcacggtggtgtccgagcacagcgagatttcgcgcgttccgataagcgtaagcttctttggttagattaagcgaactaattcctcgattaattgtcagaggttgcgtggttgtgctgttcagaaattagtagatacagtgcacttattccagttctagtgcctaactaattgtttctgggaaatggttgttttaattggtagataatgattcaggttccattccctgtgccatttttgaagcaaattagatgatggcaagctattaaattgagctcttttctattatatttacggagttagattaggatgttctagagtattttctaacttgttatcatgggtttatttatttcctttgaaacacaacttgttctcatgggttttctagatgtgatcctctgagatttgagttaaactgattttatttaatgcgctcaagagtcaagacactccctattttgaaatatagacccatgaaatatgtactcattttgctccatttttgtctaaagtagcatgaaaacttcattgcaatttctcatactgcagaaagaggcagatggcctttggggttctaagtttgcgagcagattctatgggtgcagcaactcaagcagcaggttccttggtgcgcattatttttccactgacggttaaaatttgctcgaactgagtagtgttttagatttgtagtgtgcatgtttctgaggcattctacatataggaggttttagtggcagtggtactattctttgttgtatggattacctgaaatagtcaatgttttaaattgtgcaggttcaagtgttatcacgcaaccagaccgttatttgatgatcgttacaagtggaggcctcaatcaacagagaacaggggtaatatatgtgccacactgttccgtatcaaatactgtgatgcgtgtggatggataggaaaaagaataaaagaaatcagtttgcaaatgtacatgaagaatcaacttgtacacatagattttatgtgatccattatgacaccatgttccatgtaactccgtggtagttatgtgtattctgttgttccatatgcataactatgaccatcttctgcttttcagataattgatgctgttgttgctgcacgtatcttaaatgccacacttgttgttcccaaattggatcaaacatctttctggaaagatgcaaggttaatttgagtattgagcgcttcctaccctaatattctaaggctgcccatgtttctatgaacacttacatttgtatgtgtactgtttctctgcagcaatttctctgaaatttttgacgtcgactggttcatctcgaatctatcaaaggatgtaaagattgtgaaagagcttccagagataggaggcaaactgcggactcctcatagaatgcgtgtgccccgaaaatgtactcagagatgttatgtgaaccgtgtgttgcctgcacttcttaagaaacatgtaagtcattgctagcagcatataatcccaagatacttttaaattatgtgctaattcaccgtcttgatgatatgaatttttgagatcaggaatagaaatttcatattcttggtaggtcaattgactgtactttcgttccactgactgaccattgaccaccttgtgtgacttcaaataaatttacttcttctgttcagagacactcataataccaataccaggataccttatatcattactttcacgtagtgcaggttgttcggctgacgaaatttgattatagactagcaaacaggttggacacagatctgcagaagctgagatgcagagtaaactatcatgggttgagatttactggcctaatagaagaaatgggtgaaaaattaatacaaagaatgagagagagaagcaaacattttattgctcttcatttaaggtacacgcatctcaagttctggtgcttgagctctcatattttggttttcctttaatacaaaactagagagtcttatattcttagtgctgtatttgtgaagaacatagtttctttttctcaggggattacttgaaacccattttaggtcataaggggggcaattttcatctctagcttggattagcaaatgttgggctccttagcatgtttcttttatcatgaataccccagttgagcatagcctggatttgagagggaggatgcacaaaataggatgcatgcacaaaatagtgaagggtgatatctaaaagttgtcaaccaatactgtccaaagtagcctttgtgcgggcacatactcatactagtagaacatatatatggagttccgaatggcatgtcaaaagagggtcctcctgtgctccatctatgtattgagaagattggtctcagatcttatcgataatatcagtcaatcacttgttggtcatgctagtaaagagagaaggccatcatatagcatgctcttgtcaggagaagttcagtttagtggattggctgtgacctttgcttcagaatagaccaccatcttggtctgaagttgtactggtttctgattttcttgtatgagtaatataagtatgttgtctatttagtttgtagtggtttccttttttttccttttccctaaacagtctttctcttgggttgccagatttgaacctgatatgcttgcattttcggggtgctattatggtggtggagaaaaagaaagaaaagagcttggtgcaataccgaagagatggaaaaccttgcatgtacgtatggcatatcattatagtgtattagtacgtacttaaaatggcatatattcttgaccgaactacctactgcaacctcttctttgtttaggctatcaaccctgagaaaggaagaagccaaggtaaatgcccattgactcctgaagaggtggggctgatgttgagggcactgggctacagaaatgatgttcacatttatgttgcatctggagagatatatggcggggcaaggacattagcacccctcaaagcgttcttcccaaatctccacacgaaagaaacaatatcaagcaaagaggagctggctccattctctaaatactcatctcgcatggctgcacttgattttattgtatgtgatggaagtgatgcttttgtgactaacaacaatggtaacatggctaaaattttggctgggcgaaggtatacttctcttctgctactggaagctccctgctgtcatcatgtacttcgttattagttctgaccatctatactgcttttgataggagatattttgggcataagagaacgatccggccaaatgctaaaaggctctattccttaatttcgaacagaagaaacatgtcatgggattcattctcctcaagagtgcgcatggttcagaaaggatttatgggagagcccaaggaactcaggccaggaaggggagaatttcatgagaacccttctacctgtatatgtgaaaaaaccgttagcaaaacagtagccaaatctaactcccaatctgagcaagtcttaagtaatgatactgagagaggaatagccattcaaactgagcaagtctcgagtaatgatactgagatgggaatagccactagtgagcccacagttcctgatcatactgatgaagaggcaggtgaatccgaggcagatgaagatgctcctggagagaaagaggagataattgatcctgaagcggatgatgatgtgcagttcagactagaggatccagagttagaagggattctttcagattagttgagttgtcgatgcttcaccaaccaatttttttggtgagcaattgaggaattttgcccctctaacgcctaaactgtacataacttggtttgctctgtcaatgtacatctctaggctagttcatagtgacatttttctgtagttcactcactcacagtgtcacgccggcggttgatctcttagaagctttgagtttgtagtacttgtggtttgcattgatatagcctgtagcatatgctcttgtacctgttattcaactcctttttgtggtgtctaaaatggatgttctattttgacctgtttgcagcaaatgcaactgagcagctttgtttgaaaccagtgaggtcttcttttaactgtatcaaatttatctgtgttgatttcacctttcatgctatcaactgaattacaatgatacccgcctacctggatcaagtaaaggagtaaagctttgcaaaaagttaccagtttgcaaggaacataactcctgtccgacactaattctcaacattataccactaagtgctgtatttgtgacaaatttgtgctcttgaacattccctggagagagatcggatctgttggtgggtcgtcatcaatgaaaaagaagagtgacaacacctccaaatctaactgaatggaactgccatattactcttgctattgatgaatttgcaggcgttcttcgggatatcgtatggttttgttgttactgaactaacttttctggagtctgtaacctccatggacgtaaataaccggccaaacaaacagaggttagttcaacaagtctcttccctctcccttgtttaactcattttcttactgccctgtttgatttctgcaattgcagataactgtgcttctcacttgtgatcttttcccctaggtgattcttgctcacttttgctcttgcctattgttgcatcaagccctccacgagcatctcatctttctactttcaaggatcagtttttttttttacctcccctctgcaattctctgaatctgacgacggagaacgcaattttcttgcaagcagcacatggcaggatagggaacccaaaacttttcatagctggagtacagttcttgattcactatgcaactatccctttctaggaattaggcaattaggtccccgtgaatatctcactagccttgatgcttggtacagtagagagtacagtaggaatcctagctgaagagatgtatcagctgagctcccatcacatgatcactgtgctgaactacctcccctgttccccatacaatctctgatgctttggatttcgctgctcgtgccggtgttcttccgttccaaggacaagaggccaaacgctttcccccaatgcctgccaatatctctatgcttgctccaatgaaagtcttctcttcctgtcgttttctcttttctgaacttgtgttttctcttcctctctgcctcacgggactactagatggtgacacttgggatgctgtggctatcggcatgttccacgtgtcaatgccacagagttcggacatacaccaactagttcatcatctagtagactagtactagtgtcagattctaatgttggcgtactaatctgtgttaaaactcaccttttctcattgatttgaatttttcataagtataggaatacataggacacgattttattcttttgtttgagctgacagcctctaaataataagcccttgcat

SEQ ID NO: 19495 - DNA, 1023 bp, Oryza sativa
tagcaagtacaatagtttggtactacttggatcttgccacatcctacaagtgtacatttgttaattgttattcagctactttgccaatttaaaactaaagaagaaaccttttagtcctcattcaagtacaggctgcaactgaggttatggtcaatgtactcatatggtgttgcatgttgtcaggtactgggaccttgtttggagtaaactgggagaaagaactggcatatttgatgtgtaagggctctcaattcactcggatttcaggaatcgcctccatatgattacactttttgtgctagagagagcccaggtgtatctgacattgaacgttgttacgcagaataaaagggacagagttccgaatcatatatcaggatgaaaaccatgcagaggtctcgttcgttagaacatgggatccttctctggaaggcaaagctgttcccttgaacattgataagaggtgatccaatagcacaggcataacaatggaattgttctcagcaattcatttggaaaaaaggcaatcatgtttaacagagcaagtaatttttgaaatattttgacagcgcaagtatgtttgtacaggttcattgtactccggggctgctcaggattctatacctatggaatctatgagcatcaggaagggtggcctggttttagcctgggagagaccagggtggccttcaagcttcggaaagacaagttgttctagttcctgaatttaagttttcttttttttttttgcagtttgctgaattatgctacatcttacactgaatgtctgaatccattactttggtgcaaattcaggtttcattacatggcattagctgacgacaggcagagaataatgccgatgcctgaagaccgagtgccgccccgggaacagcaattagcataccctgaagctgtccttcttgtggacccaataaatcctgacctaagaggagaggtaagttgacaaatataggattttttttatctatgataaacgtattatatcatgaagaatctaac

SEQ ID NO: 19496 - DNA, 2051 bp, Oryza sativa
attacgcagagttacatgatgtgcttctaacatctgtgtccactgcagaagaactgatcagagcacctaccagccaaccacatggcaaataaagttcaatcttgacagtgtcagtcctaacagcacatacaaattcagagtggctcttgcatcatccgcaaatgccgagttgcaggttatttcagaaaaaaaaaacacaaaaatacttagattggccaatgtccattcctatttcattatttgttatcatcattcaagaagttgatcctaaatacacaaaatgcttgtattttcaggttcgtttcaacgatcaggacagaactgctcctcacttcacaactgggttgattgggaaagacaacacgattgcgaggcacgggatccatgggctgtactggctgttcaacatcgatgtgagtggagcttggcttgttcaagggatgaacaccatctacctgaagcagcccaggaaccagagtccatttcagggactgatgtatgactacctgagaatggaaggtccttctggcagctaaggccagtctttagctagtttaaccagcctcacctgtatggctagtatagctgtactatgcctaggtatgcagtacgattatgacccagatattcccatccactaatattctatttagtgtgctttaaagtttaatcttattttaccaaaaaaaatcctgggttttgtctaaccccggatttagcttatctgatttaggttagctggtaaagatgtaagctgccgaaatttcgcagagcatcagaattcagaaaacgattagatatactctaaatcggtgatatgtattggaaaaagaaataacatttccctgctgttttaactctagtgtaacaatttgaaataatctaaattggtgccatgctcttgtttctcagaattaaggtttgcagcaaacagctttcactggagaagttgccagatggtggcaagacacattcttcactcaaaagtcaaaagctccaacaagctgttagttaattaggtcaaatcggttgccaaccccactaactattagcaaagaaatcaattcttgaagcagtagctatctttggcaccttccttttgctgcaggtctcccctctcaacaagtcaagcccctgaagcttttgatcccttcacctcgtactcgcagcagcagcaggctgtactgactactgaccaaccaccagtttcggcgccattgctgtcctcctccttggcttgaactcaactcatcgatcaactccagtgcaggcacatgccaattgctttccaaaccaagggataaccagtcatctaagcaaagctgatgatggattgatcaatcagtggattgccagctgcttgcggagttggaggatgtggtggtgcttgattagggcatggaaaaccaagggataaccactcatctaatcaaagctgatggatggattgatcaatcagtgcattgtcagctgcttgtggagttttggaggatgtggtggtgcttgattagggggagtggattttgatctctcgagagggatgtcccctcgttgtttgtatgtcactcaaatggttatgaaaaagctctaaaaaaattgagaagatgtattaacatgtgatattactccatgaacatgctagttcaaattcaacttctacatctcgcaacgaaaaacaaatttgactgtgaatatacgttaactagctgtagtttaattatttttttttgttgcgagatgtagaagttgaatttgaacttgcatgtttgtggagtgatatatcacatgttgcattttttttaattttttttcataactatttgaatgatatgcaaacaacgaggggatatccccttgaatgatcaaaatagtttccccaggattagggcatggaaaaccaagggataaccactcatctaagcaaagctgatggatggattgatcaatcagtggattgccacttgccagctgcttgtggagttggaggatgtggtacggtggtcactcctacggaacacatttttgcatactggcaaaactgattttcgcat

SEQ ID NO: 19497 - DNA, 10446 bp, Oryza sativa
atctccgccacgctccagatccgccgcccaccgtcgtcatcgccgtcacatccaccgcccccaccgcacgaggtaggatcctgtagctggatctgccttcgtcgtccggatctgccgctcgccgtcattgtcgttgagggtgccgtcggatccgccacccgccatcgttgtcgtcatcggcactgttggatccgccccccacctccctccgtcgtcgccggtgccagatccatgtggggagggcctgctcccggtcgccgccgtcgttgccggtgctagatccacgcgagcccgctcctcctccggccatcaagccccgccgccgccacccaccccactccacaccgctctcggagtctcggttgctcttgccgtcgaggtgacaaggagagagagagagaggattgagaggagaggaggagaagataagtatcgacgtttgaggtctcgactacggtatttgcatggtgtggagatcgtcggtgtaccagggtatatgcgagactgaagtgaaagaaatggagacaaggatttttatacaggtaataaccctactcctattgaccaaagccggtgttgctctttattcatctggatcacacaagtacaatatttgggataacctatctagctgtcatcgacttggcggcatagataaccaacatgtagtcgacgacaagatagtcttcctcctcgagtacgaactcatcgagatcagagatggcgctagatcccttttgtcggcctccgcaggcaccatattgggtctgtctaggcttatctctgatgtcgatgtctgccggcgtgttggtttgtgtgtcgatctatcgtgtcctctctcccctagtgtcagggttatggataccacatacataatagtagtcgactaaatctcggcaggacccaccacataccatgtcttatacgggaacaatcttcggatataggaggagttctacataaggaaggatgaatagagttctacatgaaaatgacaaggactactcggattgtatccatattggtttccctagttctacttggacaaggggacacctatgggtataaatacaaggccccctaggaggaaaggggacacgaacaacatagacgccacaaagccacatgccaatataagcctacatacgccaagacaagctggcagatatcgatatcagagataagcctaggcaaatcccatatggtacctacgggaaccaaagagaggaatctagcgctatctctgatctcatcgggcacggattcgaggaggaagactaccctgttgtcgactacgtgatgatacttcagtccgccaagtcgacaacagttagataggctaccccaaatattgtactggtgtgattatggtgaataagagcaacgaccggcttcggctaataggagtagggttattacctgacaattcaggggcccgaacctgtataaaaatcatcgtctccatctcttttacctcaatctcgcatatatcctagtactaacgatccccataccatgcaaataccggaatcgcggcatcaaacgtcgacacctagggtgtcttgtatttatacccatagatgtcccattgtccacgtaggaatagagagaccaatatggatacaatccgcgtaatccttatcgtttccatatagaactctactcgtccttccttatccggaactccttctatatatgaggcatgattctgtataggacttggtatatggtgggccccgccgagcttagtcgatttctattgggtatgtggtatccagaaccatgacaataaggttgggtgaaaaattttaaaccggtggacagagaaggagaaggctaattagacttcaagtccaatccttaagaggctcgcatgcaaaaatcgattttcgcatgcgggtctcttaagtggcctgcatgtaaaaatgaggaacttaagcatctgcaaaaatcaatttttgcatgcggctctttaaacttcgagtcaaattttatcatacattcgtactaaatgaactcatataaaaaagttgtcaaaaacaaagttgtataacttattgagatctaccaattttttttggttatttctccatcgagtttgattaaactatataaattttaaattttaaaatataagaaatttaaataattttttcggtagtaaatgatttcaaatggaaaaattgttaataacaaagttgtatatatatatatattgtactggttatatatatatatatatgtatacatacatacatacatggcaacatatcatatgcacacagaccctcacgtgtacacacgtgcacaccaactaaaaaatgtcactaaaaaatctagaaaaaattatacacatactttcaattgtagtacacctagggttaaaattttaacgtcaaattcattatattttagccgtaacaaaaaaaaaaacaaaaaatctgacagttttaaggttgtaattttgtcagaattttatcttttttgttattctctatgtagaatgaatttgaagatgcgactttgtacgtagatgtaatactattgaaagtacatgtatgaattttcctagaattttttgtgataatttttacttggtgtacacggtgtgtacacgcgaaggcctgtgtgcatagaatacgctccctacatacatacatacatacatacatacatacatacatacatacatacatacatacatacatacatacatatgtatatgtatatgtatatatatatatgtatacatatatatacatatacatatatatatacatgtatatatatatatatatacgtatatatatagatatacgtatatatatagatatacgtatatatatacgtatatatatacgtatatatacgtatatatatagatatacgtatatatatatacgtatatatacgtatatatatgtatacgtatatatacgtatatatatgtatacgtatatatatatatacgtatatgtatacgtatatatatatacgtatatatatatatatacgtatacatatacatatacgtatatatacgtatatgtatatattatacgtatacgtatatgtatacgtatacgtatatgtatatgtatacgtatacgtatatgtatatgtatacgtatacgtatatgtatatgtatacatacatatatacatatatgtatacgtatatgtatacatacatatatatatatgtatgtatacatatatatatatacatacatatatatatatatatgtatatatatatgtatatatatatatacatgtatatatatgtatacatatatatacatgtatatatatgtatacatatatatacgtatatgtatatatatatacatatatatatgtacatatatatatatgtatatatatgtatatatgtatatatatatatatgtatatatatatgtatacatatgtatatatatatatatatctgtgtgtaaactataagagaaatgtaaattttgtgaagaatattactatcactttgtcagatgaagaagtgaccaaaataaaagttgtatgtcttggtgagttctaaaacttttatgttcatgactttttcagctgaaattatttactacttcaaaatattatttgaagttttgaaattcaaatttttaattgataaaacaaagtcacaagagaaaatagccaaaataatagcagtaagaacacaataacatgatagaggatgattttaaaaacatttaggaaaaaaatcatccaatttggagttcatatgagtgagataaactagtttcaaattttattttcgcttacggctgcttaagacgactgtatggaaaaatcgattttctcataggggctcttaagtgatccacatgcaaaaatgagctcattttttacatgcggacatcttaagaggcttgcatgaataggaaaatcgatttttccagaagccgtatgcgaaaaagctgcttgatttttcatgcggtaagttatggtccgtttgcaaaaattatgagggtctcgtacacaaaaatcgtttatgtagcagtgggtgattgattagtactactgctgcatctgcactgcatggccatgcccacacacttggcctgcattgctagccattgctatactatgggcctgtttggggagctttagattctaagaagcagctatttggtagccagcttttgagaatctggaaaagctctaaaacctagcttctccagcttctgacttattagttcatttttcagaatatgtaactccatattctcagaagctgtggactgtttaggatagcttctagcaaaagcagctttttccaaaagctgccgctgagacaagcttcccaaaacagggcctatatatgctgctggtttcctggtttggtggtctcatgctcatgcatgcacacgtccatctgtgtgaattctgaagctgcaagaacctctcgccgtgctgcatgggccatccaccggcgacctcctcaccggccggcgccaccgcggcgtcagcgttatggtcagcgaccgatatgtaagtgtgctgctgctggtcagctctgcctgcatatgttcgatcgatcgattcattgctgacatgattgattgaatgattgcatgcgcatgcaggttgagattaaaaatggcatctttgaggttacactgtccaaccccgacgggatcgtgaccggcgtccggtataatggtgtggacaacttgatggagattcttaacaaagaagacaagagagggtacctacctgacaattttgcttacgctttttatcctctctttgatatgtttaactagcatagtggctcacgcagattgcgtggctagcatcgttacatttttttttctcatttaatagcttaaatattttcacattttattattaaaatatattaaaatgacaacgtaattttaaactcttggttgaactaacaaatgtgtgatatttttattgtatggtatacgtgatagttatttataaattatatttatatatggactcaagaataatcttttaatattccttagtttttaaatttcgaatttcctttgttcataaattctattcctatatggattctagactactcttccaatattcatttttctaaactctgaattttagttatttataaattgtatttctatgtggactttaaactcttctttcaatatttattttttttaattttgaattccaattattggtaaattgtattactatattgactctagacttctttttccaatagtttttattttttaaaattcagctatttctaaattgtattcatatatggacgctagacttttttttcccaatattccttatttgttaattttaaatttcagttatttataaattgtattcctatagacgctagtctcttctcccaatcttgtttattttaattttgattttttgtaattctaaattgtatttctatatggactctaaactctacttttatttttttttatttttaagttctaactttcatttagttctaaattcctatgtgtggaccgtagactcctcttccaatatttctacttttttaattctcaacctgttatttctaattgtatttctatatggattctaaattcatttttcaatatcttgttttttaattttttaatttaaattatttataaattgtatgcctatatagactctagactcttttttttaatatttcttattttttatttcaaatttcagttatttataaattgtattcatgtatggactctagactcttctcctaatcttgcttttttttaaaaaaaataatttgaattttagttaattctaaattgtatttctatatggactctaacttctacttttagttttcctattttttatttccgaattttaattaattctaaattgtatacttgtatagactccagtcaactctttcaatattccttatttttaattctgaatttcatctatttttaaattgtattcctatatgaactctactttttttttctttttctccgattaatatgggaatttctaagccgtgagagtaaacgtggtggaccgtagactcttcttacaatatttctacttttctaattcccaatatgttatttctaattgtatttctatctggactctaaattcattttttaatattttgtttttttaattgtgaattcaaattatttataaattgtattcctatatagattctagactttctttctaaatatttcttgttttttattttgaatttcagttgtttataaattatatttatatatggactcttgactcttctcccaatcttgcttttttattttgaattttagttatttctaaattttatttctactagaaaaaatgcccgtgcattgcaacgggtgaaatctattttaatcttattattgttatactgtttagttaaggtgagattcaccgtgggaatttgcttgaatttatatattttcaaaaatcatgagctgcaattaggattcttgtgcacataatataattaactttaatttttaaattaaaaactggttcattataagattttataatcaacaaaaatttgttgaagaaagaggtactatagttttgatttttcatcaaccggatgtgtatggtccgtgctagtggtcgagaaaaaaaaatttgcgcgcaaatatgatttgacaggagggagggacagtagacttattctaggagaggcccataaaaagtagatttattccaagagaggcccattgacacagtgcaagtaatataggtgtaaaaaggagagagaggtgattatatggaagatacgtatactatatcaaccgcggttttgacccgacaattaaacggatcccccgaaatccttacgtatttttttaattaggtacagaggtatagattagaattagaattaaataacatgttattattaaaataaaatacaatatacattttttattaaattcttcatgaatgaaccacactatctagaattgttttgaatttttcaaagctcatttgctaattttaataatacaaatataattttaataattaatttaaagtaaaaacaaactaaaagccctctcctaagtctgggccaaatctggcccattcttcttctcctccctcttaggctgccatccctccctattgggccgtcatccctatctccacttgggcccagcagccacctctcttcctttcctccttcttgggccaccatcctcgggcccaacagccatgccaacccatgaaaagaagcggatgggaataaaaccgaaaaagacgacggaaaaaaaaggaaaacggcgaaaaaaaacgcacggacgaaaaaaaattgtcggaaaccttatgtattttctaattattaggtgtgtgtgtgtgtgtatatatatatgaactctaacttctacttttgattctcctattttttaattccgaattttaattaattccaaattgtatacttgtatggactctagtctactcttttaatattccttatttttaattccgaatttcatctatttttaaattgtattcctatatggactctacctttcttttttttctgattaatgtgagaatttctaggccggaagagcaaacgtggtggcttcttttttattactttaataatataatagataattagcaagtacaatagtttggtactacttggatcttgccacatcctaccagtgtacatttgttaattgttattgagctactttgcctatttaaaactaaagaagaaatattttagtcctcattcaagtacaggctgcaactgaggttatagtcaattggtcatatggtgttgtatgttgtcaggtactgggaccttgtttggagtaaactgggagaaagaactggcatatttgatgtgtaagggttctcaattcactcctcagatttcaggcatcagttctgtgcctccatatgaatacactttttgtgctagagagagcccagatgtagctgacattgaacgttgttacgcagaataaaagggacagagttccgaatcatatatcaggatgaaacccaggcagaggtctcgttcgtcagaacatgggatccttctctagaaggcaaagctgttcccttgaacattgataagaggtgatccaatagcacaggcatacaatggagttgttctcagcaattcatttggaaaaggcaatcatgtttaacagagcaagtaattgatatattttgacagcgcaagtatgtttgtataggttcatcgtactccggggctgctcaggattctatacttacggaatctatgagcatcaggaagggtggcctggttttagcatggtagagaccagggtggccttcaagcttcggaaagacaagttgttctagttcctgaatttaagtttttttttcgattttgctatatctcactcgaaagttttttttcttatctctcactcgattttctcactcaaatttatagtgcattttcttgtaagttacaatgtaatttatgaaacttacgctgtaacttttacaatgtaattttgaatcttaagttttgaaatttatattggatttggtctttttcttgcagatatggtaattagtgtctattatggtgtttcttagttgtttcttgtcttttactgtgtctattggattttaatccaaaaattaaaaatctgtgtgatatgatcataaaaatatttcaaaaaatgcatagatactcccttttttttttagtttgctgaattatgctacatcttacactgaatccattactttggtgcaaattcaggtttcattacatggcattggccgacgacaggaagagaataatgccgatgcctgaagaccgagtgtcgccccggggacagcaattagcataccctgaagctgtccttcttgtggacccaataaatcctgacctaagaggagaggtaagctgaaaaaataaggattttttttagagaacgatggcaggagatctgccggaattttaattatcaattaaacactattcctggtaaatttacaatatcatgaagaatctaaacactgttactggtaaattgtcaaggttgatgataaataccaatactcgtgtgaaaaccagtataacaatgtccatggatggatatcattcgatcctccaattggcttctggcagatcactccgagtgatgagttccgaacaggaggtcccgtcaagcagaacctgacctctcatgttgggccaactatgctggctgtaagttcagacattatattatattgaaataaaaagttcagattattaagttcagacattcttctgaaaccctttttctttaatatgattttcagatgtttcttagcggtcattatgctggggatgaccttacacccaagttcatgactggtgaatactggaaaaaggtccatgggcctgtcttcatgtaccttaactccagttgggatggaagtgacccaactctactctgggaggatgcaaaagttcaggtgaaaaattggatgcatatttcgtctctaatttgatatctttcttttattcacaaaagttcaggtgataacattcaggttgattcttattgacagtacaagtgttatgaacacggcacaagtaacttgtaatttaactctctctttctccttttgaaatcagatgatgattgagaaagagagctggccgtactgttttgcactgtcagatgattttcagaagactgagcaaagaggttgtatctctggtagattactcgtccgagacaggtagtaattaatgacatctttttccagttttatacaacagtagtaactaaaagaagtttgattcagtccagatgtaatttagttcgcgatacatctattactaatgaattcatcatgtgttatttaggtatttagatgatgcagatctttatgctacatcagcttatgtaggcttagctctaccaggagatgttggatcctggcaaagagagtgcaaggtgatgcatgctatatacacacttattcttttagaacaagcttgaatacatgttagactatgaagtatattatcaatcacatattccaacaccgtgacccggcaaaaaaaaatatatattccaacactgtagggataccaattctggtgtagggcagaagatgatggaagcttttgcataagaaacattgtagctggagactacaacctttatgcatgggttccaggatttataggggactacaaactggatgctaagctaaccatatcttcaggtcagtatctacctgacatttattcctcttgcagcttccaatgagatatcctgatatgttcagcactcctgttcaggggatgacatttatctgggtgaccttgtgtatgaaccaccaagagacgggcccacgatgtgggagatcggaatacctgatcgatccccctctgaattttttgttcca

SEQ ID NO: 19498 - DNA, 19559 bp, Oryza sativa
  unsure (1)..(19559): unsure at all n locations
aggtgataacattcagattgaataagttcttattgacagtacaattgttatgaacacggcacaagtaacttgtaatttaattctcctttggaaaacagatgatgattgagaaagagagctgggccgtactattttgcactatcagatgattttcagaagactgagcaaagaggtcgtatctctggtagactactcgtcagagacaggtagtaatgacatttcttttccagttttttacaacagtagtaactaaaaaagtttgattcagtccagatgtaatttagatcgagatacatctattactaatgaatttatcatgtgttatataggtatttacatgatgcagatctttatggtacatcagcttatgtaggcttagctctaccaggagatgttggatcctggcaaagagagtgcaaggtaatgcattctatatacacacttattcttttagaacaagctggaatacatgttagactatgaagtatattatcgatcacatattccaacactgtagggataccaattctggtgtagggcacatgatggtggaagctttagcataagaaacattgtagctggagactacaacctttatgcatgggttccaggatttataggggactacaaactggatgctaagctaaccatatcttcaggtcagtatctacctgacatttattcctcttgcagcttccaatgagatatcctgatatgttcagcactcctgttcaggggatgacatttatctgggtgaccttgtgtatgaaccaccaagagacggtcccacgatgtgggagatcggaatacctgatcgatccgcctctgaattctttgttccagaccctaatcccaactatgtgaataggttgtatatcaaccatcctgacaggtgatgcagactggctaccaacagacttctcaaacatgtactaatcaagtgatcatcatttcttatcatatagtgttctgattgttcgttacagatttaggcagtatggactttgggaaagatatgcagagctgtatccagacggtgatctggtatacacaattggccagagcgactataccaaccgatgggtctttgctcaagtaaacaggtgatgttttcatctcatttgaatacaactgattacgcagagttacatgatgtgcttctaacatctgtgtccactgcagaagaactgatcagagcacctaccagccaaccacatggcaaataaagttcaatcttgacagtgtcagtcctaacagcacatacaaattcagagtggctcttgcatcatccgcaaatgccgagttgcaggttatttcagaaaaaaaaacacaaaaatactcagattggccaatgtccattcctatttcattatttgttatcatcattcaagaagttgatactaaatacacaaaatgcttgtattttcaggttcgtttcaacaatcaggacagaactgctcctcacttcacaactggattgattgggaaagacaacacgattgcgaggcacgggatccatgcgctgtactggctgttcaacatcgatgtgagtggagcttggcttgttcaagggatgaacaccatctacctgaagcagcccaggaaccagagtccatttcagggactgatgtatgactacctaagaatggaaggtccttctggcagctaaggccagtctttagctagttaaccagcctcacatgtatcgctagtaatagctgtactatgcctaggtatgcagtatgattttaaagtttaatcttattttaccaaaaaaaaatcctgggttttgtctaacccggatttagcttatctgatttaggttagctggtaaaaatgtaagctgccgaaatttctcagagcatcagaattttgaaaacgataagatataatctaaattggtgatatgtattggaaaaagaaatatcatttcctcttttaactgtagtgtaacgattagaaataatctaaattggtgctatgcttttgtttttcagaattatccgtatagcttgaccgttttccgtttccgacggataatagccttactatatccatattcgtctctgatactatctgaagttatccataaatcaacacagtctatttccacgcaagtgtctggacagtccgaaactatatgaaccaatttcatcactacctgtggatatatattataactaagcttttttttggatatatattataactaagctttttttttctttctctaaattagttccgaaagattgacctggcgatagtagacctttttgtgcgttgtagcacgtagcatttccacttattgagaagatatcattttgtacataaattattcaagtcatatgaacacgagcgagtgcatataatacaaaaagaaatgttttgagtacggatcgttatccttttagggtttcacattcatatatacttcttgtaagttgtcgttcggcgttgtaacctcaccccgatacagtgaagatattaatttgctggctggcacctatggttttttctctcctgctttgggaaggtttttcacgttaaatctcgtgtcttctgtgattgatctattgttctttatcttttatttgcctattgtttcctaacgcaacacacatatattttgctagtttaattaaaataataaacgttttaacacaattacatatgcattgtggttaaaagtagaaattatgtagtcctcgtacagcataaagaatagaactaactaacgaggactagttaaagagaaaatgtaacaataactattaagttagtgctgaaaaaactactccctccgttgcagattacaagactttctagcatttctcatatttatatagaagttaatgaatctagacacacatatatctagatttattaacatctatatgtatgtgagcaattttagaaagtattacattgtgaaatggaggaagtattaagttaagtataatcagtggcatataagaaatttgtctatttttttactagaaaatggctagccctattctattgaaccagatacgtgtggaaagcataaatttgattagtacgacgtccaccggcccatctatgctgcagtcctttacataatgggcttctataatagcccatgtcccactataaaccaaccaatggcccaactacttaattgggccttccacaatcaacaggagcagcccgctgtagagagggcagagctaaactgtacaaaattgcgtgcatgttttttaagataagaaaaactttattgaactcaatcaattaatatcagtgataaaaccatattgaaaacattctcggcatttgcataacttgaatacacaaccaaaattttcacgcacatagtatcacatagcaatacactcttgtgtgtgactatatgtgtgcagtgtgcgtgtgtgttcacgtgccacattatatttctatcatttgagccattaattgttgtaagattttcacaaatgttatgttcagacccagccaaaattgcagtatatatctggcaccaatttgatatgcgttatcaagatcactaattcagtgtgacaattgtcaccacttaccaaaatacggagtagtaaatgtacaaattaaatcccagccagattcaattaaattttgtagccacatcacatacaaattgaacatcaaattggatttggttcggccttaattcggtgttatttttgatggcttgcgtggctagcttcatccatcatctctctagaacgagaagaagctacactgcatgcatgcatgactgatcagtcattgacaattaacatgcattatcaccagttgatccacctaaattaaataatcaaaacaccacattaatccaccattaacttgatcatctcatcgatcgatcgattgattagctagttccatgcttgcatgatgcatcgatgaaccctaataatctggtggttaattaatataataattaattaattacttcatctcttggtccagtgagccggccatgcccatcccggcggcgccgccgtgccgcagttgaagccccggcgcgccgccgctcacgccgaggaagtccctcgtgctcagcttgccgtcgtccacgccggggaagccgccgccgacgaacaccgttccggcgccggtgccgcccccggtcgccgagagcgtgttcatcatcagctcccggagctggctctcgttctccgccgtctgagaagcagtgctcctcgacgagctctccccggacatgatgaacccggctgctccggcgggcttaccgttcagagcgccgccgccgccgccgcttccgagacctctgagtagcgagttcacgctgccggcgccgccgctgctcgtcgtcgcgcccatctgtgcggccttctggagaagcgccgtcgccgacatctgcggcggcgggacggtctggtcggacgagctgtacaaggacgagaagccgccgccgccgcccatcatgttcccggagaagatgctccccgagtcggcgttgttaccgctgttgccgtgctcgccgctgccggcgcgggcgccgttcccggcggcgacgccgttgaactgatccgggaagacgagtcgtccctcctggtggtggtggtggtggccgccgttcccgccggagaagtagctcaggttaaggaggccgccgccattgctcccctgctgctccggcagctgcattaggccgtggaacgccggcttgccgtggagcagcgaggtgtgggcctgtccgtcgtcgccgccgccgccgaggtagaacggcgaggaggacgacgacgtcggctgcgcggcgcggaacgcaggggagccggccgcggcggacgacgtggccatgaggtggtcgaactgcgcggcggcgttggcggcggtggtgatggcggaggagtggtcctggaacggttggagctggtgggaggcggccatgccggtgaggccgccgatggccatgccggcgccggcggcggcgtacagggcggcgcccatgggtggcataatcctgccgctctcctgcgccagcgcgtcgcagaaggcgcggtgggtgatgaagctgtccctcctgcatgtggtacaaagttttttttttcacggtgatcaatatgatgtgccacttaattattaatctttataagcaagatatatactccctctgttcttaaatatttgatgtcgttaatatttttaaacatatttgattgttcgtcttatttaaaaacttttgtaaaatacgtagaactatatatatacataaaagtatattcaacaatgaatcaaatgataggaaaaaaataataattacttaaattttttgaataagacgaactgttaaatatgtttaaaaaagtcaacggcgtcaaacatttagggacggagggagtatacaatttactcctagctagagataataatgatactgatcatgatgctatacacaatgaagttgggaagaaatacactacttgattggttttaaattaattacttgccgttctatctttatcctcggtctcaaacatccatatatttgaccatcaatttttaaacagttgtatagtttagcatcagtgtgatttatgcatgttttcagatttaccttgaaaaatatcttcataatataccttgaaaagtacagtttttctagaaaccaatggccaaattaagataaacatatttgacttaggagatcaagctaaaacaataagtaatttgaagggtagcaggttggtatatgtgcattcacatgttcacctcaaattcactttcttcttttattcacttgtcatttaattcactcatcttgtatatagttgtttcgttgtgcagccagcacaacatttatcttttaattaattaagttgatgtgaaaacagaaaatgtgaacattatgatttgttttacagatcaatatatacgttcaacttgtcactccagttatctttttttttttaaattcaataataccatcggttatgagaaaaaaacagttcgccaaattaataaatgaagaaatgtctaaaagagcaattaatcaaactagaatatcaagatccattgcaatgctaaattgagcatatagctttcgagacatatatcatactgctgtttaatagcacacgaagttttcccccaatttaagcactatctaacttatacacaaaattacataaacatatatatggtaccatcaaatatcctttgctaacatatatagcaacaaaaaaattgttgaaaattatatatctatttactaattaaaaaccatactaatgtgcatgcatgtcaacatggaatttatttgtggacagaaaaaacattggcttaatttcactagtagtacatgcatgcttgattgtctttgtaccaatatatccaaatatatgcggcagattgtgcaaactgcgactgtagcccatgatcaaaaagccagaaatgggaaggcaaaacaaagggaaagaaagaatgtcaatgcaacaatacccaaattaagatgcatggtgtaactgtactgtaccctctctccaaaacattcatacacaattgcaagcaaggttccaattttcagatggggatgcaagagcatatctgcatatgtgtgtgtgtgtgtgtatacacatgaaatggttactaattacacatgcatgtatgagcagatcgatcaggtcgccgagtggcatcatcaaatgtcgatcgatccgaatgcaacaacaagtggttcaggctgaatagtaaggccaataggactaaaactttaagtctctatcacatcggatgtttgaaaattaattataaatattaaacgtagactattaataaaactcatccataatcttggactaattcgcgagatgaatctattgagcctaattaatctatgattagactatgtgatgctacagtaaacattatctaattatggattaattaggcttaaaaaatttgtcttgcaaattagctttcatttatgtaattagttttgtaggtagtatatatttaatactctaaattagtgtctaaatacagagactaaaattaagtccctagatataaacaccacctaagctaacgcagctgctcgtgctagtagctagcacagtcgccatgaaaagaatagagctgtcgtctctgtagtctgtatgcatggctccatgcatcgatcgcatgcaatgcaatgcaagagagagtagtactgatgcatcccatccgtcacaagagaacaagccatgaccatggccatggtccttgcttacattgctgtagtacgagtatacagagagtactagtactacagttgcagctagcaagggctcttgtcatcacgtgaacacgtagggacgatgagagagagacagagagagaaggatacttgtatcaagatggtgcggattccgagtcgaaaaagatgactggcttttgtttttctttctgaaccttttcaagaggaggaggaagaagatgaccatggcggcatgatctgcagtggcctctctcagctggcctgcctgcctgcctttgtgtccccctccggacaagagcagttcacgtgtgaccagctaagctactaatcctatatactctctctcatggaatgatcaatgggaaaagttaatttgttgtaagaggagagtaagcaaagggaatcaaaatcaaatttccaaacaagaaagactcgagagacacaaccgtacaaggccagtcacactgttactacctactgttcttcactgcagcatgcgcgagtggtgacaaccctaaccctaacacgtagtagtactcacccgggccggccggcgacctagctagctagctagagccatctgcttcaatcaaatcaccatcatctccatctatcctagtatctaccaaagctattcatctcgtgcctttcagtgcccggacctcctcctcatgagtgtgttcatcatgactcaatcatatgatgaacaaaatatataaaagtacatgaaaaggaatcatcccaaatccaaacaattctctaggttgccacatcttgcaaactaatggaatatctaataattcaagacatactacacctccatctcaaaatatatacggtaacttctagctatacatctgacacaagacgcataaccagaagttgctgttgagaccacagagggacatcacaaacaaaaaaaaaacaaagaatttaagagatattatctccgttctcaaatatgaaactttttaattatacatctggcacagtcatgcacatataccagatgcatagccagaagttgctactgggacatacggaagggagtatgattcgcaatagaaagacgaagatgacgacttatattttgagacggagggagtagtacataaagagtacctggagaagagggtgccgcagtcgcagcggtactcgcgggtgccgcaggtcttggagtgagccttccagtcggactggacggcgtagcgcttgttgcacttgtcgcacttccacttcttctcgccgtgcttgcgggagtagtgcttcttgatgccggtgaggtcgccgagggctcgcgacgggtcgtggtggacgcaggacggctccgggcacaggtacacccgccgccgcgtctccttggggttcttctgcttcagcttccatggcaggttgtgccctcgccggtgcagctgcaggttctgctccctctggaaccccttgttgcacacctcgcacacgaacctgttcgtcgccagcagcgtgtgcggcgacagcgccaccacctccgcatcaggatctacgtacattatcaattcatcattgaattaattgatcatctgcgaaattcattcagaggaattatattaaatgagatacttgcttggattcccgggctgattcctcttcttcttgggcggcggcgtggccgcgaccggagcagccgcgttgttctgcaggggaggctgctgctgctgctgctgcatctgcggctcgccgagaccgaagtagtgtgcagacgaggcggctgccatctctatctctgatgatagttaatcagctcaaaccactgatagactaattgtcttgttctgttaaattgtggctgaagaagaagataggcatggaattaatccaatccaattaagtcacactcttcgatagtagtatgtgtatcttggacgctagctagtctaccagctgacttccaatcctcttcgatttgcacgacctgaaaattaatcaagacaaaattaagcagagatccaagaggtaattacatgcgtggatgaagctagctagcatggaagatggtggatggatctgtactgtgtgcagccataggacagacaaactgactgacctgcagctgatcgatcagatcctctctaataacaaagcaacaaattaaatcaaaaagggggaaggaaacgaaaacgagaggggaatttaatcaaggaattaataagagaggaattaattcacaagctaattaatccaaagttccaaaaaaaaaaacatgcaatcgtacgttgcacatactcacaagcaaggcagctagaaactagctagcttgaaaaaaggagactggtcaataacatgagataaggcatggagaccgaggtagaagaagaacagcaacacatgcaggagaaaaaaccaaaaaaaataaatcacatgtcatcgatctgagatggagatcgagaaccgaacaaacaagttaaagaaaacaagctaggctccttgttgaaaaaaggaagaggagaaaactctaattaaggcgatggagatagaaatatatagagagctagcaaacacgaaccggggttataataaattcgaaaagccaaaaacgagactgcagctatctcctcgtcttcttgctgctgggctagctagctgctgcaatctatactagctagtacacgtacgctccaaattctccaagttttgtttggagctagctatagcacatgatgacgacgacgacgacgtaactggtataacaagctagcttaggagcatatgctactatatggcgcctgtggctggagaagaagagaggaagaagacgagagagcgagcgagcgagaggagaggagggagatcgatatggtgtggatcgagtaatcgatcgactcgagttgggtggttggttatgagcgagcgagctagctagctctcctccggcgccggcacaagggtggggcccacgtggcgccctctatgggcccaccatgacatagacagatgctctcgtcccttccactccaccccgacctctccatcctatactagctcatgttccctggtatatatggatctatcatctatctatatctccaattcccaatcagatgtacatgtacacgtgaccgtgtacgtttagggaagcttttagtagcggcaatttcttttaaatcttgagctctcttaaatagtttaattagattctcactccaatactagggattctctgtagttatagaattcagaaaattaactactaaatagaagtaaaagattaaaaacacagtttgcttcgtattctcactagccaaggctactcattagtttcttcctagaatctcaatctctccaaacgtggcctaatatcttgagatttctcgctcaatctatatatgtgtgtgtgtgtcgctttcggaggggtaaaacgcttttcaatctattgtattattaaaacatcattaaaaagcgacattaagtgaacgatggggactataaattctcacattaatcaaagaaaagaaaaaatagagttaaaaagagttcaaattatagttcccagcggtaaagagaattagcaatagccagcggtcggggcgtagaagtaaggtgacgatgtttattaggacttctaaaattataacaagggaaggacgagacaatgaactctaaaatagtacgatttcccaagacaacgagatattttttaatacattttaaaattatgtgtaattcttttataattttatgcgggtgctaggactgctagcctcataattgtacggggcgcggactactccaattactggcttaaaaaaacgattgatcaatcaaatttgaagcgctagctgttgtgagtggggagcctttttggctggatgttttgcttgcctgattaattatacttgcagtggctgctgtcaggggcatgtgtgacgtgataacaaacactgaatccgctgtagagcggctcatcaatcatcaggccctgaatgttgcggcacagagcatgcatctacagctagctaggtacatatatccacgaccaagttccatgtgatcattgctcatcacatatgtaaacgggataaagatatatatatccatttatctaaacataatatatactatatgtaattggcttagttaaataaaaaaaatgttatctaaaatttaaagtccaaaaacaattatatcaggcggcggttgtgcatagaggtacatacatgaacatatggcacgcgtgtagattttttttcttcggcgcatgcatatagcgaaactaagtgaaaaattaaatacgaaaagcatatattaatattatatgctcctcatgcaaattgagaaaaaatatctttgtgctaaaagattagttttggcatgcatatatatctccaagagtttcatgacattctttgtcacatgtactttgcttgtcaagtgcttggcagcaggctatggctgtgttcgctgctggcggttcccatgcggaaaacggaacagtctattagcgcgtgattaattaagtattagctatttttataaaaaaaatagattaatatgattttttaaacaactttcgtatagaaactttttgaaaaaaacgcactgtttatggcaatttgaaaagcatgcacgtggaatacgatggagaggggttaggaaccctaggttctgaacagaccctatataacacaataaaatactacgctgttgaatagtaattcctctacgaggcatgcataattgcatgtgatgtgtattcgagatcaaaagtacaggacaaaaacaaacatatagaaaaatcaggaacagatacatacttgtgtgtatatgcagatgtgctcacatgtgatatataattagctgatcatttcatctccccagaaattccaaagtagcaaagtttaatttagtggattacgatgtataggaaacagcaactatccacagagaggaattacacaatggcgactaaaggacaaagccgtgtattgtcaacagcacgaagaaaaacaaaattcttgtcacgaggctgactgtaaagtacagcatatatactacctgtaaataatccctctcaattaaattcaaaaataacacatgtgcatgagcaagatattaggtcgacgattcagcatcgggtataaaagggcatccaaaaccttaaaataatcaaattcaagctgttccaagaaaattcaaaatctctacacctgatatccaaaaacctcccatatgcctcaaatattaattattgaatcaattagacatatataaatcaaatgttacgatagacgacacgagtttgatgttgacggctagctactagataaacttgatagcagaagaaaacacaacatgccatgttgccatccatatgaaccaatcatatatctcttgttttctcaatcctcattctggtttattagttttacatagtagacaaataaagagtaaattgtgccggtatatctgtgatggtattttgaaactcgtcgacagataaaactaatgatatgggggggggaattctatagtgttattcttgttttgattttccatgcatgcatcatcctgatcactactccaataatgtcaatactaccaataataatgtgttaatttcctccatatcttatatgctatctacttctcatcagtactaccactactagaacaacgatttttgcaggtagccaaaacgaaacagcagttggacgtggtggtggtggtcatcattgcagggaggattgatgccgccgtcgccatcgagaagccggctttccatggacgccgcttctaccaccacctccagcgccaacattgtcaccaagaccaccacgaggaagatgacaacaaacagcgcgaggagggtgcgcccttgccaccatgatgaggaggaggccaagacgagtcgttgccagatccgccgcctccgcctccctcatcgccggatccaccaccctcgtcggagaaccgtgtgccacggccgggggagcaccgccgctgctcccttcccttccaacactaccgagccccgccgttgctgccgttcgggtgaggaaagaggagctcaagagaggaaaagggagggagttggggacttagaaaaaactggtgtttcagttttcttttgcgtctatttaaatgccacaaccaaatttcaccggatggcttaagaggcccacctgcaaaaataagggtattattgcaggcagcccttttaagccatctgcctgcaaaaatgggaataggatattcccaggcggtcggccattggactcctctccacacaacgtacaactacacaggtgggcaatcgtagtcgaaaataagatctgcctgtgaaaatctatgtgtttcattgtagaaattcgtttttctagtagtatgccatccatcatcagccgcaaggagagagatgaagcaatgagcaatggatgatcttcttccaatgctagctatctactgtggctatgaacaagaaggcggacatatggaaacaaacctagctataaataaaacagagagaaaaatttagatgcctactaaatttgggcataaattaaataaaaaatcatttacactatttgaatggaaaatatgaataggctcacatttttcccaatacttttgtagaggaagctagcaggtcctagtccttgaacactgaaatacaatatatatgtaatgacaaatttaattagtttatcataaataaaagaaaatgttattagggaatagggatggaactctgctaattaagggttgttcgagttcaggctgctccttaagatcaccacggtgcggttttatggattggtgaagcatggtaaaagaagattcaaaaagcttacttttctacattttttttgaaaataaaacctttcttttgttttgttgtttctcagttaagatttttggaaactaacgatttttgtaagttttgtctatgtatagtatatctatttatggtagaaggtctgggatctctatctattatattgagacagagagagggagagaacaaacaagtgcagtgcatttgcaccggacctgcatgcagctttagtggttggcaattgccattcgaaatgaattaagaattggaataggaatatttttgttggctaccttgtgaaatgttaggtaggcttgcgtccacgcttgattcgatcacattcgatcaaccaatgtttatatatactttgatgaaccattaaaaataaataaaaataaactagtggcagctgctaattaactaattaagctgttaggttgttttagctcacagcaatctgctaacctatatatatccatcgaaatcgagttactgtgagagaggctgaaatcgagttactagccggacatgatttgtagtatctgacaattctggccgtatacggtcgttgcctagtttgacgtgttgacactgacttgttgcgtgctcacgatttgatttgattcagaattgaacggattagtcctaattataaattctagtcaatggctgccggcctagcgcatgcacatctccacttgtttaatttcagcctagctctcgcttgttccgcttcctccatcttgcgcaggagcagatcgagatcaacctcttttctactcgttctccgtgattttacctacttgcttggtgccatatatagcctggtttctctagtatctcctctattctctagcttctccccgagctcatgacataatcggatcgaggcaagtcaccttttcgtggaagttcataaaagacgcaaatattgtggaaggaactaatatcaaaaattagaaggggtgagacttcgtacccaagtcatctagcccaacagaagacccctgggcgtttcgcggaagttcatgtctctatgaacacaacttccaatccttggtacttaattttacaaccaaaatcaagaggattaatttgaagcgatgtagctctaataccatattgataactactcaagaacgcactcgaatcgtgcaacagacatgatgaatttcagttgtagctatgggcaaatcaatccggatcaagctagagcaccgccatcgctaggttcagatacaagctgagtctgtcatttctttccccttatataagcttagagcatgaccgatgtttaatccattataagatcctatggatagacacccagtgagggtagcacccttcaaaaattcttgcaatgtatagaactagtaaatgtcttataggtaggacgcgctataaatggcaataggttcatggtggatgtaaaggcctctgagaggcgggcccatatattctctcttctctatagccagatattatgattgttgactggttctatattaaaaatggtaggaaaaagtttcacaatatgtaggttagacttattcttctctctctctctctcccatagaacccctccaaatatcacattgtggatgctcttatacattacctactatttatatatttttttctcatcagataggtcgtgatctatccataattgtgtattattacacgacccatgtcgacccataatactttaaattattgtgtttttccctcctgccgcgtcttagctcctctcctgccctgtcttcagctcgatcagcaacatcttctttctttgatacaacgtctccctcagacccagcatctccctatggtggctaacacatacgtagactctgcaatcattggatgcagtactccaattttgccagccaattgcccactgcacgtacagtagcacatgtgtacattcttcttctttccaaattgaattgaccattataatactccccccatccacagaagttatacatattacttttgtcaccaagaccgaggagagattaaatcatctaggagtcaccaagaccaaggagagattaaatcatcttgcatattacaaaatcaaggagtgaatgtaaacatgccaccaatgagtatttagatgactcattgaattctaatcaaacatttaatttatcacttcatttaagtcttggatgcataaaaactacaaataggaacaacttatttggaaaagctcaaatgtgaaatatctaacttttgtggatggaggaagtagtaatatagcacatgcaaaatagtttgagatttgtgggttgctaaatttcagtcacatctttaaaaatctcgctcaaaatttcccaccgtgtgatttatgtcaagatttgtgccctgacgtcttccccaatgacgtcgggctagtagctagtgtcgtctccggcagcgcgagcttctagagacatggaatgacaattgaccgagggtacattgctggcgttcatcttaggaggatgagtgaggaagaggagaggacggggcttgatgatgaggtagagcattgatgggcgatcaagaagaagagaagataagattagaggattggagcattgtaggtgcacgaatcttagtacaatatgagtcactgaaaaacaactgaaattttatgatatttttggtaaaaaatattcgataatagtacatgggtagccgatagatggaaactgaaaacatacatgcagctgatatataatacaacctccatctcaaaaaagatcaacttctagcaataaattaagataagtataatattattttgggacgaagggtttgtaagggaatcccaaatgcatgaaggtgtggggcgtggcggtatccaagggagggaggaggtccatgctgcatgcatgtagtgtgaactgtgaagctagtatgcagcacgtaccctagcttgtttgctttcctgcaggacacagtcatctgacagtcatatactgtagtattaggctattcctaacccaaagcactgtacatagtttccataaactccacatcatcaagaaactagtactagacactactctttcaatgcaaacaccactatctatacttaaatttaatgctacttatctcacatgatgtcttagatgttgtgtagaaactatgtctcatgcaagacatggtttccttctatttctttatttatttacttgtgacatcattttttatcttagatggcagcctatttaatactatggacatcatcttaaccattgagttaggaatggccttagcttggcgccacctgcagggacactgcatctgcatggtcggttcatgttacagcgtacaggcctcaacctctctccgctatatacactctcctagctggctaacatgtgtgtctgcatgcactgaatttttgtaaattcgtatgctagtacatggacaagaatgcagagaaaagaaacagatactagctcgatgaatgaattaattggctgtgctaagttttgagtactctctctatcccaaaatataaacatttttaactatggatctggacaactatgtatctagattcataactaaaagttattgtactatattttaggacggaggtagtaactagctagtctttacataaacgacagcataggccagattagttgtgatgcttggcctctcggaattactcctacacatataactcatgaaattaatagtgctgatgcatttatcttgaactcattttcacattcaactatatattatacgtactctgttcgttccatgttactactatgtttcatattataaatcgttttaattttttgagccaaactttattaggtttgactaaatttataaaaaaaaatatagcaatatttttaatacaaaacaaaaaaattatcaaaatatatttaatgttagacgtaatgaaactaacttggtgttataagtgttgctatactttttttataaacttggtcaaacttttaagaagtttgacacttcaaaaagtcaaagcaacttataatatgaaacggaaaagtgtaagttactttagatttgttctaagttaaacatattattgaaaaagtagcaatatcagggaggagacaggcccataacaattagagcttaaattaggtctaagctagtctccttaatcccttataaatcatttcaaaatttcattcaaagtctaaagatttgataaattatgttggtttagccttaggtttaattaattagtaaattcctgactcggctcctggttccaccctccatccctaaattaagtgaagctacttttagtatagtaatttgttctaaattgaagttatagtaatttgttcacctatcatctcatctcaaccaatattaaccattttgtgtgtttagtttctacacctacgactttctctcagtcaatttacaaacatctcccaaatattttcaaccactctcttcgtttcaggctataagatgttttgactttggtcaaagtcaaactgcttcaagtttgactaattttataaaaaactatagtaatatgtacattaccaaattagttttattaaattaataattaaatatattttgataataaatttatcttgggtcaaaaatattattgttttttctataaacttggtctaacttgaagcagtttgattgtgaccaaagttaaaacattttataacctaaaacggagtgagtactttcttaatttgtgtgaagctgttcagggatgtttatattttgggatgaaagcaatacattttttttgtacaaacttgaaataagagcaggtacaatagcaggctataagtcagttataaacatattttaaagagataaaggaagagagagaagagtagctggcgacagatttgtagccagctgcagcacgggctccaagacgcaatgtgtgtatgacaggtggtaccgggtattaatagtatagcaagcaactattgtatgaattggctattacattggttatagatgatttagagctggcagtgggttataccattaaactcgctctaaggggagtactagtgtgcatcaggcactgtggcagctacaggctacagctagggcgcgcgtgcatctgatagatatgatgcatgcacacatcaatgcacgggcgcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19499 - DNA, 11378 bp, Oryza sativa
atgttccaacaattagcagcaagaatcagcaggctagttcacttgactggtggatcttgacatatttgtgtgctcaatgtattattttaatggggtgctaattgagttttattgctggcatgcgtgttctctagttttgttgcagttgttaatttccataggtgtttttctatgcacaattcagtctgcttacacgctcaacctcgtgtgttgaagctggcttgtttttttctgtggtagcaagatccactacacaaggatcctttgcttgttgctggtgcaacatatggcatctgaataacgtggccatacaatagtaaataatttcaaagatcagagtgaacagtctttgctaactacttctataacaggcaataatggcaagcatcttataagaaaattaggtgcttctgtcaaagcatggatgaaatgcaacaagaagtagataaaatactgtgctttgtttctcaacttaatatctgtacaattcctctaatgtatatacacattgctaaaatgttgcagtgaccagcagatcctttaaaatttggacaccagtcacaggggatcaaagtggtatatgatctatctacaagctgagagtgttgagaagagaaactctgctctggatcgatttcctgaacagattcttgactccagtgtctaaatcagcaatgttcgactccaacacttgcaattgctcctcttggcagaaaagtgctctcttcttgaatgtcttggagacaagagaccacttgctagaacttggcatcgcaagttgccttgagagaagatggaatgaggtttcaagcattaagatagctatctctcttgcttcagccaacagcttgaccaccctgcagctttccagatcaactgaagaagacttcttgctgatcttcctgaactgtttttgtgccttcttgataaggcagatataagactggatcttcacttgcacagctgcattatctcctctcttcataatcagctgcatgtcttgaatgctttgcttaaggttggaaaagctctcctgcatggcattgcagaaatcgagcaagatgagagagcgctcaagctcttgctccactgctttcctctgcagtggctggcaaattgcaacatggctgcttggcaggcacatgatctcattgatgcagctgtagatattcccgatcctcttcaagccattactcattgtctcaatggtcgaagacgatgaagaaacaattgccttcaggttctggagctgcccttcgatatcgatttcgttggagcgagggctcgatggcacacttgcagatctcaggtggaatgccatgtcttcagaggaagctgtaatactttttttttcctcctctctctgaagttggaagaggagaaggtatgctacaatggtgtcgacacggttagctttatctctatatataacggaagaagaagaagaagaagcagaggcaatggcatctctactctgtagacagcattggaatctcaattacatttaagtaatgtgctgctgcaacggatgccacccatctcctcgacaagctgatgaattttatgtttggtaatcaagtgtgtgtaacagtgcaagtggcatgtctagctcatcttgtgtctatcatgtgctggctattggcagcaaactcattgcacgagcatgttgtttaaatttagatccagatccagatcatgggattgatgagcttgccactaaagagaacaagagctgttcctttgctcggccacgcaacaggtgactatacctccatgatgtgttcttatctggtacgttcttcgtgcagcatcacatcggtggcctgccttctgcactcacagcattcagcatctgctgcaatctcaagatgattccacgtgctgtccaaatttctgatgcattaggcctaactgagtcacattgtcatgttccagttattggcagcaggaatcagcatggcagcttattctattactgagccttgtcatacgtgtatgctccagcacccatttaatggagattgctaatcaactagtattggtgccatgtgtgctattgcatctgattgctgagcaatttatcaacaactatttagttatatggggagcaaaggatcttgtgcctgttcctgtctcatgtgaatactggtgacatgaccatcccatggctttacgaaggcaaggtgggaactgtgtacttattactaattgcatatattatgacagccaaaaatggtatgtgtcttctgactaatttattatttttttgcttgaacatgcttcaggtgaagcgctccaaatgtccggtgattgtttgagagcagtatgcgtcaagtgaagggggaaattagaggcaaaagagtgaaatattcattgaatgaactcctgtacatttcctcatgtatgatgtaggtgaacatacaaaattgttttggtgatcaacaaatcctctaataggcggacgccaatcacaggtgtcagagttgggaatgttccatcattctatctacatgctgagagcgtttagaagagaaactctgctctggatcgattttctgaacagattctcgattccgctctcaagatcaacaatgtccaactccaacgcctgcaattgctcctcctcgcagataattcttctcttttggaatgtcttggagacgagagaccacttgctataactcggcatcacagtttgcttcgagaggagatgtgatgagatttcaagcattgagaaggctgtctctcttgcttcagccaacagcttgaccaccctgcagctctcctgatcaggtgacagagtcttcttgctaatcttcttgtactgtttctgcgccttcttggcaaggcggatgcatgatggaatattggcttgaacagctgcgtcttctcctctcttgataaccaacatcatgtcttggatgcttgccttgagctcagaaaagttctgttgcatagccttgcagaggtcaagcaagacgagagagcactcgagctcttgctccactgctttcctgttctgtgactggcaaaggagaacttggctgctaggcatgcacatgatctcgtcgatgctatcatagatgctcttaagcctcttcaagccatcgttcatcgtcctgatggttgaagaaggtgaggagattgttgcctttaggctctgcagctgttcttcgacattggtttcgctggaccgtgggctggatggcgcactcgcagatctgagatggaatgccattatatttttctcttgttttcttttctctggagatggataggaagagaaaggaaactgtgctgcaatggtgtcgacctgggcatggtttgcctgtatatataacgaaaggagctcaagcaatggcatttctgattgtgtagacagccatggaattgttgtgctgctgcaacagaagccacccaactcctcgacaagctgatgttttttttcatgtaagaggcatctctagctcagctaatgattgtaccatcatgtcccgattattggcggcaaactcagctgcacgagcgggttgcttagtgttgaattcaagttcaagatggtgagaccaatgaagcatgcaatgaaatgggagaatcaatcatgcggtttctgcactagcatgttactcctgcctgccgtgctaaactgcaaaatgttcttatcagttgtgagttgtcatgctgcaaaataaggacacattgtgacattgtcaaccatctctaacaagttgatgcttcatgtcttaggttgtgttggcaaagtggcaaactcatctgcacgagggcgtggttggttcttgcttgtgtgagaggattcgttgttcttataaatgacagccttggtccattgacatttcagccattatatatcactctgttgtcttcacagcattgctgtcatgtttcagttgtatggtacagcacatttctctgttcaagtgttcattatggatatgatccacatttagtgcattttttcagtgtattaggtgccgttcgtgtagatgagtttatgttttttcaacatcagtttccggcatcagtctttgttatagtatgtttcagctgtctgcggttagtatttgatgttcatatgccttttattttgatattatgcatgtttgatcctttttcaagtacaatgttggtgcctcttaagagcttaattaccacatatacattttccagttattggcgagaatgaaaccagtagcgcactggtactaagccaaacaggtgcatgcatctttaggtgattctaaatccaaaatctttttaaggttttaaaccaaacatatcaaaatatattaatgccaaaattggtcaaatttcgtcattaccaagttttgataaaattgaaagtgtcaacaaagtgaaaggacccgagatgcgcattctctgattctcctccatcttcctcatcagcttgggccgaaattgacatgtgacgcccatagtaaagcccacacggcccataacccaccacgcgtctcttcaaatttccgcccctaaataaaaataaaacgaaataaaagaccaaaaaaaaaaaaaactcacgagaggcgcatcggcggcggcgccgccacagggccaccggccgccgtcgccggcgatctgcagggtcaagcactcaagcccccgcagcctgcttcccgccggaggtcagttcggaaccctacttttttattagcgttgcagtgggttaccgccgtccttccactgttgcgttatcgcattagcgattgggttagggaatgattacagactaattggtgctaatcacaaggtcagacctcgtggggttggatctggcatgctgcgtgtatgcagggcaggccagcatgatccaccattgaaggatcgtgcgctgattatgggattaaacaagtgcgaggtcacatggccactttgaaatcaaacatttaggttcagaaatggacagcattaagcagttgaaagttgattccatctacttataacttattctagtcgaatctctctcttttttctctatcttcctgagaagagaaatcgtgtttcacttgcaacaataattcacatcttctgtttttttcatgttttttttttgttacccatagttttatggacatcagcacatcacaaaatcacatcatcagataccactgaaatcagaaatcagaagcatgtataaatgattggagatgagacactggctagatcaaaactgctgttttcaattgctctttttgttctatacatttacagatgtacaaagattggcagatcctttaaaaggcggaggccaatcacagggtgttagagtgtcttcactttaggagaatctatgagctaagagtgtttaggagcgctactctgctctggatcattctcctgaacagaagttcggctccattctcaagatctccaatgatgcactctaatgcctgcaattgctcctcctcacaaacaactgatctcttcttttggaatgccttagagacaagaaacatcttgggaaccactagttgctgtgataggtggcacgatgtcgactcgagtagagagacggtgagcactctagccttgatcaatagcttgatcagcttgcagtcctccttgtcagaagtagtcttcttgctcatcttcttgcattgcttctgcgccttcttggccaagcgggtgaaagattggatcttgacctgaatgcttgcactgtctcctcttctgagagccgcgtgcagatcttggatgatggtcttcaactcggtgaagttctcttgcatggcactgcagagatcgatcagctcgagggagcactccatttccccatccaacattttcctttgctgtgcagagaaaacttggttgctgggcaagtggatcatcctcctcgatctgattgtagacatctccaagcctcctcagaccatcaatggtcgtggagggtgaagagatgcttgcctctaggctttgcagctcatcctcgatttcagcttcattggattgcctcttggatggcaaactgactgatcttaggtggcaagccatctttgtattggagtattcgagagttgggagatgtggaagaaagatgaaacttgggtttgatgtctctactcctcaggcgatgcctatttatacactggaagcaactgagacagcatcaattttttaagaaatgggagagagcgagcatcttttgaaaggtagacagaaagaatcatgccatttgatttcccagatgctgtctgttgaagttgcatgctaatgctgcagaagtgctgcattatcaaggcttttcacgtgaagtacacatatttagttcactagacttcacaaactggtcttaacactctgtcatgttgcaattataggtagcaagaatctgcatttgttccaaccgtcacgatgggtcttgagggaaatgcaaggaaaaccattaacaggttcttaattgagtattattagtgcatgtgtattagttcaattcttgttgctctttgacattagtaggtgtttccatcagtaaatataaatgataatgctaattaccgggttgtagctcgtgtgttggagctggcatgtttcagctgagtagagcaagatccatttcagaaggatcttccgctagaggaacatgtgagttaacataacctttgttcccataaaaaaaaaccattaacgtgaagcccgcaaggctgtaataacaagttgataaccttatggagacatgtcacttttgttttaacatcaaaaaattataagaggcacaaaattttacttggctggaacggcccggatcttaggttgttcttttgccctgtaaatggatggtatgtttgaggcacaatacctatattttagttatgagaaacgtcaatcagtcatgatgtgaataataccaaagactcatagcatgaaattgacaaaattgcttctctttctttttaatttagtgaactttgtatacatatccacaagactatacatgttgcaaaattgttgtgatcgactgatcctttaaaaagtggaggcctatcacagggtattggagctcaggttgcctatgagctaagagtattcagaagagaaactctgccctggatcaatctcctgaacagaagttctgctccactctcaaggtctttgatagtgagctccaattcctgcaattgctcctcttcgcacatgactttgctcttctggaatgtggcggagacaagagaccacttaggcgtctcaattttcttcgacaggaaacaggatgtagactcaagcaatgagacggtgatttctcttgcttctgctagtagctttaccaccctacagtccatcttatcagaagcagtctttttgctgaccttcttgaattgcttccgcgccttcttggctagccggatgtatgccttgacttgagcagacgcatcttctccccttttgatggccaacatcatctcttgtacactcatcctcaactccatgaagctttcttgcatggcattgcagaggtcaagcaagacgagtgaccgtccaagctcttcctccaccaacttcctttgcagcttctggcaaaggctaacttggttactaggtgtgcaaatcagctcctcaatggagttgtagatatctccaagcttcctcaaaccatcgcacatcgtgtcgatggttgctgatggtgaagagacgactgtgtttagggtctggagctgctgctcaattgtggtatcatttgagcaagggctggaaggcacgcttgcagacctttgatggcaagccatgtcgggattgaagctttggtgttattttcttctgtgggaatgggaagagaagagcaaggaagagagaagatgcactttgctggtactcaaacactttggctcctctcttatttataactgaagaagcagaaccaaaaacgtgattgggtttgaacagagcaatcgacagaaagaatctcatctactaacctccctgcattgtgcgttgtcataataagtgatctgttctgaaacatagccattcaagcctagacatgttgttattcatctgatttttaattagtgcaacaaatgctaatgagtgagcttatgagcctgtcatgtctcaactattgatgacagtatacttgcacgagggtttagtttgatttcagatccagatacatcatcaggaaggaaggaggaaaagcagccttttggtgctggtgaggaaataattattttggttttcttctgatactcctacattaggacgagttgaacattcatctctcatgcagcagcagcagcagcagcatcgctggcatgttccagctatccacagaaaggatgaccatgcaagtgcacgcattcttgactcaacaaccagtataatttatcttgtaatatcaaagtttcggttggatagatatgacacgatcatgtcaaatcatatttattagggaaggtagcagtgagcagctaagcatacagcagaaatgtgacttgattagttagcttaaattttgacaagaactttctaggatgcaacacttgcacacgaatgcaatcatcatctggcaaaattttttgagatattttaagagtttgcaggcgtgcaaggaagtgttgagaaatcaaacaatcgttgtcacagtagtcaagtcagtttgcgtagcttccgattgtacacctggatagagataatgtgccacttgttcataagttgatagggtaaacacaggctccaagatggtagagaaggaacaaatcacatgttaacaaaactgtgtaatttctttttgcaaggaagcaatgcatgccttctcaattatgtatcttgctatacatttagacttacgtacatattattcaaaatttgtggtgattgacaggtcctataaaagttggatgccaatgccaatggagcatctatgagctaagagtgttcagaagggaagccctggtttggatcaatctcctgaacagattctcagctccgctctctaggccaacgatgcccaactctaatgcctgcaattgcacctcctcgcatgaaactttggccttctggaacgatttggagataagagaccacttgcttggattgcaggtggagatttgcttcgacaggagctctagggcagatttcaggaccgaggcagtgatccctctcgctgttgtcaacagactgacaagccttccatcctcatcagaggtagacttgttgctggccttcttcaggtgatgcttagccttcttcaccaggcggatgtatgactgagccttcacttgaacaactgcatggtctcccctgttgagaaccatctgcagctcttggatggtcatcttcaggtcagcgaacatctcttgcatggcgctgcaaagatccagcacctccagagaccgctccatctcttcctccagcttcttgccatgtgcttggttgctatgcaagcttatgatctcgttgatgcagttgtagacgccaccaagcctcctcagagcgtcagacaccatttcgatggtggcggatggcgatgagatgcctgagcatatgttgcgcagctcttcttcgatcttgatgtagttggggtgaggcatagacggcaggcttgtcgatctttgatggccagccatgtttggaatgaaatttggtgctatgcctcagactctgagtgttgggagcagatgatgaactggtggtgctaatgctccaactctccctacttataatcaggaggttgagaagatggtatgaggcaaattatgcagagacagcaggaatctccactgctctgctctcccatctgctctttgattgcatggccaatgcagctgcagacaaggtgatgcccttcagatgttgtctaattccaggtacactgctaactaacctttgctgtgttgtcatgtctcatgcattgcaagcagagtaagctgcacgctcaagagattgtactgttgggttcttatggatgacaaaagcacaaaaagaacgaaacaacagaggtacgtggaagtttcatcggtgttgattgttgaaacttgtttcagatatcgtaagcaggatccaccatttgtattcacctgccaagttgtaaggatctgagcatatctgatcaaatgaacatctgaagcaacacatcatcacttgtttggcaacattggaggttcactactcgttgatcctgttgctctgtctgtaggatttttttttcttttatgtccaatgctttgtctacaactctaagtaggacttctccatcatgccagcgggctcatcggagattcctcatactgcaaatgatctcaaatagtctgaaaatttgtgacatcaaaaagacagccggaagatgcaatcctctaatttgctccagcttcagggaacagtgtgaataactctactttggctaagtgaaaagaactatgtgaagctgagctgatagcgtggctttgccccttcccgctgtttaggagttgcttttagctgccgcagtagttcctaagcttcagtttttggctttgctttttctcccttcccttgtaacaaaaattctttttcttctaatatattgacgtgtaatccttttgcgcgttcgcgaaaaaactgagctggtaatatattactctgacactagtctacttaaggaggtaacctatcctatgcaaataagtttcgggtgcatcctcaaaaattcttgaaaaaattatacatgtatttccaatagtattgtaattgtgtgtgaagtctctttaaaaaattcattatatatagagagagaccaaattctaacttacttatattcttaaaactattagttttataaaaaaaaacggatgaaataaaaataactttgaagcggagactttacatgtatgtgtagtactattggaagcacatgtacagttttttctagaattttaagtggaatttgttagatggtgtgcacgttgtgcatccaaaacttaggctgtgtttgagggagagaggattgggaagatacgcaaaacgagatgagtcattagcgcatgattaattgagtattaattattttaaacttcaaaaatggattaatatgatttttttaaataacttttttatagaaattttttgcaaaaaccgcaccggttagtagtttgaaaagcgtacgcgcggaaaacgagtgacaatctcccctatctccaatgaacgaacgcagccttagttaatgactgattgttagtccagtttatgtgaaagttgtttcacaacaaataatttcgtacatgtacgaatgtaaaagactaaaggagtagtagttatgaaacaaagctaaattgtgttcatcagcatatgtgacatgagaattctgatcttttcttcttcctttcgatgggtatgatggcatcggagagcacagtagtccaagagaatgg

SEQ ID NO: 19500 - DNA, 1722 bp, Oryza sativa
ggcgctgctgcttcttgacgtcggcgcgcgccttcctggcgaggcgcgcgtaggcgctcgccgcgctctgggcgccggcggcgtcgcctcggcggacggccacctcgaggtcaagcgcgcaggcgcgcatcgcccgcaggctgtccctcgctgcggcgcacgcgtcgagcagcgccaccgacgcctcagctccctcctccacctgctcggcgcaggcgaaccgcacgagcggcccgacgtgctcgtacacccgcgccacgccctccagcgcgccggccatcgccgccgccgccgaggaagacgacgacgacgacgccacgttctgcctcagcctgcacagctgctgctcctccatagctgcagatcaccacactagcttccctcaattcttgggaattaatggcgatcgatcgaggaagacgaatgcatgcaccatggacagatgcgatatatatcctgagccgccggaagaatctcatcgctggcatgtcggtacggcctgcctcgccggcaaggcctggctggcatgcctcccgtgggcgcggcacccacaccgcacgagcgcgcgacggcgacgacggcgacgcaccacgtacgtactaggaagcgtcgagcagttgcaaccacgagtggttggagcttgacgacgagctcggctagggacgcgtggcgcgtctccacggaagcgcgcgaagccgacgagtgggttcgcgcgcgaatttgaatgaatgattgcacggccgtaccagcgaaggaggggaggaggagatctttggggatcctgcaatcggattaaacaaacgaattaaagttgattaatttgtgctctgacgtgcatgacatcgtcagatacgttcatacgctggcctgatacagcattatctgtatctgtataagtataatcatgattaaggtttttctctgctgtgtttcgtctgattgatgctgtctctctcacctaatacatgtacgtgtcactttctcaccaggtttgtgaaactggtttgtcttgtctccactgatgcaacagatgacaacatgctgacatcctggcttttgttttctcaattcatcatggaattgttattactttttttattcttttttaatttttaattttaaaaatattttttccgaatctgaacattttagccacgccaccctacctgtagtggatgtgtctgtatcgttttgccacaccaataggtttagatttagaaataggttttgcgagattttatttttaaattaagaaggttcaaaaaaaatttagaaaaaaacttcaacatcatgtttcatatgtactgatctggttgtcactttcaagaacagcttggcaaccagattcaagaacagtgcatactgagacaggttaagagatgaaagaaaaaggctcaactcaagttacactcgctgtacaaagttacagtgtcacaggtacaaatgaatcatatcatgtgtatacagataaacgcagagagagactttttttcgacagccaatcaaattaggagattgaagagttgcagtatcagggccatgtctgcataaaatgctgtcatgctgaggctcccaattcccaaatgcttcggtgggaattatcgagtagagactccaaacagagcatcaaacatgtctcattatcgatgtagaggcaggagtgatatccattatctaaaaaaattatctcattatcgagtatcagataagattcatccacag

SEQ ID NO: 19501 - DNA, 889 bp, Oryza sativa
atgtgtaagggttctcaattcactcctcagatttcaggcatcagttctgtgcctccatatgaatacactttttgtgctagagagagcccagatgtagctgacattgaacgttgttacgcagaataaaagggacagagttccgaatcatatatcaggatgaaaaccaggcagaggtctcgttcgtcagaacatgggatccttctctagaaggcaaagctgttcccttgaacattgataagaggtgatccaatagcacaggcatacaatggagttgttctcagcaattcatttggaaaaggcaatcatgtttaacagagcaagtaattgatatattttgacagcgcaagtatgtttgtataggttcatcgtactccggggctgctcaggattctatacttacggaatctatgagcatcaggaagggtggcctggttttagcatggtagagaccagggtggccttcaagcttcggaaagacaagttgttctagttcctgaatttaagtttttttttcgattttgctatatctcactcgaaagttttttttcttatctctcactcgattttctcactcaaatttatagtgcattttcttgtaagttacaatgtaatttatgaaacttacgctgtaacttttacaatgtaattttgaatcttaagttttgaaatttatattggatttggtctttttcttgcagatatggtaattagtgtctattatggtgtttcttagacgcaatgtgtgtatgacaggtggtaccgggtattaatagtatagcaagcaactattgtatgaattggctattacattggttatagatgatttagagctggcagtgggttataccattaaactcgctctaaggggagtactagtgtgcatcaggca

SEQ ID NO: 19502 - DNA, 686 bp, Oryza sativa
aaccaagcacatggcaagaagctggaggaagagatggagcggtctctggaggtgctggatctttgcagcgccatgcaagagatgttcgctgacctgaagatgaccatccaagagctgcagatggttctcaacaggggagaccatgcagttgttcaagtgaaggctcagtcatacatccgcctggtgaagaaggctaagcatcacctgaagaaggccagcaacaagtctacctctgatgaggatggaaggcttgtcagtctgttgacaacagcgagagggatcactgcctcggtcctgaaatctgccctagagctcctgtcgaagcaaatctccacctgcaatccaagcaagtggtctcttatctccaaatcgttccagaaggccaaagtttcatgcgaggaggtgcaattgcaggcattagagttgggcatcgttgccatgggggcggacatcgcccccgccgcccccggtggcgccggagcggactctatctcccctcgccctttctcgccggagccttctccggtggtgggagtctgggagaccagaccagacgagtaggcagtagtaattttttctggggccgcgggcttacttgtatttgggcctggtgggtttttccggtatctcatattaagcccactacaaaatgggcccccccacaatcaaaatcaaaatgaacatcg

SEQ ID NO: 19503 - DNA, 606 bp, Oryza sativa
tggtgattcgcaatgaggagcacctgtgggcgttaaagtgctgcatcggacatcttgaggctggagccagactcttgatactgagacggatgcagaccctggttactctactgaacattcttagctcatatatacttcttaagatctgacactcttaagaccctgcgaggggcatacgtctttcaaaggagaggctgatccttcccactcgcatatggtataggctcactgtacagcctggaaaatacatgaagagagacaaagttttgatccaattcttgatgcgcacttgatcctctggtgttgcagagatacatgacgggctatgcaatctaatgtacatataatcgccctggcatatgactgatgcaatatctgggccagctcacgatattactttcatgtgtttgataccctacaggcgaactgatatatgatgcgccatatagctatcaaaaatggccatgtgggtcattccattctgcgccgtttgctgccttactagcaagcatctgaaccatgtgaagcggatcttgctgctgcaggaaaaacaagccaacttcaatacacaaagattagcgtgtgagcggggtggactgtacacaa

SEQ ID NO: 19504 - DNA, 402 bp, Oryza sativa
ttgggattctgtagacataacctaatagcatgcacttcttgcacataccacaacaacagatatacaagaaaatttgtattcactcatctgtgttttgaagcacagatctgcatcagaaaatatatccataggtttgtagatatccttcttgtcaaaagaatatgtcagtttgcttggactgtgccttgagatccttcaatttttttaaaatgttagtgaagtaatcttgcaaatacttctctaaggtgagaatatcctttgaatctaccccaagaagctggtatgtatcattcattggaactgagaaaattgtgtcactggagaggacctgaattataacaattaaatactagttattaattttcataagccttgacaattttataattactgaaaaatcaa

SEQ ID NO: 19505 - DNA, 2400 bp, Oryza sativa
ttatgcaaatagccacaaccgtcccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgccgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaaagtggtatcagagccaactcgactgtaggttgagccaaacggtcaaacactaaggacaagctttctgaaaaccctatttgaaaaatgtctcccctcgcccttcggcttttctttgccaaacggtttttcaaaattctcctccctgcccctccaattcctttagttgtcaaacctggaggacaaaccgccagcgtcatgcctgttcggaagtcaagtcaagcctcaagcttcgtgcagcaggagcaagaagttcagcccggagtcgtcgttgcgcgaagatcaagaagagttttcccgaagttcacctaaacctaatccttcccggaagagtagttcgttggattctagatcgtgtgttgtttgcttgtgtgtaggggtatggtttgcgtcattggtggggatgcgaccatactaggttgtttgcttaagcaacttgaacaataaaagtgtactcacaacagatcagtaggcaagtggtttagtaccttatctttagcgacccctctcttccacctctcttccgtcctggcagcagatggtcagtgttagagatagggtcaattaaagccacagatcaatggtttagttgaaagctaccaggtactcccaataccagaagaaccccagctcgtgatcagcttttggtatccaggatcagaagatgggtgtattgatgcaggagatgcaaagctcgatgcaaggtcgaatgtagcggaagcaactctagcagtagtgtgttgcagtcagagtcagtggatcagttcaaggcaacaagctaccagctgagtcggagcacctcgctctggtcagatcctggctagctgagatctaatgatggatgtgtcagatgttgataccgcaaccgtagagtccgaggcagcagatgcaacgacagtgtcaccgacaacaggtacaagctcggatgcaagcctagagtcagaatcagagttaatggcaaggcgtcagcgtcatcacatcaacagctgtatttgcaacacctcaactcctcaagttgtgtcagctccaatgtagagtcggtcagttcagttttgaggaatcaactatgcaactcgacaccgaagtcaggtcagaagaagaacagtcatgccagcagttggtacttatgggaaagttagtcaagggtcagtgtgttcatgagctaaatgagagtcacttttatgtggaatttcctatcatcaactaagggttaagttccaaatcttgtcgggatgaaagtgcatcgccattgcttcaatttgatggaccgatgaagttttagtcttcaaagtcagggcatctgtaaatccgagaaatgttggttatttttcaaggacaacagttcaaaggttctcagtcaggcgaaagtaagactacccacggtaaggggggggggggtaggtctctgagatgagttttggcttacctcgtcgccgtttcagtcgaaggatcgacgaggtgaaacaaagtggttagtagttaaaggagtcagttgcgagccactagcaaagttaccccaatctcaagtcaacaggttcgattcgaaggtacacccgtgaggccgggtcaacagttcagcttagagaagtagcatcgaggacggttgcagttcagacgaaagacaggtcaagcaggtttcctggaattacgtggcactcgagtcagaacccgttcaagcggacgtaggatcaatgagtttcaaaggtcagatgtaagtttcaggagcatccgtagttctggcctgggtcagttcaagcaaaacgagtcggtccagttttggcaaagcaaaggaacagaatggtcaatgccggtcagttcagtcgagcaggtttggaccattgaggaatcgttcagttgaatcagaaaggaacagtgcagtgtgcaaatcagtcagaccgcccgccagctccagctttctttccagccatcccagaatctcgggacgagattcctgtaaggggggtagatttgtaacgccccgattttcgttcgggattaaaaaa

SEQ ID NO: 19506 - DNA, 16720 bp, Oryza sativa
cctttggataaatcattatatgtcaactgaattcagggcaaaatatgtagtacaaactgtattatgtaatagaaacttagaaactatcgttacataaaaaatagatgtctaaaatggtgttcacgtcatcaaaaataaaacttttacttccagatttaatcatgagaaaaagttttactcttgttaacatggacaaatatcaaacatcaatttttggatccaacgatagttttcaggtttacaccagatgtgtggtttgcactgtatgttttctagaatttcagttagatgcccattacaccatcgcctgtgataagttctcagagtatagcattgctacaagcatgtattcggtaatcccttttaagcatacatgatatatttgagtagctacactgttcttttgattatacccttatatgagaaacaagagggacactgcctacatacagtataatttcaggaaaaaaacagttaatagattaagaaaaactattacctaaccttgaggtcttaacagattattcgcgttgatcagaagaggttgcaaaacagcaatataaacaacataatacatgatagcatgatggggaaaaccataatgatacagaatctgtaatatatatatataccataacgtgatgaactaaacatgaagacatatcaaggtatatatatatgaaacattattaattattcatggtaaacaacaacaagatggataacaccgactataatctataattctatactatacttctataagacaatagtggtcataatatcaatataacttgtgagtgctataacagcttttatcatgtactggtggagtggtgttgtagtaatagtcattagttgcgcgcttttgctgcaataaggttctttaattttcttgccatcacgattaagaaaacttacaaactttttaggttttcattgcagtttaaaatgagatagacaacacaatttattgacaagtacatattttctaatcatatgaaaatgatatatctttaacaaagatactgtcatcgatttgtacaaaaatctagcaatgacatttttcttttcgctttttgagacaaaaagacttgtttgaaacaaatagaagctaatatttttttttcaacaaggacatatgcgatttttttctattttgaattatccgttgtaatgcacagatatttatctacctagtctatactaatacaaaagatggtagtggcggtgagtctgccaccaccaccatcaccacccaactaccatacgggacccatgaactgtgagttgcttgtctcttagcctcacatgccatagttcccgtcgaaagaaaaaatatgacaatagaatattatgaaaaattttatcttacgtaatgacaacaaaattagcataatgatagtatagtagacaattaagaaaaaaaaacgttgcaacacacagccatcatgctattgtctagagaatatacaacaatggttcttttgtcataaaaaaacaactaggtaaacatgctggtttcatgcctacatgacatgaacaaaccagcatcagtataggaaaacaggtaaattaaactgagtacagatacatatagcatatcacaattcacaacatgatatgctcaaagagccatgaggccaaggatcgaaatgtagatcaaaataactaaacgattcttctgatgataatctcatcacaacacaccgaggagttcttccagcatcgtcgtccatgaattaatcccttcgatgcagcacaccataattattcaggatcaggatcattctggttgcttactgtgtgtcctcgccgtcgccggccggatcctgccagaacgaggagctgaggatgtcgtcgccgtcgccgagatccgcgaagaactccatgacgaactgatcagggctgtccggcggggtgtagacaccgaggagcttcggcttcttgtgcggcagcacgggctcgtcgtcggagatggccgacagcaggaagtcatcaggagccaccacgacgccgccgggagggatgatcatcggctggaagatggcttgattggccggtgcaggtgccagcgccggtgccggcgccggagctgcagcgggtgtagtcgcctgcagcatcggagaatcctcggcgaccaccctcgccggcgtgcgcccgcggccgcggcggccgccgcgaccgccaccgcgtccacgtccacgcccgcgcccgcgctctccacggccgccttgaacttgtagctcgggctcaggaaccagcgccgacgagggaggaggaggaggaggagcctcgcttgccggggctgatggcgccgccgccgccgccgcgcgacggcgtcggcttctgccgcgtccacgggcaccaccaccgcgtccacgtgggccacgagcccttggaacgagggagcgcaccaggtgggcgatcccgaagaagacgagcatggaacgcatcaccggcgtggtcgccggccgcagcggcgcgcgggggaagttggtcgtcgccttgtccccgtggatcaccgtcgccgcggtgtcgtacgcccaggcggcctcctcggcggtgccgaacgtgcccagccacaccctctccttcacccccatcgtgttgcggatgcggatctccgccgcgtacttcccccacggcctcttcctcgccccccggtacttcctctccgccgccaccagaagctccgccgtcaaaccttcctccccctccacaaccggcgccccgacgaaaccctctccctctccctcgacggccggcgccacccagccctccccgtttgcggccgcaaaaccctccgcctccacggccagcgccgccaacccgtcggtgttgatctccccctccaccgccgcagccgccgccaccgccccgttccccgcggtcgcctgcgccgccgcgcgctggcagtactccctgagaagctcgaccagccacgtcgtcgtcttctgcttcaccggcctccccatccctacgacctaactccggcgatcgacgccgcgcgcgcgccctagccctaaatccctaatccctctagatctgcctccctcccctgatcgatcccctctcgctcgctctcgcctcacgcttctcaggagagagtcactcacttgaatgcgaggccagccacagccacagccagcgccctaatagctttcactttttgtcgcgcgcgggtttcaaggctttcctcctgatctcacttggcggcgtcacggcttgcgtgtgctggcgttttgctagctagctagccgtttgctgggctagctggcgcagcagcagcggcggacagcggagcgtccgtacgtcgccggtggctggatgcgccgcccgcgcggtggccgtggctgggctagctttagctgcgttgcatgcgttgccagtctctctctctctctctctctctctctgtaggaaacgcagaggaattaagtgggcatcctctgccgtttggagattgtactggaggttgtgcagttgtttcgatctgggtcgctcatctggaaagggacgggaagggagtagtatgtcacatggtttatgttgccactcggtttgtttctactagggtaggtaggttggagtggagtctacaagagtaatgattcgtctgacatctacgtttgtggactctagtacactgtattaattttgatacaccaagatttctattaaaattaatgctgctaaagaaaataaatctattccttgaatagagatgcacatatttatcaattatttgcacaagaagaggcatatctttatcatcttgtggctactttggcaactttaaatttcgaaaggagcaaataatgggcatttcaatttttcaccaagataaatgacactgctctagattatacgggtcatagtagggtgagcctggctaatcgaagtatgtgaggtggcaacactactctaaggtgaggtggcaacattgctctagggtgtagacgatgggtaaggcagggaggtacttggtactattaatcagatcaacggcagcaaatatgatactagttgtgtctctagccaatagtgttcaaaaaaattgttaagacatgtaggttgtcggtgatatgggaccgggagtatcgtgactagaggcttgaggcagacacaaccgcccacgtggcctggcaccttcggggacgtcgggcccgagggtgaggtgaccgccctcctcctgatttccccgagggggggtcgggtgactccagcctcgcccccgagggccgaggcgccccgacccctcgcgttttctactccacgtgtatgggttaggtgagcacagcagggctcacctaaccgcatttatcgcgcctctgctaagcgtgtcacgccgcacgaagtgcagtgcagtgcactcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctgagccgacgtgtggtggacaagaatgaccgatttgtgaccggtctgacactgctcacgtcgtcagcacacaaccaccttcccacgacgtgcccgcctcaggcagaagtggaggtaggtatgtgccgtcccatcaggaggattttcggaggacgaccgtgcaaatctccgtccatttatgaaaagaagaaaagtccagtttggaaagggaagggtgcatgtggtatccccttgaagtataaaaggaggaccttgcccatagaggggtggattctttcgagattcagagcctagaacgagggagaggtcggctcacactttgtagctccttcatacacagatccaccaaaacacaggagtagggtattacgcttctcagcggcccgaacctgtatacatcgcttgtgtttcatattctcttgaaaggtcgcgatctttccgtcatctacagagagagcttgagatctcaccctgagcccccggccgaaccggcaaaggggggcctgtgcggtctcccggtgaggggccacgagctccgtcatctggcgcgccaggtagggggctcagcgtgtgttttctgagctctcgtactcctccgtgtgcgccaagttttttcttgttcagcctaatggccgggcaagcaaaggcgcacgacctctctccgagtgtgagcggcgacgacggggagccaaacccacgccgtcgagctcgtactccaccgcctcctccacaccaaagtcctaagcagggagaggcgctcgagagggtcgacaaatccgcggcttcaccgatcgcgggcgatggaggagaacggcgagatggggagcgtcgcctcctcgtctatggcgacggcagcacgccccagggcgcgcttcaggctgctggcgcgctcctacgtcacccgcccgtcgtccttgacccggagtctccagcccagcgatggctggacgacgtggccaacttggtcatgacggcacaacagcgcctgggagctggtggacggtccgccaccaccaagacctccggcgccgccactaccggctccgtgtcgtcaagacgaagggcgcggcgagcggcggctgttgcacgccattcggctgccactccctcgtcggcacctccgactcgggaggatcagcatggagagccggatgcccgcctcgacatcgagcgccggcgtaatagccggcgtactccccgcgcgacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccaccgagtttctctaggtctatacgaccgggattgaggccgctgggggtgacgacagagtcatggcgaatttctttcccatggccctgaagggacaggcgcggggttggctaatgaacctgccacccgcgtcggtccactcctgggaagatttgtgccaacagttcaccatgaactttcaaggcacatatccgcgcccaggcgaagaagcggacttgcacgcagtacagcgaggggatgatgaatcacttcgctcgtacattcagcggttttgccaagtccgcaacaccataccatgcatccctgcacacacagtaatctacgcgttcagggggggtgtgcggcacaaccgcatgctcgaaaagatcgcctccaaagagccccagactacagcagagctttttcagctcgcggaccgagtggctcgcaaggaggaggcctggacttggaacccctccggttccggagtggcagcttcggccgcccccggatccgccgctcagacagggcggcatgacaggaggaggaagaagaggtcggtccattccggcgacgagggtcatgtcctcgccgtcgagggcgctccgcgggccacccgaaaggggaggcctgcgagcgacaaaaagaaagaggccagcgttcccagcagggagcgccctaccggcaagtggtgcaccgtccacaacacctccctccatgaccttgcggactgtcgcgcagtcaaaagcttggctgagcggacaaggaagtgggaggaggagaggaggcaggagcgccgggaaggcaagtccccggcggttccttccggccgtcggcgaagtgaggccaagcaaaaggcccccgccgaggacatcgatgatggcgataatgacctaggtttccaagagcctggggctaccatagccactgtcgatggaggagcgtgtgcgcacgtttctcgccggagcctcaaggccatgaagcgagagcttctggccgctgcccctactcatgaggcgacgcgccgggcgcggtggtcggaagttgccctcacttttgaccagtccgaccacccgccgtgcgttgcccggggagggcagattgcgatggtggtttctcccaccgtttgcaacgtgaagttggggcgtgtcctcattgatggaggagcagccctcaacatcctttcccccgcagcctttgatgccatcaaggccccggggatgatgcttcggccgtcccagccaatcatcggcgtgacgccggggcacacttggccgctaggtcatatcgacctcccggtcacctttggtggacccaccaatttccgcacggagcgggtgaacttcgatgtggcggacctcagtctgccctacaacgcggtcctggggaggcccgcgttggtgaagttcatggcggctgtccactacgcctacctccagatgaagatgccgggccccgacggccccatctctgtccatggcgacctcaaagtcgcgctcgcttgtatggagcagcgtgcggaccgcctcgccgtcgtgtccaagcccgagggcggcgacgagaggcttgacacatccgcccccgccgccccgaagcagcggatagtcacgtccgatgaggtcccggtcaaggaggtcacactgggcgacggcccgtccaagaccacacggatcggtggtcttttggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccacccggagtggctggcgaacccggtggtcgttcccaaggcgaacggcaagcttcggatgtgcatcgactacaccgaccttaacaaggcatgtcctaaggatccttaccccttgcctcgcatagatcagattgtcgactccacagcggggtgcgaccttttgtgttttctagatgcatattctggttaccatcagattcgcatggctagggaagatgaggaaaaaactgcgttcattactcccataggaacttattgttatacaacaatgccctttgggttaaagaatgcaggtcctacttttcaacgtactactcgaatttctttgggtagccaattaggacgtaatgttgaggcttatgtcgatgacttggttgtaaaaacgcgcaaccaggaaacgttgctttcagatttagcggaaacttttgagagcctccgctccgcccgtataaaactgaaccccgataagtgtgtgtttggtgtacctgcgggtaagcttctcgggttcttggtctctgcccgaggcatcgaggccaaccccgagaagatacgagctatagagcggatgcgcccccccagtaaacttagggatgtgcaatgtgtcaccggttgcatggccgccctaagtcggttcatatcgaagctgggagagaaggcgctacccttatttaagctcctcaagcgctccgggccgtttacttggacggaggaagctgaacgcgccctcactcagttgaaagcatatctcagctctcctccggttctagtcgccccggagccaaacgagcccctgctactctacttatcggcgacccctcaagtagttagtgcagcgttggttgtggagcgcgatgagggcaatcctcattccgcgcacccccaccctgtgctgacttggcccgggagcgagcagggaggagaggcccccgagccgagcggtagcctaaggcccctggcgaccggagtcggccctctccccgctcgtcagatggtgctgggcgcccccgaccctcaggaaggccccgaggccactgcgggaaggctgcacctatcgccctcggaccccgaggctaaccctgtaccgattcgacccgggagggagcagggagaagaggcccccgagccgaacggtggcctaaggcccctgacgaccagagttggccctttgcccgcttgtccgacgacgccaggagcccccgacccccaggacggccccgaggccactgtgggaaggccgcccctgtcgtcctccgaccccgaggtcatcggcacagaagacaagtgccccccgaggggccacttggacgaggagcgccccggggatatggcccttagcgaaggggatcggccccaccgaagggtgcagcggcctgtctactttgttagcgaggccctccgggacgccaagacccgataccctcaggcccagaagatgctttacgctattctgatggcctcgaggaaactgcgccattatttccaggcgcatcgggtcaccgtggttacgtcttaccccctcggtcaaatcttgcataatcgggagggtacaggacgagtggtaaaatgggcaatcgagctttctgagttcgatctgcactttgaaccacgccacgctatcaagagccaggccctcgccgattttgtcgcagaatggaccccggctccagagaccgtctcaatccccgaggccaacacggacccctctcagctgcctcacaccgcccactgggtgatgcagttcgacggttctctgtctctccagggcgccggtgcgggggtcacgttgacctctccgaacggagacgtcctcagatacttggtccgtctcgactttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcactccaagctcccttagattgattgcttggatctccgagatccaagcatacctcacagataagactctacctgaggaccgtgaagggagtgaacgcgtccaacgcatttccaaacgctacgtgctggtagaagggaccctctatcggcgcgcggctaacggaatcctcctgaagtgcattcctcaggaagaaggcgttgagcttcttgccgacatccatgaaggcgagtgcggagcccattccgcctcgcgcaccttggttggcaaggcctttcgtcaagggttctactggccgacagctctcaatgatgcggtcgacctggttcggcgatgcagagcgtgtcagttccacgccaagcaaatccatcagccggcccaggcactgcagaccataccactttcatggccatttgctgtctgggggctcgatatcctgggaccgtttaggcgggccccgggcgggtttgagtacctgtatgtcgcgatcgacaagttcaccaagtggcccgaggcttatccggtcatcaagatcgataagcactccgcacttaaattcattaagggcatcacggcccggtttggagtgcctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaacattctcaagaagcacggcgattcatggatcgaggagttgccagcggtgctctgggcgaaccgaaccacacccagccgagcaactggggaaacgcctttcttcctcgtctacggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgacgacctcgtcttacgtcgcgtccaaacgcgtgctggattgagcaagctctcaccaatgtgggagggtccgtatcgagtgatcggtgtcccccggccgggctccatacggctggccacgggcgacggcactgagctgcctaacccgtggaacatcgaacaccttcgtcgcttctacccctgaggggggggtcgagtgtcaggttttggctcgggccaaccccgcacccccctcgggtgtgcagggttggccgggggctaccacacatgcacattctcatttctctcttttcagtatttcaataaaagcagtttcaatttcctaagggctgtatctgtgccgttttttcctttttgaagaattttgatttgaaatgaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgagccactagaggactgggatttgggcacgggcccttaaatcaagctaagacacaaaaagaggatcacggcacagatcatcctcatctcattcgcatagcaaaataaaattaacacaaagaattttttcatcatttttgattgcagattgtaagttgatttatacaaaaaacaggcccgagggccttagaagaaagaaaaagaagaaaattgaagattggcgggggcctgggggctcaatccgatgcgcccgggtcgccggcctcgtcttccacgtcatctgcaccgctggcatcgccctcctcgtcggagttgggggcgaacgtgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttgaagagcccaggccatcttcgtgaggtgcggagcgaggccttccaggttggtggagtgcgtccttgtctggcctttccagaggcccgcttgctgaccggcgcgatccaggcgggagaccgcatcccaaagcatgccgggccctatctcgctcgccaagcggagggcctcggcttccccggcggatgagtctagcgcgcgctgcatgtccgcgacggtgtgttcggcatctgcgaggcgggcggctaagtcgttttcgcccgcagccgccccgccgatgcacgccctcgcgtccagctccttttcccgcgcctcgagatcggcagcccgctgctccagtgcggctctctcggcgcggacggattccaaattgcggcgggcctgctccgtcagcgctgcctcacggagggacagggagtccgccaaccgttgcgcttcggcctcggcctcttcgagagctcgctcccgctcggcaagcgcgtcttcgcggaggcggagtgcggactcctcttcggcgcaggcagactcgtgcgccgccagcgttgcctcccgggaggtgacggcggcctcgcggtccgccaggactttctccgcgatgcaggcgcgctcctccagcgccatggcgcgcgcctcgagggcctcttcacgccgccggagcgccgcttcggtctccgtcgctcgctgctctcgggcagcggcggcatcaagaaccccctgggcggcgtcgagctttttcttcagctccgcctcccagttctcgtgctgaaggcggagggagtcctgcgcctcgctcatcacagtggtggcgatgagggcagccccccgctcctcctccacctctcgagcgatctccgccagtgccgtcttgcgggcctcaagatccgagacgtgccggcggtgtgccttgcggcccgcttctaccatagcctccaccgagcgccgcccctcctcgacacgcgcccatgcggcgtcgagctccgcacgctccgcctgcagggcctccacctgggcattgaacccatccaacaccgcggtatttgcggcggctaaggcctgcagaaggggctctgcgctcagcggggcggcgaaggcatggggaagagctgccttgaagaagacgccgcgcggctcggcccgccaatggacgcgccggcatcatcgcgggccacccccggacctgtttggtcttgggcgtcgcccgaaggggtgggcccaagcgaggcgtccgcggccccgtcgtgaaccgcctcggaagccgccatcgcctcagcccggcgaacccgggcggcctcctcccgagcggcttcttcggcctggcgaacccgggcggcctcctcccgagcggtttcttcggcctggcgaacccgggcggcctcctcccgagcggcttcctcggcttggcgggcccgggcggcctcctcctgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcgtaatattggctcatttgcaaaggcagcatttagcaaaacatttaagagaagtaaaatagtggagtaattaatcaggaattttaatcaacactgaacagcacacccatgctgcacaggcccaaccatcctgaacaaccatacccggctgtacagatctaatctccaaaccaggagctaagcaaattattaccaggtataacatccataactattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtacaccattcctggatcataatcacccccttataaaacaaggcatggactccccagcgacccccgtgggcttatttccgccacttctcagtctggtgctccgcaatgaaccatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgagctaccattaaaccatcattatataataatgaatcataagttatcccaatagtgtgctaatgtttctaagcatggctaagcaatcacatctaatatctagctgaaccaatatataaagctcaactagtcaaattataataacccaaggtatcaaggattaaagtaattaatgcaaacaggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcataattttagatgaattatgagacttgaacagcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttcaaatgaattagttatgaatttttaaagattaaatcggattaaaacctttaaactgattttaattgaattatgacgcaataatgaattatttttgaaaaggaaaagaaggattattgcgtcagcggctagggtttgcggtggaccgggtgcacggcagcggttcacggaaacgaacggccgagatcaaccctatccaaaacggacggccgagattgatcggtccacgaccggctcacgggagaagggatgatgatgacatcagcgacgacgtcacctccggcggcggcggctcagcggctctgacggctcggacggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacggcgacgacttggcgaacccgatggtggcgacggcgaccgacgacggcgactgcaacggcggcgcggcgcggctgaaccgacggcaacgacggcggcgactagggctacgcggaagcggcgctagacgcgacggcaggctaaggcaaaggaggcgacgggtagaggggagctcgggggtccttatataggtgcaaggaggcggcggcaaaggcccacggcgaccggtgacgagaaggaaacttcgggttggagggagaaaagaggaatccgattcaaactcgaatccaccggtttccaaagaaaattagccgatgtttccaaaagagaaaaggaagaggagatcgagaggatcatttgccctcaaacaattcggccggagaaggaaaaacgcggccgaatttggaaggaacggcggcggcttgcgctagggtttcggccggcggcggcggcgcgaagacgaaggatccgacaagcgggccctgtcacgtcctgataagttcatcccgaaataaaaatcatcttctaaaaggaataatagaattaattaaaattcgaaaagaaattggcaaacattaaaatacgtacaagaaaaattcaaatgtgacccggagaatttctgttaaattctccttggtctaaaaggagccctcaaat

SEQ ID NO: 19507 - DNA, 10920 bp, Oryza sativa
ggttaaagcaagttcgtgagggttcacagccttgaataataaatattgtgtagctctaggatcgtctttataaaataactttgggcaactaagtgacttttaaatgctgtttactgcaaaacctaacccctattattatccccttgtacccccctgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattgatacactagcgttcgggaaaaggcaattttcccggtcgcgacaagctggtatcagagccatctcgactgtaggataagccaagtggataaaacctaaggacatattatataaataaaaactatttgcgaaagttcctttttttctccttcccttaatgctatttgcaaaaggtttactcccttcttccttcttcggatttcaattagtactagttggtcagctttgtgaagaagatgtcgtcagttgtttgccgaagctccggaagactgcaggatccgctagtgaagtgaaggaagcagtgaagccagctgtgaaggagtgaagatcttggagaacccgtcgcagaacctaagccaccctctagtgtttcgttagtcgtgtgctcctttgcttgtgtgtgtagcgcgtggtttgcgtcggtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacactagtccaacacctgattaaccagaaccgattgcttatagagatactacagcagcaccagacgccaattctgaacttgagtcaaatacaacctcaagtacagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtccccagcagaaaagaaaagcaccactgcgaaccgaagatgaagtccgtaagatgatcattaccagcacagaatggcctccaccaggaatgacaaaacatcagagaagaaattccttccgaggtgcacaatagttgacagagcatcttttagctaatggaggtagagtgtctgatagtgaagattcagatcaagtctcctcagatgatgaaaataaaatagaacttaaggcatgctctcgttgtggagaaatcggtcatgttgccagctcgtgtgcctttacatgcgttcgttgtgaggaagaccatccacccgataggtgccctatgagcaggatcacttgtttcttgtgtgaaggaactgatcatgtaccaaaagattgtcaactcagttttctgctgacgaagaagatggccgaccaacacgcccattctaatggagagaagcatcaaggaagcacaaatcctcgccaagattacagtttcagcctaactccagtgccaggacagaggaaacaaaatgagaaaagaaaatgccgagtccgggaagatatccgttgcttcaattgtcaaggaatgggtcatttcgccgacaagtgcccaaaaccgagaaacatagctgccggcacgtcagtccacgcaactccctgcaatcagcagcttgctcctcaacgaattgtcatccatgcatcccgaagcagtcctttagcccgcgttgcaacaactccaattccaatgagtgcactaccacaaggtgtcaatgctcaatttcacccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcaggacccatagcagaaacaatgcaccaatgctcctcctgctgcacctgactcggcaataaatcttagcaaccattctctgcatcgacagcctcagcaaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcattatgcagtcctatcacatcatcacagaaccaatcgaggatgcagtcactggaacaatgccagctatatctctccagaatcaaaatgagcagccatgtttgtggttttcagtccgctacttatcatggtgtaatcgaaagtttgcagcaatcatgtaatacctaaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgttgactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaacccctaagggtacccgccatgcctctacattgataagttcggatatacctgcaaacagttacaaagatccaggagacatcaatatttgagaacataatagtcgatggttggtaattagtctatcaggtatcagaaaaggaacaaaggtgatatggcagaagaacaatttgaatgctccccacctcgaggaagcactaaagatgatcatcggcaattaaaccctagtggcgtagatacaaatagcaagcaatgtatttcccttaaggtttcactgaaaggcagcaagccaaaggacctcatcgtccccagaagcgtccgcaatccacattaaagaataccacctgttagagataagccgaaagatgattgaaaaaagagattggcaaagatgttctctagcataaaagaagtaggccgaaaggtgattgataaacagaaacatgctctgcatcgctcacggaagacccctgattgtaattgccccgcaacagtcaccttgtcattaagtaagcaagatgacctaggtaaaagtgtttctatgaaggcaaagagtgaaatcttccactcggtatcagatgctacacggagtgaaaaatgcatgcaccggttaccaggcaacgccatgtcctgggagatgatccaacgggaaagaactcatcaaggttaaaggtgtaaaggaatacgttgagtgctaactgatgacaacatgaagagaatagcggaaagtaaactgaatgtaaagaaagtgaatccgagttgcttgttcgtgagggctattcccagttatgaaccaagtgatatgttcgaagataatctacagaggtcagattaaaagcacatctaacaacgaagcctcagatttgacagggtaatgattagacaataacaaatccagcaataaagccattggagaagacgtcaaagtatgtcaagtgggataaattggttctcttgggaagcataacttatagttagagtggttgacccttgcatcgaatagcagaagtacctagcaccggagaccaggaaagctaatatgaggcagttggtggcaagttagaagtgaatgacaggcatgatattcttatgatgacaaacctggtaccctagtaatgacaagctagtgttgacgcatgacataaagtggtgacttgtatgaggttgactccgaagatatgaatcatgagaagttcgggaacggaagcatcattgaactaccgcaacctagtctgagtcagccaaaaggtgcaccctggtccaagtcaggtgaagagaagattccatccgcaacaggaggtcaagccaagcagttccgagtggtgaagttttgctggaagtttgtcaagacgcaacggaagaagacagacaagaagagaagaccgcccaacctaacttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaacattaaaatacgtacaagaaaaattcaaatgtgacccggagaatttctgttaaattctccttggtctaaaaggagccctcaaattttagtggaattttcagagcacaaataataattgagaagaaataaacaaagttaaaaaggttttataaaaagaaaatctctaaaaagtctgtttccccccccttcccctcttgggccggctcggcccagtccctccctctctctctctcttcccccgcggcccatcggcctcccccgtgcgcgcgccgctgacaggcgggcccgcccgccactctcgctgacgggtggggcccacctgtcatcgccttcctcccgccgcgcccgccgctcgcccgtgccctagcgccgccgccgccccgaatcccgccgcctcccgccgtccccgcgcgccataatgagggggaaattattccccgcgattccctctcccatttcccccgttttcccctctctctctccctcggattcgtccggattcatcccgcaatcgtcgccggcgtcttcaatggcggccgagatctccgcgccggtttccttcctctccggccgcgctctccccctctcggcgctatatatttgctccccgtgcttcgctcttccgtttccgccgctcgccgctcgctctccccgtcggattcgtgctcgcgccgtcttcctctctctccgccgtcgccgacgagctccggttcgccgccgacgtcgctccgcgcttcctcccgactcggcgccacctccgtcggcttcgccgcgtcgccgccgaccccgtccgccccttcgcttcgcccgccgaccgccggagctccgtcgccctcgtcatcccgaaccgcgccgccgcgttcctccgctccgttcgtcgtctccgccgtcctcgtgtctcggggtgagccgtggaccgtcccattcgcttcccccttccctcctctctctcgggtgccgctccgccgcgccggtggtcgccggcggtgaccatcggggcgcgggcgcgtcccccccctcccgtcggccgtgccggcgaggccgccttcgggcgcgccctcgcggctgccaagtgggcccggccgtcagccgcccgcgcccgcgggtgcggctgacgcgagggacccacggcgccgaccgccgccagccgcgtgctcccggtccaccgtggaccgagaggctgacgcgtgggccccactcccgtggacccggtccgcgcgccctctccctcggctgacgcaataaatgagtttttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgcttgttgtgtggagtttagtagagtaaaagccttttcttttccgttggtcgtgtagacgctgcagcttcggaagatccgcccttcgtggaagttgaagccagcgtttgggaaagtgagcaaggcaagtcacatcatccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaaccccaactagtgggtactctattcctggttccactagtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctatttgaatagccgagccctcggatatgggcaagccgagcaatgtaccaaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagctctaggatcgtctttataaaataactttgggcaactaagtgacttttaaatgctgtttactgcaaaacctaacccctattattatccccttgtacccccctgcattaattatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattgatacactagcgttcgggaaaaggcaattttcccggtcgcgacaggccccacctgtcagcggctgacagagagagaggagagcggcggctcggcggactgggccggctgggccgagggaaagagagaaaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttaacaaattaaaattagatcttctcttataagcttttaaaatcatttctaataattccttttaaacaacaatttataatttaaggatttttaaacaagaaaagctcttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacattttacttcacttgtaaattaaagaacatttaatataaattctattaataatttattaaataatttataaatcctgaaacgaaaatcaggatgtgacacctcccgagcggcttcctcggcttggcgggcccgggcggcctcctcccgagcggtatcctcagcctggcgagcccgggcggcttcccgggcggcttcttcagcttcccgtaggcggtctgcggcctctcgccggtcagattcccgcctccgtgcctctgcggccgccggatcttcggcctcggactggccggacttgggatggtgggaggaacgcgatgggatatcactgaagcaaaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgtcatggcccttaggagcctgctcctctgaggccccgaccgccgtcataatggtcaagatggaggcacgatctgggtcgctgcagagggggagaataccgtgggggatgagggacgcctccacggagttgagatttagcacccgttggaccagtatcttgaagtcctcgggggcccaatcccatctgactccctggtgggtccgcatgtagtcttcggacccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggctggctcggaaggcggaggcgcgcttcgtcggcgaggggggtgtagaaccagtcgctcttccagtcatcccacttcttgcggaggacgcaggggatgtagcggttcaacaccggcccccgcggcaggaaatagcagccgccgaccaccgacggtggcgataccgactgcacggtaaagaaccaccggaacagccggagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcgaaggggagaaagaagacggaccgccccgggtagtctggcgccgggcgtccctcacccagcattactatctcacgaccggtggcagattccggcatgaagcggcgcggcaacccggcctgcttctcgctcacaatgcgagaaggcggcagcacgctaccatcaagcagtgcggagccccgtgccatggcgccggacgaagagaagatgaagagcgagcgcgtgtggcgaaagaagggcgcagggaagaaggagttaggacgcaagcggcgaaggcaagggaaatgatggcgaaaggaaggagacaaatcccatcctccgtgcctttatacccttgccaacgctgtgcccggctcctcgtttctcgcgcccattatttcgccccctcgtttttcgcgcccacgcttccactaatcccattcgcccgcttgcggcgcgtgagatggatatgcagttgcggcagtcgagatagatcatatcgtgcgcgcgttaattacgctcgccaaccgaagcgacattaccgtatctccaggcgaggcaaatcggctcgcccagattcgtgcgccgctcaggtgatgtggcagtctcgaagagaccgcccattattgacagccaaattaccattaccaatatgcgtgatttgagaccgttgggtttctgcccaaccatggagaccggtcccacctgtcaccaagctttaggagtggcgtcacgcccgaccgcttcccttgagaagggcgatcgccctggcataacgccgggggctactgtcggtgatatgggaccgggagtatcgtgactagaggcttgaggcagacacaaccgcccacgtggcctggcaccttcggggacgtcgggcccgagggtgaggtgaccgccctcctcctgatttccccgagggggggtcgggtgactc

SEQ ID NO: 19508 - DNA, 15699 bp, Oryza sativa
acatgcacgttgctgagccgacgtgtgtggacaagaatgcccgatttgtgaccggtctgacactgctcacgtcgtcagcacacagccaccttcccacgacgtgcccgcctcaggcagaagtggaggtaggtatgtgccgtcccatcaggaggattttcggaggacgaccgtgcaaatctccgtccatttatgaaaagaagaaaagtccagtttggaaagggaagggtgcatgtggtatccccttgaagtataaaaggaggaccttgcccatagaggggtggattctttcgagattcagagcctagaacgagggagaggtcggctcacactttgtagctccttcatacacagatccaccaaaacacaggagtagggtattacgcttctcagcggcccgaacctgtatacatcgcttgtgtttcatattctcttgaaaggtcgcgatctttccgtcatctacagagagagcttgagatctcaccctgagcccccggccgaaccggcaaaggggggcctgtgcggtctcccggtgaggggccacgagctccgtcataggtagtccattggatggtcaatatatactagtataggaataagccgataatcaagttctgacagagaatggcctctaatatgtgacatcacgtctagtaatattttatatacagtgtcatttagaattctagggcttacgtcaaactagctagttatgccaataaacgcactttacatcaaataattttccatgtaagaaacgtttttggccaacgaatactcgggtagatactagggcttacgtcgaactagttttggcgccaataattaatagtactgtgatataagtcatctgatgaatacattccacgtaagcaacgctttttttctaataagtcctagggtttgcgttgaactaattttgacgtgaaatccaaatttcctcaacttacttaaaacaatgaatctatatgatttttttttgtttctcgcattatacgatttctaataaacaaagcatcgattacaagattttcttttacaccagtggctaaaaaataagttcttaattaacctacctgctagattgtcattaagataatttattatctgacacttggttaccactgctcaatagcaaagaggttttaccttttggagcataacatgtcccctgtgactctagctaggcaatagaggtagaaacaatacaatcatggtgaaacgtgtaagtagtccattggtggtcaatatatactagtgtaggaacaaaccaacaatcaggttctgacacgaagactaatatgatacgtcacatctagtagggaaataacaccttaatttgtgccaatgaattttagggcttacgtcaaactagtttcgccaataagcgaaccaaattttgacacgaaggttctctagtgtgtacatctagtaactttccacttatacaatgttttttgccaaatagtgcggcggatagtagggtttacgtcaaactaggtttggcgccaataataatattgtgacattaagtcatctcctgcgaatactgattatatgtttcatgcatgcaaacaacactttttttgcccataaattctatggctttcgctgaactaattttggcgcgaaatcctaatttccacaactttgaacaattaacctagctatatgatttccaacaaccaaagcatcgggcacaagattttcttttacacaccgttggctaaacaaaaacaaaaaaaattaacccagttgcacatgtgaaacccagttaaacatccacatgcaagggcaccagacatgccagcaatgtgtgtacaatgcgagctccagatcgggtttctccgatgctgcaacagcaactgcaaactactgattctgtagagtataggccgagaccaacggtttgcatcctgaccgtgataatctcttttaattaagcaccaaattaaaacattcatatctagctatgcaccctcacttgcatcatcagttgcggctacctagcttgatatatatagtcgttaattaatcgtggtaggctggcacagcagccagagcagagcgagtgaacggggggaatcgcgtgtgtgccgcacggtgggcatgcagctgcgctacatacaatcaaagtcgttcatctggaaaggaacggaggagaccagcatgtgtatacaataatccgtaatttctttggcggccaaaaaccgctaaggttagcctgtaaactgccaaagcaatatatcttcacggccaactgtaaagtaagaaccgctaattatagagcaacagggaaatccctattttttaactgctaaccgtgagggagagttttattggtggtccatctcaacatactatacgtatagtgtatgttgtggtggcttacgaccgcatgatacttggatacacacatggtttatgctagccgcgtgtatgtctagtacttcaatttgttttcagggatactgggtagaaagggaaagtatataaaagtaaatgattttgatatctctaagttggaccctagtacaatatctattatattattaaaggaatagaaaaaggaatagaaaaaggagcttccacgttcgctttcacggcctagaaattctcacattaatcggagaaaaagaaaaaacagagtctatatagaaatacaatttagaaatagctgaaattcgaaattaaaaaataaggaatattagaagaggagactagagtccatatagaaatacaattaggaataactaaaattcggaattaaaaatagagaactgctagaccacggcatcctgctaaatgggatagattatgatgggttaataacgagttgttgcccccaccaaccgcgtccatgtgtccccacgcgtctgcatcgctttcccccacgcgtctgcatcgttcacccatacccttcacgtgtctgctactcccccacgtgtccatgcactggcatcaggtcccctgtctaataccaatctggcaccaatatctgatacgatacttgatacctgaggtaccagatctggttggtacctaaggtacaagatctagtactatgatatcagattcgatacttggggtaccaaacctggtacgcactgtcaggtaccaaatctggtaccagtgtttgatcagatacttgatacctgaggtatcagatctggttgatacgtgaggtaccagatctagtaccataggtatcagattagatgcttggggtaccgtttgatccgagacttcatacttgaggtatcatatctggttgatacctaaggtaccagatatagtaccataggtatcagatcagatgcttggggtaccgtttgatccgatacttgatacctgaggtatcatatctggttgatacctaaggtactagatctagtaccataggtatcagatcagatgcttggggtaccaaacctggtacccatggtactagggttggtggtacctggtctgatacccatgacgtatcaagaccagtagttgtatattaggcctggtacttaaaaaaaagtaccaaagcgtggtacctagcgcagcggtatcatctggtaccaaacaagttatcttcttcttcctctcgctaacacgttgtatcccaattagccgttgatccctaggcatgaaatgaaagcaacaaccaaaaaagaaagattgtgaatagatgcaggcaacaaactagtagaaaatccgtactctcatcttcctcctcctcgtggacatctagccccatgcagcctctgctgctgctgcactcctgtcggcttctcgaggatggtgctgatggccagctcaaatagggtgttacgatcgacgtggcaggggaacggctccgggtggctagtggctcgtgggtgcatagagggcgacacggagggatcagtgtgcgcgtagtgggtggtggatgacgttgtgtagacgatgagtcaagatgaggcgtggggcgttaggtgatcattagtctatcccgttaggacggtattccgttttatagattttctgttaaaaataaggaatattagaagtagagtatagagtccatatagaaatacaattaggaaatacctaaatttcgcaattaaaaataaggaatattagaagtagagtatatagtccatatagaaatacaattaggaaataactgaaattcggaattaaaaataaggaatattagaggtacaatatagagtccatatagaaatacaattaggaaataactgaaattcacaattaaaaataaggaatattagaagtagagtatagagtccatatagaaatacaattaggaaataatagaaatttggaattaaaaataaggaatattagaagtagagtatagagtccatatagaaatataattaagaaaaaaaatagaaattcggaattaaaaaaataaggaatattagaagtagagtatagagtttatataggaatttaaaattaacctaaactttggaataaacataataaaattaaagtagagtttagagtccgtataaaaatacaatttacaaatggaagaataacctagagtctatatagaaatgcattttacagataatgaaaattcagaattaaaaaaaagaaatattgaaagacgagtctagagtccatatggaaatataatttacaaataactaaaatttaatattaaaaataattaataactaacacgtatatataatacagtataaatattacacatgagtagtttcgtaaagttagtacaaaatttaaaattatattatcattttaatatttttaaataatacattgagaaagcatatatgctattacttaagagaaaatataatgatgctagtcgcgtaatctgtgcgggcctccatgctagttaattttgatataccaagatttctattaggaatgttgctgaggaaaataaagtcagctctgtttggacaactaggagatagaatagaaaacacattcctaagatacagatgcacatctctgtcatcttggggctctacatggcaattagtatctctttcatcatcaagcaatcatagggataaatgggtttttaatttttcaccgagacaatgccattgcttcatacaagacaatatatagccgcgagcagtacgtcgccggccacgtgtgccgcgcggtggccggactagctgcatgcgttaccagtcaggagattgtactggaggaggtgcagttgtttcgatctgatcgttcatctagaaagggatggcgaaggtgtagtgtgtcttgcggtggcttaagactgaggatggtttggattcacatggtttatgttttgcatctcttgttcaattctcgatttgtttctactggggtaggtgaggggaataaacaagactttgtgagacatctaaattggactctactgtatttattaattttgatctaccaagatttttttctaggaatgctggtgaggaaaataaatacaccttttatctgaataaaagagagagataatagaaggacattcctaagatagatatgatcatcttcatcaatcgatcaattgcaaactagatgcacatccgtgtgcctaatttggcgactttctttctcatcttggccgccggcgatggctgcggcgacgcatgtgatggccatgcgatgttggagaagacaccattggggaagaaggttgtcatgacaacatcatgggctatcaacaccgacttttctggttatggcacaactgttgcggtggtgagcttagtcgtcaccggtgccggtgccggtgcagctacggcagaggcagcgggtatgtatgacaccgggaaaatcaaagaatttggctctagtgacggtgccggtgcagatactaaataaaaagggccaccatttttatgcaactttgagctctcatgttattattgtagaacaaaagaactcacacacaacaatagataacacattaattcatgtcaacataattaatgtgtgaaacacacaacatgattggggagttctaaacaagaccaaagtatgggtaacacattttaaattcgtggtaaacaattaacacggaaaagtgtctaattgaccagaataggtttcaatagtttttgttcaatcataagaaactagataaacatgtttgctaaattacataatagcacaggtaaattaaaccagcgtcattacaagatgaatacaaacaacttagtaaattgactgatacatagcacgtcaactgaagctggtgctttctctgaatcatcgtcttcattcgtaattggatgatggttcgttgaggtcaaagtcaaacactatcggcctctcattcccagcagcaccttgggtcaacgaggatgcgacatcggtggcagcctgagccgacgaggagggaacgtcgatggcagcctgagctgatgaggaggggacgttgatgaaagcctgaaccgacgaggaagggacgtcgacagcggcttgagctgacaacgatgcgacgtcaacggctgcctgagccgacgaggatgcatcgtcagcagctagagacgacgaggtgtcaacgtcgaggagcattgacatcgagctcagcagcacgggctcgccctgctcaccgtcgggcacatcagcgaagaagatgtttggatcaaagtccagagcctcgtggacggcgtagtttgtcggcacaccgccaggagggatcaccacctggaagaaggaatcgctagccgccggcggtggcggcggcggtggcggcagcgcatgcgatggccctgcagtgtaggagaagataccgttggggaagagagttgccatgacaacttcatgggctgtcagaatccgcttttccggtaaaggcgtagctgctgcggttgcaagttcaggcgtcatcggagccggtggccgtgcaactacggcagaggcggtgagtgttgatgacaccgaggaaatcacagcatttggttccagtgactgtgaaggtcatgatactagataaaaagggcaccagtatctttatccagcagcaggactttcactactttcccaagtaaagctagtgttaagagactggattgtagaagtgttgactgacttgactggaaatataatatggaaagactgatggactgactttatacaactttaagctctcaggtgattattcttgatgatcaaaaaactcacacacaacaataaataacacattagttcatctcaacataattaatgtgtgaaacacacaacatgattggggtgttctaaacaagaaaaaagtatgggtaaaacacattataagttcatagtaaacaattaacatagaaaagtgtctaattgaccagaataggtttaatattttttgttcgatcataagaaactagataaacatgtttgctaaattacatgataacacaggtaaattaaaccaacgtcattacaagatggatacaaatgacttagtaaattgatggatacatagaagatcaaacgaagctggtgctttctctgaatcatcgtcttcattcgtaagtggatgctggttcgttgaggtcgaagtcaaacactatcggcctctcattcccagcagcaccttgggtcgacgaggatgcgacatcggcggcagcctgagccgacgaggagggaacatcgatggcagcctgagccgatgaggaggagacgtcgacgacagcctgaaccgacgaggaagggacgtcgacatcagcctgagctgacgatggtgcaacgtcaacggctgcctaagccgacgagggtgcatcatcggcagctagagacgatgaggtgtcaacgtcgaggagcgtcgacgtcgagctcagtagcacgggcacgtcctgctcaccgtcgggcacatcggcaaagaagatgttcggatcaaagtccggagcctcgtggacggcatagtttgtcggcacaccgccaggagggatcaccacctggaagaaggaatcgctagccgccggcggtggcggtggcgcatgcgatggcgatgtaggagaagacaccgttggggaagagagttgccatgacaacttcatgggctgtcagaaccggcttttccggtaaagtcgtagctgctgcggttgcgagctcaagttttgctggaaccggtggcggtgcagctgcgccagaggcagcgagtgtagaaggcaccggcgaaatcacaacatttggttgcattaacggtgcagttgctagtgctgatgcagatgcaggcaccaatgccggttctgtagcaggtgtgggtgccgacggcgatggagtacccacggtcaccgcagtcggaatgcgtccgcgtccgcgcccgcgcccattccaaactccacggccacgactagcaaaggttgcctcagcaacacgcccgcgtccgcgttccggtccaccgcttttggagagggttgaggctgtttggagcttcctcttcttgggtacaggtgcagcagctgcggctgcaactgcaggcggcggcatcgggaccaggatggcttcaggcaccgccgtcggcggtgccaccgccggtgcagcagcagaggcgcctggcgcgagtgtggatgaccccggcgaaatagtggcattcggctccattgttggtgctgatgcaggcaccggcactggagctgcagaaggtggcagtggagcacctgcggtcaccaccgccgaagtaagtccgcatccacgcccacgcccacggtttccacccgcaacggcggcatcggcaacacgtccgcgaccacgtgcacgtccacggccgcgctctccaccgcttgcgaagagggttgaggctgtctggagcttccttttcctatcgggtgcaggtgcagcaactgcggttgccgctgcaggcagtggcggcggtggcggcgggatcgcttcagctgccaccggcgccggtgcaaatgcggctgcagcagaagcgctggctgcgagtgtggacgacaccgtcgagatcggtgcaggtgcaggtgctgatacaagtgccttcgccggagtggcagcaggtatgggcgccggcggcggtggagcacccacgatcaccaccgtcggagcgcatttggtttcggacccacgcccatggccacgaccggcagcgttggcgatggcaacacatccgcgtccccgtccaagtccgtgctctctgctgcttgcagagagagttgcgggtgtagcaggcggtggtgcgagcgcttcaagagccgccagcgatggagccggtgccggtacagcataagcgggcgcgagtgcggatgacggcggagaaatgacagcattcggctccaccggcggcgcaggtgcatgcacagcaggtgtgggcaccggcagcggtggagcaaccacggtcaccgccgtcggagcgcatttgcctccgcgcccacgcccaccaccgccaccgcgcccatgtccggtaccgacaccgcggagaagtccacgcccaccaccaacaccgacactggcgccgcgcccgcttccccttccaccaacaaatgcaccttcatcagatgtggcaccggagcaacatcagatgatgccggtgcgcctgcaccgaaaccggagatgcatcagatgacgtcagcgctggcactggagccgcatcaaatgacggcggcacgggcacctgcaccataaccggagatgcataagatgacggcggcgctagcatcggagctgcatcagataacggaggcgcggccacctgcaccatcaccggagacacatcagacgaaggcggcggcacaggcagcaataggagaggagtaggagccggagcctcgtggacggtgtagtttgtctgtagactaccgagagggatcaccgccaggacgaaggtatggctagacggcggcggaggcggtggcggagcatgtgatggccctgcaatgtaggaaaaggcatcgttatggaagagggttgccatgacaacaacgtgagttgtcggcaccggcttttctagcaatggcgcagctgctgcagttgcgagttcatgcatcgttggagccggtgactgtgcagctgtggcagaggcggtgagtgtggatgacaccggggaaatcacagcatttggttccagtaacagtgaaggttaagatactatatataaaggtcaccaatttttatacaactttaagctctcaaagtgattattcttgatgatcaaaagaattcacatacaacaataaataacacatcagttcatctcacaataatgaatgtgtgaaacacacaacatgattggggagttctaaacaagaccaaagtatgggtaaaacacattttaaattcatggtaaacagttaacacggaaaagtgtctagttgaccaaaataggttcagttggcttacgatagtttttggtcgatcataagaaactagataaacatgtttgctaaattacatgataacacaagtaaattgaactaacgtcattacaaaatgttaacaaatgactaattaaattgatggatacatagcatatcaacaagatcatgcaataaagcaaaatggtcatgagggtcaagtaaaccaagagatctagttaaggatggtccttctcgttgtctccatctcattagtagataatccagttgatcgcgatagactcatcaatccgaagctagtgctttctatgaatcatcgtcttcattcataattgattgtcggttcattgaggtcaaagtaaaacactattggcctctcattcccagtagcaccttgggtcgacgaggatgagtcgtcatcggtagcttgagccgatgaggaggggacgtcgacgacagcctgagccaacaaggatgcgatgtggacggcagcctgaaccgacgagagtaagggacggtgactgcagcctgagtcgacgatgatgcgacgtcaatggtagcctgagcagacgaggatgcatcatcgggagccagagacggcgaggtggctagtaattggaaggagattgacttgcgagatgattcacctccatggattgttcaatggtgacgtcgggcgggtgtcaacaccgaggagcgtcgacatcgagctcagcaacatgcgctagctcatcctgctcaccatcaagcatgtcggcgaagaagatgttcgatcaggtcgaagtcaggagcctcgtggacggcgtaatttgtctgcagactgccgggagggatcaccgcctggaggaagatattgctggacgtcggcggtggagacgacgacgcttgtgatggccctgcgatgtaggagaaaacatcattggggaagtgggttgccatgacaacatcgtgaattgtcaacaccggcttttctagcaatggcgcagctgctgcggttgcgagttcaggtgtcatcggagccggtggtcgtgcagctacggcagaggtggtgagtgttgatgataccggggaaatcacaacatttggttccagtgactgtgaaggtgatgatactagataaaaagggaaccattttgtacaactttgagctctcaggtgattattcttgatgataaacaaactcacacacaacaataaatcatttggtcgttaacaataacacattagttcatctcaacataattaatgtgtgaaacacacaacatgattggggtattctaaacaagacaaaagtatgggtaaaacacattataaattcatgctaaacaattaacacaaaaaagtgtctaattgaccagaataggtttcaatagtttttgttcgatcataagaaactagataaacatgtttgctaaattacatgataacacaggtaaattaaaccaacgtcattacaagatggatacaatcgacttagtaaattatcggatacattgcagatcacccgaagctggtgctttctttgaatcatcgtcttcattcgaaattggatgctggttcgttgaggtcgaagtcgaacattatcggcctctcattcccagcagcaccttgggtcgacgaggatgcaacatcagtggcagcctgagccaatgaggcgggaacgtcaatggcagcctgagccgatgaggaggggatgtcgacgacagccagaaccgacgaggaagggacatcgatggcagcctgagctgacgatgatgcgacgtcaacggctgcctgagccgacgaggctgcatcgtcggcaaccagagtcaatgagttgtcaatgtcaaggagcgtcgatgtcaagctcagcaacacgagctcgtcctgctccccgtcgggcacatcggcgaagaagacgtttgggtcaaagtccggagcctcatgtatggcgtagtttgtcggcacaccgccgggagggatcacctcctggaagaaggaaccgctagccaccggcggtggcggcgcatgtgatgacccggcagtgtaggagaagacaccgttggggaagagtgttgccatgacaacgtcatgggctgtcagcaccggcttttccggtaaaggcgccgctgctgcggttgtgagctcaggtatcgccggcaccggtggccatgcagctacgccagaggcagcaagtgtgggcggcaccggtgaaatcacaacatttgactgtattaacggtgcagttgctgatgctggtgcaggtgtgggcgccgacggcgatggagtacccacggtcacctcagtcggaatgcgtccgcgtccgcgcccgcgcacactccaaactccacggccacgaccgacaaaggttgcctcggcaacacgcccgcgtcctcgtcctggtccaccacttccggagagggttgaggctgtccggaccttcctcttcttgggtacaggtgcagcagctgcggctgcggctgcaggcggcggcatcgggatcaagatcgcttcaagcgccgccgccggcggtgccaccgccggtgcagctgcagctgcagcagaggcgcctggcgcgagtgtggatgacacgaccggcgcaataatgtcattcggctccagtgatggtgctgatgcaggcgccggtgctggagctgcagaaggcggcggtggagcacccacggtcaccaccgctggagttagtccgcatccgcgcccacgcccacggctgccaccggcaatggcggcatcggcaacacgtccgcggccgcgtgcacgtccacgtccgcgctctccaccgcttgaggagaggcttgaggcagtcaggagcttccttttcctttcagctgcaggtgcagcagctgtgcttgccgcagcaggcaatggcggcggcgggatcacttcagctgccgccggcgctggcgccggtgcaaatgcagctgcagcagaggcgctggctgcgagtaccggcgagatcacagaactcggtgcaggtgcaggtgctgatacgaacgccttcgccggagctgcagcaggtgtgcgcgcctgcggcggtggagcacccacggtcaccgccgtcggagcgcgtttggctccgctcccacgcccacggccgcggccggcgaccgcagcgttcgcgatggcaacacatccgcgctctccgccgcttgcggagagggatgcaggtgcagcaggtggcggcggcgcgagcgcttcaagagccgccggtgctggagccggcgccggcgcagcataagcgggcgcgattgacgctggagaaacgagagcatccggctccaccgacagcgcaggtgcatgtgcagctgctgatgcaggcgccagcgtcggggctgctgcacctgcagcaggtgtgggcaccggcggcggtggagcaaccacggtcaccgccgtcgtcggagcgcgtttgcctccgcgcccacgcccgccaccgccaccgcgcccaagtccacggccgccaccaacaccggcaccggcgccgcgtccccgtccaccaacaaatgcagcttcatcagatccagatgacgtcggagctggcacctgcaccggcaccggcaccagagcaacatcagatgacggcggcgcgggcacctgcaccggcaccggagatgcatcagataacgtcggcgctggcaccggagctgcatcagatgacggcggcacgggcacctgcacaatcaccggagatgcatcagataacagcgtcgctggcacaggagctgcatcagatgacgacggaggcgctgccacctgcaccgtcaccggagacacatcagacgaaggcggcggcgcaggcagcaacaggagaggagcaggagcaggagcctcgctcgcctccgcctctgccgccgccgccccacgttcctccaccacacgctcgcggcgagctcgagctcggtcgaagaacgctagcatggaccgcatctccgccgaaagcggcgacggcgtctgcgcgggatcgccgaagttggtcgccgccgcctccccgcgcagcacccgcgccgccgcgtcgtacgcccacgccccctgctccgccgtgtcgaacgtccccagccacagccgcccggcccccgtcgggttgtggatctcggcgacatacctcgtcccaaacctcaccctcaccccacgatacttcgtctccgggtcaatctcctcccactcctccgccgccgcctgacgacgccagcgccgccgctccacggcggggacgacgcgaacctcgccctccaccaacggcgaaaccaaaacctccgccgacgccgacgacgacaccacctgatccccctccatgacgggcacaatcacgagctccaacccggaaccggccctcaacctctccctctccccgggcgacagcagaaatccgccgccgccgcccgcggcggcggcgcggcggtactcgttcccccgtacctgcacggcgaggcgcgccgactgctgggagtactccaccagcaagcctttcatcgcctccgctactctctcctccggatccattcctgcgacctactcgatcgagactcgtgagagattgtgtggagagagaggaagaagagatcgatggcgatggagatcgatggatggcgaaatgggggtggcggcgtgtgggatttaaggaggaggagagggggggggggggagcgtgtccgggcgtcgtcgcggcgtcttcaagccgagagctaggtcacgctggggttgcctttgctgccgtcgtcgcgtcgtcttcaagccgttgtgacgcacgcgggcgtatgcggacagctagcgtgggctgtgcttgcatggctgcatgcgtcaaccagtggactcgatcctctggtttagggaaggaacttgaggggatgcggttggttcgatctggaccgttgatcgtgaaagggacgatgagcggtggttagcggtgatgttttgggttgccgttttggcttttttttttctttttctttttcttttttgtgcggggaatatgtgcttagccggaagcgtgagggtttgcggggaatatctcctatcttaatcttcctatctagccagcagaaggttgtcagggcaggtaattaatgtggtggggttgttaatgtgttgctaaacatggacgtgctgcagtaattagctgcctagatcagcaaggtttgaaggtttagctttgatggatcagggcagtaccgttgatcggattgagaacatagttttcttgtttccttttctttatgacttatcgatatgcttcctccttataaaggataatcaatttctagctatgaacatggacaagcatttgtccaagttcatatatagctgggaattgatttttttcaaatggagggtgaaggctgatgacttgtatgtttctttttttttctttgtccgaattgcaatagtgttgagaaaatttggggaatgt

SEQ ID NO: 19509 - DNA, 969 bp, Oryza sativa
ccccccccccccacaaattttttatttttcttttatttgtttgatatttttttttcacgcttagggacaggcaagaaccaaccatagaaaaattgaactcaaatggacataatatgtgacctgtagaatttttcctctcatctcctctcttcgaactagtgcagaggagacagatgtgcaaattttttatttttattttatttttttgatatttttttcacacttagggacacacaagaaccaaccatataaaaaataaactcaaacggacgaaatatgtggcctgtagaattttccaaagctctaccaaaaaacttctctcctcgaaaacacaatcttgcaagcggaatttggaggttttagtatcgccaaacccggcgttgccagggagaatcggatgtaacattttctgtagattatttgcctgattccgagtccgtatgagaaagttacgcctattttaataaatgacacccgaatgacttttcggtagagctttggaaaattctacaagtcacatattttgtccatttgagtttattttttctattgttggtttctgtattctcctaagtgtgaaaaaaatatcaaaaaaaaataaaaataaaaaaattgcatctctctgtactgtttaacttatggctatcatttcatgtggttatattttgaattagagattaagtaacttcatatagtggtagagtgcattatgtttaacatgctgatcaaagggttttactaaagaagttatggtctaattttgatgaaggtgcaaagtaggctaagtggtatgctattttcggatatctagctaagtggtatattccgttcgagtttaaattttttttgtttttctctagtggttggttgtatcgtgatcctaagtgcgaaaaaacatccgaaaaaataaaacaaaaataaaaaggttgcaaactctatataaagaaatagaaatggaggcgaggggtg

SEQ ID NO: 19510 - DNA, 5829 bp, Oryza sativa
tgaaaaatccgcggaaaaacataggaataggaaaaacgtaggaattggagtggcatattttcctaatcctacaggaatggaaaacacaggaaatatgaagagagtccctttgatagcaccataggaaacaaacaaaataaaggatagtttccaagaggttgaacctcttgcttattttcctatgaaattgagctataggaatgcaatcctaaggaaaatttcctatactttcctatgaatcaaagggtttcataggaaaaaatccttaggaaattaaatcctccaaaattcctatgacaatcctctaattcaaaggggcccttatatctcattacgcctaccgtcggctgcaaaccgaggaattttgctttgataccccttacctatctatacaccaacactacttttatattaattatggtatagagagggttgcattggctattctttggttttgattttgtgcctattcataaattaaaatcattcaaaatcatcttccatatcgggatatgtatttttgtccataaaaattttattgctggattctatgaaatcaaacaccacatgtatatctctgtctatgttgtgtataacaataataaatttgttatgaaagccaacaaaataagcgtatatatctattcgccatggtactattgtaggtctatctgcatatctcttctagaattaaataagcatatctcctgtcttatcttctagtgtgtgatttggtttgaatttattctataattttcaatacagttctattgctacatatcgcagttaaatgatgattaggatgacaaccaaccatgtcataaataagagctagtagtgctaaaaccaaacgaccaataatacatagcttttgtcacgaacgagcattgtcctaccaattttacttcttgattctaaataaactagctcacataacaaaacttgaaattatatacaccaaactgaagaggtgccaagaacaatgtatatgtgtatctgctctttttttttatcaagagcaagttttatattgtttgtttgtatatatcccctccttattgttgtctcactcctaacttttactatagtctttttgttaatggagctagcattgctgtatatatgttgattgccgcttttttcctcctcttttagcgcatgtgtacttcgccggaagggtgaggcttgcatgcgaggaacatcccgtctaatagtagccaggagattgtgagggcaagtaattaattaatggagatgctctgcagtaactaccttcctagatcaccaccaagggttgaactatggatgctgcacagcacgatgggcagattttgatcgatcggagaaattggtatatgtacgttcttatcaagatgttacttagcgcatatgggtcttgtcgaaacatgatttcggcaataataaaaggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggacggggagcaggattacaagatagaaaccttaaccaatacggtatcggtttcctaaatctactttacaatattatcaaaccaggactttaggccgttccgtaatatacaaggaaacataacacccaagtcatgatctgttacatattacatagatataagttatcccctataactagtcggataaccatgccgtgtgggtatggggtacccataatctccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaaccctccaaataacatgatccgagtgatataccaactgctttgtaaaatatgatgcgtacaacctaaagttgacaacatctttgaaagttcacatagcaaaacaactataaagaagcttgaatgctgtgaataaagaaatctccaaagtattgggcatacgccatgcgcacactgcttcaacagatgtgcttaagtccctaaaagacacatggtttcaccacacctggaaatatatggcatatgtggtataacatccgagtaagtaaactcataaaggatttaccaaccgcctgaaaaatgaccataatatataatcagcctaagtcataatattggtcaataaaaatgcacacttacgtggcaaaaagcaatgatattgtatccaatcaattgcttgataaatccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctaggtaatatagaccaagtgtagctcatatgaatagcttctgatctgatagattatcccttatgagatactccaaaatatatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtccattgatggtagctgacgcagttggcatagagacaagacgaccaacatagagataatattgcccaccagaggtggcaaaaatattggtggtagtgaagataatgataccaatcaaaagtgatgaagttgcacagccgtggaggcgaagaaaccagtcggcagtagtcaggtcagccatcaatgaagatgaaagagcccagcgataaagttgtgtagccatggcagcgaaataatcagtcggtgacagacgaggcaaatcaaaggcgatgacaaaatccaccaatcatggagatgaagaaaatagtcggcgacgacaaatgcaactgacatgatgaagatgacgatgtcggtgatccagtcaatagcagcgtcacaaccaatgataatgacgaagacgctcatcagcatttgcatagtaggtcaaccgtcaaggtgaaataataagtcggcgaaaacataatcatccattagcaacagcggagatgtcagggccgatgaagcggaggtgctggtgatgatgtcagtgacaataatccatcaaattagtgttataactgttgtagatgcttcacttggaggagagttgatgttgttgcccaactcgtctaaaccgaaatatttaaagtttgttgaagtagaatgtctgctccgaatcaaagatgaagataatgactcctggagttgactcgttggttgatgaattgatttcttcagcctgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtgaaataacatggcatcgtatgccgagatgtcgaggctaacaaagacgtcgtggttggtgaagtagcaaaacttgcgaagtagcagcaatagagtttgccagtgctgaagataataaagatgaagtcgctctatcatgatgacaaagttgcattgccgtgatgaagtgaacacgagtcggcggcaacagaagcaaactggtagtgaagacgcgcagttgtgaagataaaagcaccagtcagcgacagcataaccagtcggcgacggaaaacgatgatgtttatcagtagtggtagctgtctaaaccagacgtagaggtgagggcactagtcagcagtagacgtagacagcttgcgttgaagatgatgatgcctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataacaggccagccgtgcaggcggaaacaccagtcgacggcggtcgaggcggccggtcggtgaagacgtagacgcccaacaacggcggcataaaggccagcagtgcaggcggaaacaccagtcagcggcggacaaggcggccggtcagtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcggaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcgcagcggcggtcgaggcggccggtcggtgaagacgtagacgcccaacaacggcggcataaaggccagccgtgcaggcggaaacaccagtcggcagcggcggtcgaggcggccggtcggtgaagacgtagacgcccaacaacggcggcataaaggccagcccgtgccggcgaaaacaccagtcggcggcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccacccgtgcaggcggaagcaccaaacggcggcggacgatgcggccggtcggtgaagacgtaaacccccaacaacggcagcataaaggccagccgtgcaggcggaaacaccattccgcagcggcgaaagcaagccggtcggtgaagacctatacgcccaacaacggcggcataaatgccagccgtgcatgcggaaacaccattctgcaagcgcggtcgatgccgccggtcggtgaatacgtatacccccaacaacgg

SEQ ID NO: 19511 - DNA, 8652 bp, Oryza sativa
cggcataaaaggccagccgtgcaggcggaaacaccagtcggcggcggcgaaggcaagccggtcggtgaagacgtaaacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatagcggaagtggccaatgtgggaacaaagtcgtccatcaataacaatgaagacaccagtcggcggcgacgaaggcggtcgacggtgaaagcgaagatgcccactaatggcggcataataggtcagccgtgtaggcggaggcaccactcggcggcgacggaggcaagccggcggtgaagtcgtagacgcccaacagcggcggcataataggccagctgtgtaggcggaggcaccaatcggcggcgacggaggcaggccggtggtgaagtcgtagacgcccaatagcggcggcataataggccagccgtgtaggcggaggcaccactcggcggcgacagaggcaggccggcggtgaagtcgtagacgcccaacagcggcggcataataggccagccgtgtaggcgaggacaccagtcggcggcgacggaggcaggccggcggtgaagtcgtagacgcccaacagcggcggcataataggccagccgtgtaggcggaggcaccaatcggcggcgatggaggcgggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatttgagattaaaaatcaacatgataaataatgataaaaatcagattgagtttccccctgactgatttggatcaagtcagagaagaggagcttgaagaagtgatcgacggaaaggaagtgaaaactcccaaagcgaaaacgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggacggggagcaggattacaagatagaaaccttaaccaatacggtatcggtttcctaaatctactttacaatattatcaaaccaggactttaggccgttccgtaatatacaaggaaacataacacccaagtcatgatctgttacatattacatagatataagttatcccctataactagtcggataaccatgccgtgtgggtatggggtacccataatctccacaggtctctctatgttcttatccttaaaaaaaatcaatgatagtttctagatatgaacgtggataaccatacttgtctgatttatagttaggaattgacttttttttaagaatgtgtaggttgatacttgataacttgtatctttcctctctcttttttactttgtgataaacactagttttgtgtgcgaattgcaattaatagtgttgagaaatgtggacaatgtgaactgggtcatggataaatttgattcaagatcacaggattaatgtcatcatagtgttagaatgtggtgtgtggtccagtacttaaaaatgggcgtaatttcccgctatcggcttggcttatgggtgtggcactattaaattatgtcgttatacggcggcaattaattccctatataagcgcctatatagtaggctctaaacgcatcatcctacaccctcacctcttcctcttgctgcctcaccggcattctcctctcctgcaagatccctcgttcctctcctttcatcctcctcactttttgtacattgttcattcaaatcaataccatatgaatcatcttttgttgttaaaagggtgctaccggtgggtggtttattttatcccagtgtgcactcatcgggtgctcaaattaaatttaacatgtgacaagatgcaaagaggacatgcaagcttagctccccatcatccatcaacaaatgcaagtgcatggtatggatctcaacataactgaggaaaacacaatttattcgattttgacttgcttgttttcatatagagggatttataaaaatttactacctccattctaaaataggttcactcttattctctagcatttatccccaaataagtaatttatatcgcctacgtaccctcgaccataaatctaggagttctatcattacctcttatctatctaccaaccaacagtattctattaatgagggtcaccttgttttttttttctcttcatactaattttgaatcataatgattagaaattaatttattttggatcaggggtggagtattgactattgtttggtttcaatttcgttcctactcatgaaataaactttcaagatcatcttctatgtttttttacgggacttgttcctatatctttttgtccataaaaattacatcttcaattttatgaaatcaaactccatatgtacaataacacgatctatctattctgcgtataaccacaaatttgttcaacaactatcaaaataataatatagcaaaatgatagttgcaatggtactattgtaggtttatctctgcatatctcttacattaaataagtacatatcttatcttatcttatcttctaaggtgtgatttggtttgaatttattctacagttaattttcaatatacatctattgctatgtatcgcagttaaatgatactaggatgacaaccaaccatgtcataaataagagtaactgaagttgctaatgtctactggctagaataaacgaatatatatatctttttgaatttaaccttaatagcagtagacacctaaaaacaaacgataaattaatacaaactttttgtcacatacatgcattgtcctaccaattttactttgattctaaaaacttcgcgcaacatgaccaacttaattacaccaaactgtagaggtgcgggccaagaacaatgtatatgcagtattctttttctcaagaattaacaaagctttatattgttttgttttgtacccctctttattgtctcactcctagcttttactagtccctttttttttgtggagttagcatatttctttcttgcttaaattaagtacaaacgaccaaaccactttgatgttttgtggtgtgggggttttctcggcaagacccagcgtagcatgcttgaatgaagtcatatggtgtttggtacagtagatggtgatatggtgtatttttctgtttaagtgtattaaaaattatgtgtataatattttgttttaaatttgatagtagtatgtaatgtgcatgttaattgagttgaattctatgcaaaccttctgttttttttattctgtgtttcatttgtttatagatctttaatagtttgggctggcaagttgcatccagcagaaacttctgttccttcggtgtttcctgccatcacctcttccatcttcattgccaccccatgttatatatgtttgcaccttggccccccttccttagcgtcaatgtccctgctttgttttcgatccttgagtattgcctgacaaaggttaccaaccttcactctcttatttctcgtgcgcacgctttccaaactactaaacaatatattttgattaaaaaatttataaaaaaagttactgtagaaaattacactaatctatttttaagttttttaactaatacttaattaatcatgtgttaatccatcctttcattttacatgcggaaggtgctctgttaaagaagtgttgccaatgtacttatcagctccatttcctagtactcacttagtcatggaggcagctgtactatgaaagggatgaagtgaaagtggatgaaagcttgccctagtgacgggggaggggggagctagcgggtgcgggtgttgatggggaagacggaaaagggatggctggaaagcaaaagatttgaagcaccatgctgtcttagagcaactccaacaatctatctatctggtttggatcggtaaaaaaaaacaaaacgagtcaaaaccggggtccagcacactcggtatctcgctccgctcgcgatcccgttcggcatccgtcacccctcgtcctgcatatttgcaatgaccatcccgctcgcaatcgcctctctcccgcgcacgcgctcgtttcccgcccgcgcgctcccgcccaatcggtcccgccgcctcgccctcccgccgtgctacgccgtcgcacctgtcccgccgtcccgcgccctcgccgtcccgcgccgtcgtcggtcccgccgtctagcgcccccgcccttccgccgtcgcgccgctccggccccggccttcgtctcgccatgtggaggccgctgcgtcctgcttcaacggcggctagggacttggatcaggatgctcatcgcccggaatgggacttggatcagtcgggtattggatcgatgcgccatcgggtggttcctccaataggcgtcgatggttggaaggcacaaggtctgttcatcggtgagcaagtcaccgatgaggaggtctgcacaggtgagactcactatctacgtctgttaaaccctttgctgttagttggatgactagatcacaggaagtttagctcgttatgtattctacctgaggattttgggattgcattcatgttggttgtaggtttctggaaataaaattgatgtctttcttcgcacctgaccagagtagctacttgttagtacagtacatttgaatgaaagattcatccagatcaaattgcttcttctttgcaagtaaataaacaggacctaccctgagtctcgttttgctataaatcttccatcctgcattcacatcacaataatttccacaaaataagatagtttacaattgcaagagagtaggtaaattaaaaggataatactctgttatttacattgctgcaaatgtccacattgcatataattttattcagctcgatagtagttacattactacaattgtctggtttgcatatcatgttattcagccagagttcccatgcaaatcttgagcttcccatgccctgaaatgctgaatggaaccagtggtgtagttgctttccctattgccggcttacagtcctacatgatgtttattctccatttattttcctgtgacagatggtacgcaatcagtttatttcactgacctcctagtaaatgatgttgatgaatctcaatttgccgcacctactagtgatccaatctccaatggagctccaacagctgccaagatttctcagggtaggaccaaaaatttcactactcaggaggacatccttcttgtgtcagcttggctgaatgtgggcatggatcctattcaaggagtagatcaatcacaaggcacatattgggcaagaatacatgaatatttccatgccaacaaagagtttgagtcaacgcgttctgaatcctctttattgaatcgttggtccgcaatacaacatgatgtgaatattttctgtggatgtatgtccagaatagaggctaggaaccagagtggttccagagttgatgacaaggtaaacacattatttttgtggtatgattatttgtcgcagtttttagttctcatgtttattttggtttcaaatgtgcagatcgcaaatgcatgtgaattgtttaaggaggaagacaagaagcataggaagtttaacttgatgcattgctggaatatcctgaaggacaagcccaagtggatggacaatcggaagaaagttggatgtgccaaaaaaccaagcaataagaaacagaagacagtggcaaattcaagtcctacatcagttgaacctgctgatcttgatgtctattgttctgatgctcaaccatctgtaagaccggatggaaagaaggcggcaaaacagaagctacgacagggtagaaccatagaagcagtggactatctgatggaaaagaagaaagaagctgatgttgtgagagagttgaagaaagaagagatgtgcaagaaagcctttgctctgcaggaagagaggtgcaagagagcctttgctctgcaggaagaacggaacaaattggagagagaaaagtttgagttccagaagaaagaagctgagaaggctgagaaggtggaagaggagagaattctaggtttggatttgagcacaatgaactaaaatcagcagaaatattatgaatggcgtcagaacgagattctcgctcgacgttgcaatatctagaagttcagctcgtagcgtagttcagtttctgaatgttcagcgtccagtgtctgtgtgttcagttctgttctaaatgtttagacttcagagtctgtgttcagttctgttctaaatgttcagacttcagagtctagagtctgtgtcgaagttcagtgtctatgtgtgtggcagtatgtgtgatatagtatggtcctaatttcagacggacaacattatgtgtgcggcagtttatgtttgaacttcagtttcagggtcatgctattatccctgcttcattatcctgcaccctttcatttccttggtctgccatcgataaatacaggttataaaaaataacattgtacaagccaatatgtccaaagctgccaaaaaaatttcatagaattgcacagcctttatgcatatgatacgtcctctttttctaaatgtccaaactgggacttacaaaatgcaaagcatatttcaaataaaaagttttcagatgttttatgttctgcgtctagagaatgataagaatcaatagggataaacctcttttggacaacaatctcataaatgggacgcattaatctatatgatataaatctccatggttttgccacaagtgctcgatgaggtctacctgaagctgagtgtgggtttccttgttcttcattttttttttgtaattctgaatgaaagcttatagttcaggtgtgtcacgccctgaactagccccgaacggaaccagcccgtgacgctccaaattaacctgttaaccgataccagtcccaggaaatagagctggtatcataggaagacagaatatcacagcaacagaggtctctttattatagagtaggagtacagtcatgttgggctgcggacagaccccgagctcacaactgcattacaaaagaggaaagcggaagccaagacttggacctaacatcacaggcgcgacttgggaaccagatcgaaaccctataactcatcatagccgacttgttcctggaagaactcctcgtcagcgggatccatctcatcttcttcagccactggggaggattatttatatagagcaagggtgagtacaggagtactcagcaagtcatggcaattatgtgtttaatgaaggcttcaaaggaaaggctgttgtttttacaattgattttttagttaaactcctttttaaaacaactaagtgagtgcttctcaaacgacacggatgagacagtgcatctcgtccgatcggagtatgtgcaatgtatcagtctttgattgattcaagattggcacccggccacaactttcaaacggccagccgggcctagctgatcccgtcagctacagatgttccaaacatcgaacccaaattcccaacataattcaccaagcagtagtcgaacaaaactacgctaaggaatcaccttacattcgcccatgaccgtgggcacggctgttcgaacagtttaataacctctgcagagggggcacactt

SEQ ID NO: 19512 - DNA, 7435 bp, Oryza sativa
gtttctattcaactattgcaattattttcgaatgtcattgggtggaattaacctattgtttgttatagcccttttgttcttgattactttattccttgataccttgggttattataacttgactagttgggctttatatattggttcagctagatattagatatgattgcttagccatgcttagaaacattagcacactattgagataatttatgactcactattatttaatgatggcttaatgatagctcatgatggttaatcatgattggttaattaattaatttgccaactaaaacctgataatggtgggttgtgagcacatggttttgatggtcgtgctcatgacaattaaggaccggttcacgagttttggttgtgaaacattaaccgtgccaaccacaagccagcgtgggcaacggctttaccttttgtatagcatggttcattgcggggcaccagactgagaagtggcgaagataagcccacgggagttgctggggagtccatgccttgtttataagggggtgattatgatccaggaacggtgcgctgtggtggattgtgttgtgcgaggggtactgtcacagctcctttccgaggtaccgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattagctcttggtttggaatggtacattcctggtttggagatagaactgtgcagccgggatggttgttcagaatggttgggcctatacaacagggtatgttgtatagcgttggattaatattgtttaattactacttaactattttattaaattctaaaatgtttattaaatgatgtttatgcaaatgaaaccctactatgccatcctttgttatcctgtgcacttgcatatttgctgcgtggcttgctgagtatgtcatatactcaccttgtaatcattcatcagcggaggagttctacagtgatgctgatggtgtggaggattaggtgtagccctggtcgagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagtagtcgaagcggaacactgtggaagagccaacaacacgcttccgtgcagtgcggatgaagcgtgggccacggtggaaggaagcaactggagtgtgtccgggggtgtaggagggactaactgggtgtgggtagggagagtacactggtgagtacggcgcacgcgagctaggggagcgcgggccactgggagtgcgagcagagccgcgggagctgtgggaagacaggtggctggcgtggcagaggcggctggagtcccaagaggtagtgtcaactgaggtgacaccctcctcggccaggcgggcctcaagtgcagcgtagcggcgtgcaagggagcggtaagcctcaaggagtaggtcgtgctaagtggcctgagcctcagaaagctcaaccatgcgagtcagcacgggctgagactcgcggtacagacaagggtacctggtgtcagtgcggcctgaaggaagccgtggaagctgccgaaagacggagcccccgaggcggtggctgtagtcgtgggccaaacgatgaatcgccgtccaggagaggtcctggtacgcgatctggagagtgggcctggccacattgaagtggtgtgggcgaaggccagccccgtgtatacctccacgagggtaaaggtacaccgaaagctcacaacgaggggggacacggtccacagagtaccccgtgtactcgggacacgagaagccaaggaagcgggtgaggtcacgaagctgagcgacgtggtgaccatcaccaaagccgtgggaactgaagctggcgttcactgccatctacaattttgaaacagggagaaaagatcagtaaccattttagaaataaactactgaaagaaaggaaacaaaagaagccttagctttttgcaagtatttttgaacttagcatccttagagtcgtcctaaacgttgggtttcgctatagggccaagcctgtgctctgataccatcttttgtcacaccccgaactagccccgaacggaaccagcccgtgacgctccaaattaacctgttaaccgataccagtcccaggaaatagagctggtatcacaggaagacagaatatcacagtaacagaggtctctttattatagagtaggagtacagtcatgttgggctgcggacagaccccgagctcacaactgcatcacaaaagaggaaagcggaagccaagacttggacctaacatcacaggcgcgacttgggaaccagatcgaaaccctaaaactcatcatagccgacttgctcctggaagaactcctcgtcagcggggtccatctcatcttctttagccactggggggaggattatttatatagagcataggtgagtacaggtgtactcagcaagtcatggaaattatgtgtttaatgaaggcttcaaaggaaaggctgttgtttttacaattgatttttagttaaactcctttttaaaacaactaagtgagtgcttctcaaatgatacggatgagacagtgcatctcgtccggtcggagtatgtgcaatgtatcagtctttgattgattcaagattggcacccggccacaactttcaaacggccagccgggcctagctgatcccatcggctacaaatgttccaaacatcgaacccgaattcccaacagcaatttcaccaagcagtagtcgaacaaaactacgctaaggaatcaccttacatccgcccatgaccgtgggcacggctgttcgaacagtttaataacctctgtagagggggcacactttacccacacgacattactaacccggatcacctagcccgtggagaacagccacgtctggtgaccttaaggctttcatgacaaggcattttgagagccgacacaggtttaccatatgccgacgagaggggtcgcagaccaacaacaggttaggtcccagaccatactgtgccaggaagcccagggctcctccccgacaccaccctggtgaatccacttgtctcccggcatcaaggctcccctgattagctaattactcagccaggggtgtcccattccatccatgtggtcgtacttgttatatgttcggatgaaattctaaaggaataggtccttaagtgcaagagcgggaaaccgtgctcccgacacgtcccccggtctgtgatttttggaaattcatttagttcgcaagcaccgacccaggcgtcgggtttttccaagtcttttgtaaaacccaagttttacccattgttggatattttaaatttgaggggaggactccaatgtgcgtgcccgaaggcccatcgaagtacaacagtcgacaaaggaggtttaagtgttcaataattcaaggagggtaattgcagcaattaggattggggccggtaggctatctcgcaagccgcggccaaatttcttgtgttaatcctatccatgcattatttgcggaaaagaaatacttatatttaaattttaggtgcaagatgatcaaaggtgacttgccttgctcgagatcttgagcttgatcctcgaaatccgcgcactccgagtcttcgggctccgaagctacacgcgaacgagacgactcaacaaacggcaaaattaaagccctattattgacctctaagcgtgccattgggtagatctcgagatttgaggatttttggaagttgaacagagtcagatggatgtacggttgagaagatattgaatttctaagattattggatttttggtctaaaggaaaaaggatttaattaaaccctttgaaaaagaaaagaaagagggaggaggaacagacttccctcgggcggctagggtgcggcccgagagaaggggcgcggctcggccgagctaatgggccggccggcccgagaaggcgacccaaaggcacgcgcggggagagggggaggggaaccggtgggctgggtccacctcgcgtggtcccgagtaggacccgcttgtcggcggctcggctcaccgtgagcgaggtgcatgcggcgcggcgctagggttggggtgggtgcggtgcacgcgtgtggcttgcggtggacactgcgcgcaagtgggccacgcgtagcctatcggctctccgtgggccgcgcgcacgcgagcggggatggaggaagcggctgaacggggtcggcttgacccggtccggccgagctagcgccgacgtggcgccttcgtggctgccacgcgggccggcgggaggaagacgaaggcgccgaccgcgaatggacggcgggcggcggcggtttctccgggacgccgtgcgatgacgagggtgacggggtgtacaccggaatgacaaggggaaaagagagggagcgagccaacggctcggattcgccggagggagctcgacggcggcggattgctgcggcggcaaccggcggcgagaaagggggaaatcggcgacagcgtgacgggagatcgattcgggcgagctagagcatctacgcgactccgggaatccgtttctagcgtcggattggacggaacatcgccgacgaaggccggcgacgggcggctactaccgagcgcggcggtgacggcggcgagcctactgcgagcggcggcagcagtcggagcggcacaggctagctacggggaggctacacaagctactgctcgagtctaaggggaggaggaagagcgaggagggagaacggggggggtgttctaccgagacgagacggggtgctgtgacgagaggccgacggcatgggagtgatctctccggcctcgggccggggaagaggaagaagatgagcgcccggagtccccttccgatcctagcgcgcaccggctcctccagtgcacgcgacggcgaagggcgacggcgaacagggcacggggcgaggcgacaatggcggaaggcgaaagcgagggagatgggtttgggggaggggatcgggtttatagggcggctatgtcggttcagaaaccgaccttgggcggtcaagccagcgagctagcgccccggctagcggccaaaacggcgacagggaggatgacgccggcggtggaagagaaaagggaaaaaggaagaaagaaagggggcttgccccttgcttctttgggaaaagaaggagggagagagggcgacgaggcaggaggaggaggagctctgcctccatcccttggaagctagcgcgcggagtggcggggccgggtcgatgacgacggcgatgatggtggggcggtttggaagggcgcggctacagggcggcagatgcgggctcaggcgcggaaggcgctgacaacggcggcggcgacttgccggtcggccacctcggcgcgcgcgcacgggaagcaatgggtggtgcggcgatttgagcagcgtcggcgggaagcggcaacgagagcagagagggagggagaagtgaaagagagagagcgagctctctctctctctcgctcagcgcccaagcggcgcacgttcctcacacgtgcgggcaaggatggaggggagaggagagttgggctgaggaggaaatgggccggggagaagagatcggcccacgaactcgagggaggcaaaatagacttttcgagaggatttgatttgggatggatttgagattagggtttggatttcgacgatggattggagaattgagatctggaatggcacggacactagacaacaaacaaggagacaattttcgcatttaggatttttaagagatagttttcccactaggcgccacgacggaacggacgctacaaggtgcatcatcatgggacactgacaccctttctcccatgtcgtcgtagttgcaaacatattggcctttattgttgaagttgtattcgtagtcatctcgctcatcttcaacaatcatgttatgcataatgatgcaagccatcattatatcatggagcgtgtcttcatcccacatacgagccgccccacgaacaattgcaaagcaagattgtagaaccccaaatgccctttcaacatcctttcgacaagcttctcgtgcctttgcaaagtattttttcttattaccttgtggctctggaatggtcttcacaaaagttgcccacgatggatatatcccatctgcaagataataacccatcgaatattcatgaccattgatgtcaaaattaacttgtggaccttctccctcagcgagccttgcaaatatatctgatcgttgaagcacattaatgtcattgtgtgaacctggcatgccaaagaatgcatgccatatccatagatctttagatgcaactgcttccagtataattgtaggctcctttttatagcccctatacatcccgtgccatgcagtaggacaattcttctagctccaatgcatacaatctatggaacctagcataccaggaaatcctctgctcgctccaattgtaagtaacctagcagcatcctgttcattaggcttcctcatgtactctggcccaaaaacctcaacaactgctgcaacaaactttctcaaagcttctagagcggtgctctcaccaatacgaatgtactcgtccaaagcatcagctggtactccataagccaacatacggaaagccgctactaccttctgcagacaagataatccgagcacaccggctgcattcctcttctgcttaaaataatcgtcatgttcctcaacagctttcattatgcgaagaaatacatgaagcctcatccgaaacctatatcatgatgcaattaaattaaattagcaatactataaaacacggcacataaaaattacataaacattatagagaacatgcgaacctgcgtctaaagatgtttggtccaaacgttggattatctgagaaatagtctttgtaaagaagattgtgccacaatagtctatcccgatgcactacctcatgtccctgaacagatccaattcgacccagattatttactgattcctcaatgatcatttacgcagcaccaaaaaatagatcatgctcctcattcgacgaagagggatcaatcaattcgttcattacgaactcattaaattcatcatcagactccataccctgcacgcaagagtgatcaatttctactgatgttaattgaattcacgcaagattgcagtaccaat

SEQ ID NO: 19513 - DNA, 5277 bp, Oryza sativa
cttggagttgcaaataggttgtaagaagaatgcccccacgatgaccttggtccacacagagttatttttccctttgacagaagctgaatatcatggcatagcatcctactatttccaggatgaactgacaaatgccggtgtattcgaagggcgtacttgcgcaactgatgcaggccagtagtttggcagcttctaaaattttgttcattctgctagtgcatcaaaggaggttgcgttttcttctcaaacattgttagtgatctgcaacagactttgggttcacacgatagggctgaagtgttcgtacaggggtgtcatttctgatcatcaatatggcatgagtcattttacacatgttctttcttctgttttattcgatagcttacactcatacaatttagttttggaaagaattaatatataacctgttgcatgctcatgattctctcataaaaaatatgtgcccataagtagcgaaagaactcctctacacattatcttcctaacttgttcacatgtaaatgccatcctacaagttggccaaaatggacaatgtcggtcatgggcctcacctttttaagtacttcatgacaagaaacaagatacccaatatagcaccgtgcactttgtttctgtgctcctcagatagctattcgattcttggaaatccttaggctacccaccatagtaacataaaatcctacataatttcatggctaggattctttatctaatcaatttggtggttcttttccttggctttaatctgcacagagctctctcatggaggaaccaaagttacatgaatgatatcgctgatcgatgtgccccttcaccccatcctttaagtatgtgccagtcacgagcagcagcttttggctatccatgtgaagaatacaaggtacgactacatcttagtcctgtatggttcgcttctgtaagaaaaaactcatttttataaagtatacggcatgacttgcaggtcacaacagaagatggctacattcttagtttaaagaggattccccatggtcctcatgactctaacacctcgactgagatgaggccaccggtactgcttttccatggacttatggtggtaaggacattgttgtaccaatcttgtgccatctgtgctctcatcatacctgaatcaagtgtgttgtttggacaggatggtgctacttgggtaatgagtactccaaaacaatcacttggatttattttggcagacaatggatttgatgtttggattgccaatagtcgtggaacaaattccagccggaaccatacctcactctccacaaaagatccggttctcatctcaagctttatcaagatttaatttgccatagaattatactaaaagcatgttgggtactcttttcaggcttactgggaatggtcgtgggacgaacttgcttcctacgatcttcctgcagtgctgcagtttgcctatgatcacacaggcgagaaaatccactatatcggtcactccctggtgagctcatatgtgccacttgaaaatgtcaattactagacacttctgccttttcagtgatgctgtaaaaaaaattgctacttgcatttttctagggaaccttgatgattcttgcagccttctctgagcacaagttactagatgtagtgcgatcagctgttttgctctgcccaatagcttatctgagcaggacgaaatccaaactccttaagcttgctgctcacatcttccttgcagaagtaaaatgctgtaaactttcttgttcttattgttactggcagatcatggttgattctatttatctctttgtttgtcttgtgcagacagttcactggctaggcttttacgagttcaatcctgttgggtaggcacttccacaaaacttctaatgtacttgaaaaaaaaaatcagtaaatgtacttcaatgccaagttcttgcttgtagtttttgcatatcacagcaactctattaattaccagtagagatgcccatacttgtaactcataacgtgactatcgtatcatggaacgatgtgtcactgtcaccaaatttgctattgctatatagggatagtctacagtttatactggtattttggataactaggcccaaatgtgattgtgcttacttaaagccgtaagcattgactactatgggtgtcctgctgcatgacaggccagttgcacatgaagttctaagccaaatatgcggcgatcctgaaattaattgctatgatctattttcggctgtagcaggtattttttttctttcctccaatttaccacgccctaaacaatatgtgatattaagctcatcctagtaacaccaattgcatggatttgattttgtgactgaaggaccagattgctgcctcaatacttcaaccttttgtgcctttctagagcatgctccacagtctacctccgtcagaaacctcgttcacttgtcgcagcgtaagaacctcttatcagaaatatttttaaggatgttattcttcaaacctctgtcacatcactcactcttctatttcctgatctaccttccaaaacagtggtaagaaatggaggtgtcagcaggttcgactacggcaacgccaaggataacatgaagcattacaaccagccacgcccaccgccgtacaacctctcctccattccgaatcatgtccccatcttcctcacccatggtggcgaggactacctcggcgatgtccccgacacaaggcacctcctgaggacgctggtcaagaagcacaacagcgacagcatcgaggtgatctacgtgccagactacgcgcatgccgactttatcatggcctacaatgctccagaactcatatacggaccgatggtcgacttctttaagcgtcactgaaaccagatccaccagatttcaccattggctgtatgcattgccaaagtagcagctgtatgacaagtttcagcattgaagatttcagtctcactgagcttgcatccatcagtacatctttgtcatgtcaaagtatatatgtcagttccaccatgctagataacacgaaaataaaggatttgataaattgttactcgatctcgttgtaatcacaatgttcttgattcactggtctcttgcaaaaaatgaatatggccaacctaatttgtttttgtaccattaattcttattttctattgtctatcagatctattgcttctagcaacaaatccaatcagatgtgttgtgatgttgatagttgagatgctgccatcaaaaagagatggagtatctgaattgggcgctacagccgccagaattgctaggaggtcccaggtgtcccaactcccaattgtccggattttccttttcccttccaactattttggtagaaaatcacatgaatgatgaatcgtcattggtttttttcccccttgatttctagcggcaaccgtcactgccgctgagctgaatggtggtaatttgcgtgacttagctttgatgggatgtgatgagatatttgacagctttgaggtcatggagatgcacgcgattcaacttggctacctgccatttcatacctttgtgaggtttataataggttactggcatactcgctccgtcccaaaataactcgacctagaatgggtcacaggttaatttattttgggatggagggagatattattgagctgaaatgtagaattacttatatagatagatgatttttatttcttgcatatccagtgccaccaaaggaaagaagaggttggtagctttatatggaaacaagacaacaaagtaaaattgtatactagtatgtttttcctctttagatgtatgacagagagccagagctttcttgcaaataaaaaagaaaaggaaaaaggagtttttaccccaaaaagaaaaggtcagagggagacccaaattaactgaacttattttatttccagattttttttcctttttattcatgtcctcctttgtgctgccaagggttgccaagaacttggcagcaaactgagccagatgttcatgtggctctctctatttgcctccagggaattatgtgtcatatctggctgcaaatcagggacaggaaaaaggctttgacaagtgcttggcgttgacattgttatctttttcggcaataatgctctagtcaaataattctagacaggttaatttgtatataaaatatcaaattattgagaagagtccaagtctcttgctcctgttgagtttctctttagtctcttcccttcaatgaaaagagcctgacattttctcctcaattagtacagtactctgataacacagagtagctgtgataaaaaggccaatgtattaattgacaggttcttatcagataagcaaacacatgagtacatgacctataggagaaccaagagtccaaacaaaaaaaggccaagtgatcaaggtgacttggcttccatgtttcatcaatcaaacagcacaaaagggaatgaaaagaacttgccaattctttacttttagaccatgtgtgactcagcatcatctgttcttgtcccttcaggagccaaagaactacagtactactaccatcacttggaagcgtagcgacagctttccgagttcaattaggattaactaatcacttgattaaggaatctttttttaagtaaacctgattaattaaagaatctggagccacactaccacctggagatatcaaccgcggtttctgacgacacgtcgtgccggatccagaaccttgtacctgcaatgatgaatgcaatcatcagatgcagcaaaagaccaaccgtttcgctcatagctgattataaatcatactatttattagcatcagataataataatttatataattagaattttcatgcgttcttagcgattgaaaagctaatattaaaaaagaaactatgatataaaaatgtgaaaatcaactcgaaaattaagttttgaaatttatattatggataagttttttctgaattgttatccggtcgctttctgatcatctggttagattagatcacaggcaggaggatatggcttgctgatggccagctagcccagcagatgagcagggtgtgtggttatgtgtgaggaatcaggctggatcacatggatgattggtcgtgatcccggtggtttactgctaatcatctcacttggctagtcggcccgcgttcttcgccgcaccgtctgctgctccttgattttccttgcaaatcattgcatctggcgattataaatttgtaataattcgttagctcgtgaagcttgcatgcctgca

SEQ ID NO: 19514 - DNA, 723 bp, Oryza sativa
tggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgactggtgtcctcgcctacacggctggcctattatgccgccgctgttgggcgtctacgacttcaccgccggcctgcctccgtcgccgccgattggtgcctccgcctacacggctggcctattatgccgccgctattgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctgacctattatgccgccattagtgggcatcttcgctttcaccgtcgaccgccttcgtcgccgccgactggtgtcttcattgttattgatggacgactttgttcccacattggccacttccgctatcaccaaggggaatattacaaagctaagtcatcatttattttattctttatatgatatttttccttttcctctgcctcactacaccaattggtcttccattgagtagtgagtcgggggctacagatgttatatcatattttttataatatttat

SEQ ID NO: 19515 - DNA, 24218 bp, Oryza sativa
taaaagtttaagctaaaacatgactatatcacgcagcaagtcacctgcggccaccaacctctcggggcacgcttccacgacgcagcccggtgcatcttcacgtctgtgcagctgtatgagcgccgtggatgctgcttccggtggcaacagacacactctgaggttagagctagcagagttctgcatgattttctgtcagttcatcagttttagaaatggttttgggtagggttgtgaatagtgtatgtatatggcggtgatgcactgaggtttctcattgattttacttgcaatttgcagacacggacggcgaatttctacatctctgacaggaacactggaaagaggttctacgtgagagctggcgagggtggcaagatcacctggatgattaagcagaagacggacagcttagatggcgagaggaagggagcatcaaggaacctcaaaagctggatggcaagcaatgatttatcgtgtgatggcactgtgcatgtcaaagaagggtaaggtgctgatgctttagagaatgacaatgaaaaaaacccgtcaatttgaacatcataaacctattttataggttgaatttttgaaattttcaaataaaattctacaccatagtaaggttttatttacagtatgtagtttttgaaaattgaaaaatacctcaaacgtaaattaaatcattgtaatcaacatcaggatataaaatatatgatagtgacggtttgaactgaaaaaaaagagaagaatcataggtgactcgaacggtcgtggttaaaatacatgatagttacggttggaactgaaaaaacgaagaaaaaaatcataaggggtctatcaacggcggtggttagaggtatttctatattctatcaagaatttgtttgtttgatttccttaaatatctgagcatacaaatctcaacatgccattcatctccggtgttaacagattatctctatgtttgaaaacaactgatactattccatattatatataactcaacggtaaattactgactaaggtcgtgagatttcatccgcataacactattcctgtgctgcatgtaaagttcagatcacaaaaaagctgtgcccgcaaacttgcattgacatttgcatcacacaattttttcattggggatcacaacaaattcttcaggttcatcagggaaggggacactgctagtgtgattggagtcctgaagaagcaccacgcctacgacatcgtcgacgcgccgtccggcgtggtaaccaccggctgccagttcacgaggtgtatgtttccagtccacgtcgagggtctcatacttgtaggagacgaagacccagatgatgaagtttatatggtctgacgaactctgaacatacaaatattcctctgctgctttgcacaaatcgcatgcaaaaaactggactcccatggctccaacaacccactttgcatttcggttcacaatgtgatttggatcttgtgtggttgtgctatatactcttattcgtttttcagaggtttattgtagactgtagtgaatgaggatgttttagtacctcgaattttagttacagttgtgtaaattaaattgacacttacaggcttgccagttgccagtaggacaatttgaaacatgattttatttgataacttagtgaggagggacacaagaattgcagatattccatacaaaggtttacttttgagtagcatactcagaagtcatgtaacaattgagcatatttcactatccgattagacttaatttcatatagaaagcttcctgtttatgtttggagatggaagagggtttccgtaccatttgaaaaacagtgaacatgttataaatgttgcaaaaacaccaacaaagattacaaaattttactgttcgagaaatatatgttcctgtcaatcccattggtacctctagtaccctacaaaattctctagcagcggcacacctgggaattgggagagtttccctggaaactgatgcggcaatggttaaacaagtagtaatatctacagactacgatctcttcattcgcggtggcttggcccttgaacaactgttggtaacaaattttgtcaatattcaagttagacttatgcctagaatgtaacagagtagctcatgtgttagctcagcttgggactgtttgcctggctcagtctgaactagtactggttgatattccagatgatatctcggatcatgagtaatgaaatgtctaaaaaaactgcaaaataatactagtaataacagaatagcccaccaaacttctcttggagttttctctgcattcatttcactgccctgctgttgtaatgcattctagttggctactacatatcattacaggcttaatagttttatagacaatgataagctggaaaaagtatttggtaaaaatcacatcttgggtaaaacttttttataagttctaaaaaatctcaaaaaaaatcatacatgtaggtaatatgtaaataaataaccatacgaaactatttcacgactaaactcaacttcattaatgaagtatgaaattaattaataacactattcctgttgttgttttcttttttttttatgtttctcaattttatatctcacaaatgaagttgagtttaacctcgatactactatctgcagatattaccatatactatccaacacagatgttagaataggtgttgaatatactagttctattttggttatagttagacttggggttgtaataggtggtagggggtggagttagagttggactctgtaactcgacatctctcttaaatggagaggaggtggtgaccatggcgactacaatgtagcgtagacacgcagggagatgatggccgcgtggccattgatttgtagtggctaggagatatattgattggggaggagcgcccataatcaaagcctcggagatgtaggctttggctgaacttcgttaacaaatatcgtgtgttcctgtgtcgtcatccggtgtgtcttgggtgatcaatgactgaagcgatcaagaaggttagtcgtcgttttgctatatcgactaacttttataatgacagatggtcgcctgacgtgctcttactctacatgtgactttgttgacaaagagatggcaccgagtgtaagtgtcgtcatcctgcaggtcatagttagctaacttatctgtatgtgattgattatgcaggatatccgaagctgaatgcctaaaaattttccttgagagcatggaattattgttttagacataaggtttttaacgaggcaacaacatacaatgtatgagcgacactatgtacttttcctcctcgtctttttctcaactattgggttttggtaggagtttcgacgagtcattcgttgatcacggttagatcatggaagagtgctgtaaaacaaatctataggagatatgtttcttgtggtctcgtgggcatatccaaaacaaagtatagatagatttatcttctttcatataaacgtgtaggggtggggtgagacctgagacgtttgggtaattgtatccgagaccagatttaataaaaagatttcatcctaatgtgtccatcatctacttatgttagatggatattctcccccaggatggatattctcctctaatgttggggcaggatgcatattaatgttgtggagtgtaaaggattgatttattaattgtctaatagcccgcgaccggattatggaaatcatggaaaaaagtcacatcaacatcttcgagtgatacttgattagtaataaggataggggacaattccttctattgtgcaaaacttttatttgaattctcattatctggtacaaattctgtcacattatgcacaatagattctatgatcttttatttgtttgttaggtcgtttatggatactaatggtgttatttatggattatgtctgagtcggtaacgcgggagcacatcctgtttataaaagcaaatataaaattcattcatcaaaacctggttcctacaccatcaccattatttttagttagattttgcgatgggtaaagtaagtaaacatatatgttgctttgctcaaacatctcactttttttcctctaccatcattgcattaccatattctattcatctcagcaaccatgttgtttaatttatagtgctgatcaatcagcgagaggtcactcgtttggcatgatgcatacaaagcaataaatgagtatgatattgtaaggaaccgtgctttctttcttcttttaactcaattggttttgctcaatggtgtctgtctttcttcttttaactgccaaaccgtattagcaattggttttgctcaatggcgcctgagcagagtaggcaaatcatcgcagagctgtagagggaaggcggatagtaaaagccaccacatgtacaccggccatgtgattcctctcgcagcaccattctgtgcaccccattcgggcgattgatcgggtaggatatctaagttaaatacttttttttctatgggttctaccaacctacaaatgctggttagagaaaagtaaaatgtcttggaatttattttttagaacatgtgggaatttaatttgagaacctatatatataccacaatacacgttagcaaatatataccatttatttataatgtttatttttattaaacacaaaacaactttattggtgctataatatattacaaattatataaaaaatatatctaacatatccataatatcaaacaatcgatttacagggacaatcatgtatggaaataataatattggtgatatggaaaaaacacaaatatcattaacgcgggaaccatccgtaatatataacgactgcgctgtcgttattacaatatctaactacataaatctttgcgatcattaaattggtttcctcaaatatttcaaactcactagcttccataaagctattgtttctcgtgcatttatgaacttgtactaatttttcttggtatgatggttcctacgcttcgtttgattgacagtccacttaatatagcaaagcacggtctatgttaaagctggtaaagcatgaaggcaacgagcctgatactgtgttgagtcatgccgtttgccttttttgtcttgccaattcctcactgatgctgcatggtatgcgtggcatttgcgcgccaatgtgcaattgtagttgtagcatgggggacagacaggccacggcgtggtgaaagtggatctgcaacagttggctgcgccttgaaacagggctctctactttgggatgtgttcagttcatgccaaaaataaaagtttggttgaaattgaaacgatgtgacgaaaaagttaaaagtttgtgtgtgtagaaaagttttaatgtgataaaaaagttagaaatttgaaaaaaaagtttggaactaaactcggccttggtctagaaggagaaaccagagtccagagacaaggggcaacaaggggtacttcgtcttcgctttcagcacaatatatgcatgtttcagcacaatatatggcagaattgtcagtttagagagcaaataataaaattaaacaagacaagaaaccagaaggttggtcgtacctagcagtaggaatcggctccaaaaccagcaatatcgtttcctttatacttattacaagcgaaatgactttattaatgattaaaaataattcatggtaaaacttttaagcaagctctgaaaaatgaacaaaatactcagaatcaacttaaaattgagatttaaaattcaaattttcgcttatagttataagctgaaggttaaattaatgatgggtctgcatgtctccatcttaaatctccaaattcaaattcccgtacacgccatgtctaagaattttttttattttctgaacctttttaatttttaattttaaaactaaaccatttcaaaacatattttcaaaatctgaatcttttggccacgccagcccatctagcgtgacaaaacaacactagcacgccacctgcagcgggcgtgatagttttgtcctaccatgctagcgagcgtggccaaataacttgtcatgccaatgggagcggcctgacaatattattttgccacgccagcatggttggcatgatcaaaaggttcaaatcttgaaaataaattttagatgggtttatttttaaaattaaaaattaaaagattaaaaaataaaaaatattccctaagaatacgatattttctactatcattatttcaatggttacaataattagatataaatcgttggatgaagaatgatagtgaaggtcttgatcagtttatgctagtaatagagagtaccgtaaatacactctaggttaaaccatagaagacagcatggtttgataggttgatgagttataccttttgtcttatcaattgatttttcgaccgcatgctactagcaaatgtattttttggataatagcaactaataagcttcatactaatttattttctttacgtgatgcttatgttgcttctgctttagtgcatgttttttttatttcatctcatgaccctcatagagcttgcctagacgtgtatacagatgtagtttttttagtgcgtactactcctgtttttttagacgtaacaggagtagttggtaacttggtatgggatggtacaatattttatgagtgacacgggacggtaaataacttttttttaccataaagagtgagaaaagggggaaagacaggaaaacgtggaccggaggtggggactgggaacactatgtgaggcactgttttatggggcttttaactatttgccacttttagatttgacaaataattatttaccacccctatctcaatgacacgtgggttcacatgtgtctataacatgtgggtccagtggcaaaaaattaattaccacatctaaatgtggcaaatggttaaatatctcctgttttataaacaacggttggttactgtttcataaaataagtgtgatttaatgtcatcttaaattaaacttctctaacatagataagtttataaagaaatacattagcatctaaaaagaaataaatgcaccagcaaaatatatttcatggtggatttatgaacttatttgatgtttttggcgttgatgtacttttcaataaatttggtttaagctaaattatgaagtttaacttaggagttaggaccaaactaaagcatttacattatggaacaaagattatagttcaggcttcatgttttagaattttgcatagtagaaagtgagcatttaaatgaactgagtttggctaagctatagaagtcatgttgtattattgggtattaagaactcaacgaataatgcgaatgaaaatgttctggttttattaaaatttatgtattaatatgcgaaatcatctcatatatatagaatatgatagttattaacataaacacgctatacaaagaaggacgttacaaaaccatttatattatttttggagctattgatatccaataatatatcagggaagtagctcaaaaaaaattattgcgcgttagtacaagtatgcagtccttctgatatataagatgggactattcgatccagtggtctaactttacatgtaaacctataaacctttttctcctccataatcataggtagatgggacagtattttgtatatttcaataggtgttgtcaacaatcataaaatgtgaatcggttcccacaaatatctcatagtgtgcttggcttgttttgcaaactgtcatgcccaatccgactgtctatccacactcaccagattgatttatagtactgaacgagctttgtttgttatcccagattgatttatagtactgaacgagctttgtttgttacctgattgatttatatagtgctgaacgagctctgtttgttaaggtggtaaaaccatgagagaatatactggttcatagtcatgcactaattactcaatttgacggccaattgcgcatggataggcaacgaacgactaagagcaggtacaattgtgggtggtagatggtccatttttttatgagctggaggagagaggggaagacagagaggagaagcgggcaactaattagccgccaggctatacgctcggcctgaggtcacggggcccaccagcagagacgggttcaccatccgcgtcgtccaccaccgttgccatcgctctccattatattgccatcattgtctcgtgctccaccaagtcaccggcctcgtccgtcatcaccgccgcgcgcggccaacctcgttcgtcgtcgtcgccgccgccgccgccagccgcccgtcgcactccattgagtcgctgccctcgtccgtcactaccgctgccaccggcctactccgccatggccgccgtagcactccactgggtcgctgtcctcgtctgtcgccacctctgctgccctcgtccgcatggctgccgacaaactccaccctcatcctttgtcgccgccgccgcgccctcgtccaccatggccgtcgtcttcttcacactccgagtctccgtcctcgcccgccatagccgtcattgccgtcgtcatcacctacatcctccgtagccgccgctgcctagtcccttgctgttgccatcaccctcttccgccgccgccactgtgccctcgtccgccatggccgtcgtcttcatcgcgctacgggtcaccgccctcgtctgccatagccgtcgtcgctgtcgccgtcgcctacatcatccgtggccgctgccgcctagtcccttgccgtcaccatcactctcttccgccaccgctgcgttcctcgtccaccccggccgcctatgtccgcctcggccgtggccctcatccactgcggacgctgccggcgtgttcttccaccgcagcttgtccaccgcaggctgctgtcgtcctcttccaccgcatctgctgtccaccgccgcagctgccatcatcgttgttcactgcgtcctcttctgcatcaaaagagaagaggtgagaggaaggagagagagggaggagagagaggaagagacatagggagatggtggatcccataaaaaaataaaatatttttgttatagtattttctattgtatagacattagctgcaacgtttattataaatgacatggctattttttttaagccaacagttggctgtgttattgaccttgctctaattgatgggcacaaccggcgcagcagtcacgccacagcttttgccgactcaaagcagccgcacgcaacacgcagtctggtctcgcggttagctgccgtgttcgagactgactgcaggctcaagctggttccacttcccaactccctactcttatttttcgcacgtacgcttttcaaacttctaagcgaagcgtttttcaaaaaagttttctatacgaaagtttctataaaaaaatcatatttttctatttttttaaaaaatagtaaatatttaattaatcacatgttaatggatctttttgttttacgtgtgtacgggggaaccggctgaaacgaacacagcgtgttttcgtgaactccaaggcgcccagggaagggagtcgtggtggccttgtgggacgggcagtcggggatcggtggagcgactcgcgttttgacaacgcgtgatttcagtgggctggataatatcgggagtggatactaatccgaggatgttccctcatgtatttttttttcattttttttcaaatttgagataaatagttatgaagtagtagagttcagtgatatccattgatccttagaaaatcaaattcaaatttgacctatacatcgataaacaaaaataataaattcagatgtaaacagtatgctactatcatatgttgaatttaactattttatatcttgacgtatgagttaagtttagacttaagattttatagagttgtatagatatgttatatgagtgtatttttttagaattctttttatagctatttagatagtttttaatcaaacgagagaaaatgtccttaagtgataaaataatttctcgataatatcccatcacaggtgtcaagcaagctgctgcgtgggtgtaacgccccgattttcgttcgggattaaaaaaatcattaaataaatgcattttctagaaattaaataaaagttaaatcaatttaatcaagtaaaataatgggagaatttgaaattttcccttaaaaatcaatggccgggaatattttgtaatattctttgtgccctaatgtactctccggaattttccgtgaattttcggagctcgagaaatagttttaatagcacaaagatcattgcatcaattaaaataaaaagaaaacaaataaaaacctccctcctctctttgggcccctttcggcccaacccctcctttctctccctctcgggcccggccgccctccttttcccctcctcccttctctttgggccgtcggcccggcttgccccctcctcgcgcaagtccgcttcgcctccctcatcctccctcctctccccgagccgccgacaggtgggccccacctgtcggggtcacccccaacctccagcccgggccagcaaccgccatggccgcccgagccgtccaacgtcgccgccgtttccgcccacctcctccaccccgcgcgcgcgcgtttgtccgtgggacttcgccgcccacgtccgcgccgtttccccccactctccccgcaaaatccggccacgtcgccgcctcccgcgtctctctctcccccacgacgccgccccccttcccctcaaaatccgccgctccccggccctctcctcgcccctttgagctataaaatcaatccccgtgctccccttgtccgtttccccatttttcccgagcccggcatactctccctcgctctccccacgccgcacccacgcgctgccacactccggcgagctccggtcgccgtttcccgccgccacagccgtcgccgcgccgagccaccgccaccgccagcttcgccaccgcaaagggaagtccggccgcctcttatttccccctctccacccctcgagcaccactcccaccgcacacccgaggccgccgccccttttcaccgcctccagccgcgtcgcgccgccgcttcggtcgacgtcgactcgcgccgttgcctccctcagctccgccaggacgaggaggaccttggccgccgcccctcttcgccggaaacccaccggaacggggtatctctcggtcgccggtgagccccaccatttctctcctctctggcgtggtattctcgccgctccggtcgcctatttccctccctaaccgctccaataatttccctaggtcttgccggccctcggccgcggctccgccatggtcgggcgtcgtcggaccgccgttcccgtcgcctcccgtgtcggccgccaccatctctttccgccgccagccgcctccctgtggtcgtctcgccgtcgccgtcctcggtgagaatccccaccgtcccttctcctttttttttcctcctccgccgctccccgtgcccgctgccgcgatgcgccgctgtcgccggcggtcgtctggccgcacgccgtcgcgcgctatcgctcggccgagccggtttcatgccgtgcccgtgccctagccgcgccgcctcgtggccgtccgatcggcttcgggccgatctgggccatccacgtggtggacgcgcacccgaggccacgtgtggacttggtccaccatgcgccgcccctttgtgccgctgacgtgcggggcccgcctgtcggcgccggctgccccttgctgacgtcagcgagatccttttcctttgtaaaaataattaataattgcgcaataaatcgagtttaattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttctattagagtttttcctcgttttgcgtgccagcgtgtagtttccgtcgtttcggaagtccgcggtcgcgaggaaaagagttcggaagatcaaagtggagaagcaaggcaagtcacacattccccttgagcatgttgatcctaatttacaaatgttttactgtttgcaaataaatatgcatgttttgctaattacacgggatcagggtttacctatctgctcgcttgtgccatgtttacttgatatctgtcctttgtcaaccttgggtgataaatcgactagcttgtgttacttatgtgacatagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtgaagggtctcgtcacaatcactcgacatggtgacgtgtgcatcatgggcacatgatgacgcggtgacatatcggtgggttgtgtcttgtgggtacagttgtgcacctctggccagagtaaaactattcgaatagccgtgcccgcggttatgggcgatcgaccagattcaccgtgattagtctcactcttaataaatcgacccaatgcactgtagttcaggtgggttggttgggcctgttcaacgtggtgtagcgttgatcagtggagattcaatattactttaattactcaaccgtttacggttttctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgccgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacagtgggtgactggcggacgggttgcaagcctgcaaatgtgtaaatgcgcgagtctaagatgggcgtcatgtaacaccagtgcatatgaagtactccctccgttccagctaactgtaattttgcacggttcatatttaacgtttgaccgttcgtcttatttaaattttttttattaatatttttattattattagataataaaacataaatattactttatatgtgactaactatttaaaaaaatttcataaaattttcaaataaaacgggcggtgaatgtagtagttgctaaatactaaccccgccaaaaaaaaaaatccccattcaacctttttggaattttctcaactcagccagccatagtacccgaaaaaagaagagcgaatgtactactagtagcatcctaccacaataaccctgcacacgaagaaaatggagagggaaaatgatagacaacaccgttcacaatcccagcctattaatgtgcacgatatacggacctagatcgatcaacgtcacatacatgagaggcgatttttttacatttttattaaaatatttagaaaataatttttcatttcaaaaatttattatctagacgcctcacgatctctagtgggatgtttttttttaaaaaatcgtccttccaagagcgtcaagggaccaatgtaataatttttatttgtatttaaatcattttcaccagttttaattcgacacttcaaataattttaaatggaaaaaatataaagtcttttatataaatcttatttctatctgatatcgtttgaaatgtggatctaagatttcgttaaaataggttctaatcttataacgaatgtttgaacatctaagcgatcttaaatgaaaaaattgttaactaaaagttgtcgttctcctcgagaattttcatataaagttgatttcatccaactttatatgatatattttttaatttctaaatcatagagttaacaatttatactaaaagaatatatttaagccccttaacatgctttggatgggcgttttaaaaaacgccctccaaaagagcgtgaggtatccagatttgcaaattgttgataaaaaaatatttttgtaaatgttataatgaaaaagtaaaaaaaaaacgagaatcgtcatcgtcctcagcctcttgtggttggttggaagtacacggacaaattttcagcataatcaaaacggaattttcagcttagaaagccggaaaacacacggcctagctagctagctaggcagcgaactgctgtggtgcaaagcaaatggtccctgtaatgcttacgccggccaccccgtgcggccgtgcccctggccgcctcccgtttccgttccacttgacgttctcgaactgcagtactgccccgtatatgaaccccggcgccgctgccgccgccgagctgttttgctcatagatctttttttcacgaacacatgaaaagaactgcacgttaatatattagaagaaaactgctcgtccatcacacatgcagacacagccgatggcctgcgtcggttcagcatgtcaccacggcaaacacgtaaaaggactgcatattaatatattataagtgaactgctcatcgatcacacatgcagacacagccgatggcctcagcatgtcaccacggcagcacgtaagtcatgactcataagtccaggcgtgtgcacaatactaagcacatgtctgtagtgaattatgctccattatagtgttgataatggagacaacaacataaccaaataaccaaatttaagtgggagtgaaaatgaagataagttgtgtgattatatatgaggaaaaagaaccttaagaaaacaatataggtatacatatgaaatcataaatactgctacggcaatcgcctccttacaacgaactactcctactcctcctcaaagtcagcatggatgcatgatcaatcttcacttcatcccgaacttctcttcctcaatgtcagcgtgatcaatcttcacttaatcttcacttgtgttgacgtttttccttatcttctcattttccctctatcatttaattcgtttttattgtcacagtttcttgataataaatttattatcacctggaagactaccccatacactattaccgttaataggtggaacactttctatccggtcttgaaacgagtgtatttcattaatcatttctttgtaaatacttaactatttaactatgattaggtaagtaaaaacttaaattggatttcaccagtatctcatatccagcctttattcctaagtggcatagcttatgcatagcatccactccacccgttcatctcactggtccatgatggatttatagtgttgaagaagatagagctcatcctctcgtaccatttttaaaccatccagtcaaataaaaggtgatagtcatgcgctcataccttccacctcgtcaattgggcaaatgcgcatgaatagccaacagataggctctttggtacttgggctgcaagcctgaaaatatgtactccccctatttcatattataagttatttggctttttttttttatcaaagttctttagatttgatcaaattcatagaaacaattaacaatatttataataacaaattaattttattaaatttaacattgaatatattttgataatatgttttctatatattgaaaatgttactatatttttctacaaacttaattaaatttaaataaatttaagaaaaaaatcaaacgacttgtactatggaacagaaggagtagctgtgatctggcttgcctgcaggctctgcttttgttcatgaaagtagagtaggggatgtgaatcacatcatagaccaacacgcttatattacacttaggctgtgtttagtttacaccaaaattgaaagtttggttgaaattaaaacgatgtgatggaaaagttggaagtatgtgtgtatagaaaagttttgatatgatagaaaagttgaaagtttgaagaaaaactttagaactaaacacagcgttatacggatagctcgcagcatgttctacgtgcatggctactgacaaagagacggcgctggaatgagttataccgaaggtgccaatggggtgggcagaaaaagaccgagatcgaaaagaccgaaactgataaatttggtccaggcagtgaaataccgaattttgttcggtcaattcacttagtctccttggttaaccgaattgacaaaaagaccaaattaacaaaaaaatatatctaaatgcaacctacaatccactaagtttaataggattaaactctaattttcacatccctacttcttctagtcatgcaacctaataagagtctttactcatacgtgcttacgaattttttttatgattattgtgttaaaaatttttattatttctttgcatatatgaaaattttgttaaatttcggtcagggtcaggactgagaccgaaaccgaatgtctgtcctaaaatttttggttgaaattcggtcttcatttttcattttttaaagactaaaatgaccgaaagatcaaagaccgagactgaaatttccagtcagaccaaatctccaccccgcgccatcatcatgcaggtcatagctagctcatacatactcttccgtacctaaatatatttgacgccattgacttttttaaacatgtttgaccgttcgtcttattcaaaaaattttgtgaaatatgtaaaactatatgtatacataaaagcatatttaacaataaatcaaatgataagaaaagaattaataattacttaaattttgtgaataagacgaacgctcaagcatgtttaaaaaagttaacggcgttaaatatttagagatgaagggagtatatacgtaggtgatttgtctgattaactgtggataactcgaagctaaattttcctttttttcgcgtccacatgttgagtgcaagattaaatatgggagagggaatgaatataactatattttttagcgctcacaggtctaatgtcatagggtttttggtacagtatatcttcagaagcaacatacagtactcctcttggagtggttagtattctatatagatttttgtagagtaccctaattattccatgaatatgagccattcatctggcttaatcccatggataatattcagttctactacacctggtaatttagcactagaagttgtggaggggcaaatttagaaagatgtattttgttttaattcctaatcttaatcgatccataacccatacacacgtacagatccaaaattttggctaatcgcttgattatgtgcggcttagtcggagagaataacatgttctaattattccatgcacgcacgtacgtataacctatctaagcgagataactgcgaggggatcaatgcaacggcgagccacacgagggaaggggaatagatagggagggggatagtgagtatgacaagtggttcatagttgttttttttttctagtcacttacatacgggcccacttctactttgtgattgggttgccatgtttagcaatagggttgaccaagttaataagctatatcagtgaaaattgctctcaaaaccgctgagggagtaaaattacaccggtctcaatagttagaaggccaatatatcttatattacggttaagggatacgaattagattggagtagtatttagggactcaaagagaacttattccttgcgagggatatatagcccagcaagggtggtacgcaggctgctgctgcgttggtgaccatggactgggtgacttctatctctttcttcaccaaaaggagaagagacacaagtgaaaactaaagaagcacacatgatagatcaataatgtactcacttatacatcccatgtaacatatatatgtgcatgcagttgctagataataacaattatatatatatatatatatatatatatatatatatatatatatatatatatatatatagctcccactcaaccttttgtaattttctcaagtcaaaaaccaatccagtgaaagaacatagaagaaagaccaacatcccaagaccaccacacagaaaaagaaaggggagataatgatcaagacctagctaggtcaaggtcacatacgttgatacatgtacaggatcggatcagagaaacatcgccgttcgtcctcattctcttgtggttggttggaagcacccgaacatctgcatgtttcagcacagcacaagcataattttcagcacagaaagccatagaacactcgggaagattagtcatgcctagctaatactctcttcattccaaaatatagcaattatagcagaattgaacatatcttaatattatgagactagacagtcatggtttgaaatttcggcccccaccgacaaggtcaaaatctccccgaaatttttggcttttgccaaacatttttaaatttggtaaaaatatgttaaaaaataaaaaaaatcgtccaaaaaattccgaaaattcagttctttcggtcaccagcggcaaaaacacaagtttcgaaattgcaaaccctgattacaatatattcaagagtaaaatgcaccagcggttcttaaacttgtcaggaggtttcacttaggtccacgaacttacaaagcgcacatcgaggtctctaaacttggtttattatatcatcctggtctaaacccgcgtttgaccgtggtcttgtttacgtggcatgccacgtgtacgatgacatggattctctgagattaaaaaatccctccctcctttttttttcttttatgaaaagacgatgacatggacgacgtgtacaaggcattttcgtcttttcgacaaggaagaaaagaaaaaaagaattaagaagggagaaaaaaataaaaaaattccatgtcatcatccacgtggcgtgcaagatcacggttaaacgcggctttggaccgggatgatacaataaaccaagtttagggatctcgatgtgcgctttacaagttcgtggacctaagtgaaacctcctgacaagtttaaggaccgccggtgcattttactctatattcaatctgatccttattgctatattttaggacggagaaaggcagtgacctgctgcaatgcaaacaacgtgtaccttggacatgagggagtgatcccgagagtgcctcatgttggcggcgcttatctcctgcggcggcgagcgcgggacgacgccggccgcgccggcgccccgggccgcggctcggctccgcttcacgttgtcgaacatcaccgtgaacccctgcgccgccgcctcgccgttctgctcgtcccacaccccgaacttgggcaccgccgatgccctctggcggccgtatatgttgtgctgcggcgaggcggacgcggaccgcgccttgggcgccacctgctggtggtggcggccgtggtggtgccgcctcgacgccgcgtgcatctgcggcgacggcgacggcgcgcggcgcccaccgccgccgcagttgtacccggcatggggtgggtggtgtccgtggccatggcggtggtcggagctgtggtgatcgtattggaaggggcttgggcttgggcggaactgcggcggcggcgcgaacttgctctggaagtcgcccgggtccgacgccacgctgccggagcgccggtggtgctggtgggagcccggcggctgctgatgatgcctctgcgattcgcggtggccgctcgacgtcgccggcctggaggacggcgcgccggcgaggttgtcggcggcgcggatcacgccggggttttcggcggggtcgttatggttgtacggatggcggagcggcggcgcggtggcgcccttgttctcgcggatcttgtcgaagtagagcgtgtacccgacattgtcggcctcccaggtgccgaacttgggcacgctgggccgtttctgcaagtgcacaaaatcacacactcatcagaccatgtcctcgtgggcatttaaaaaacgtgacaaaatcatatacaagaattatttttagataatgggaataattaatgttttacactctcggcttcagtcataatacacacaaacataaatttgttaaaaaaaagtgatgagataaattcctaactctctcttgttattagcaagaacttatttagaaaataattttctggttgatgtgatggtatatgatgtgatctattgtggtcactgagatggtgggagcaccctttgtttctcactttttctgtcttatttttgggtgatttctcacagtgttatgatatataataaggcaaagaacttattattttatacattaatcaatacagttttgaaaatattaatacaaaaataaccacaaatttctactgtaacatagagtatttgttaagatcctacaaaattgcacacagtactacctaaaactgatttacaagagaaatctacataaattattttgtgtatgcaatctaattatttaaaatactttgatgtataaggtcttgaaagtgtgacttgatttgtgtctatataaaatgacatgtagttacctgtaggttactttctccattacagtacgtgctagcaaatgtcaccaaaaattagcttaattacatggtcaatggcacatccattttctaaataaaggtaagtcaatagcagataatacataacttagacataaatgtttaactcccatgtcaggaacctaagatatacacgaccaaacaattaagttcagggggatatgatgcagtttactctttaaaaaatcaactggatttgtaaacaaatgcaaaattaaattattagcactgtattagtcataatctagctgttttgagattgacaaaaaaaaaatcatcacagtcaaatggggccaaacagcaaagtggcattcataaagaaaaatggaaaagcaaaatcaaagtgggtacgtgtcatgcatttcatgttttttttaaagaattgtcccatgtttatttttctaatctcagtgaaccaagagctgaagatcatcagatatggatactgtatttctggtcaactttgtatctgctatactattggattgctatatggctcctgtcagagtcgtgcgaaccgcctcctgtatttgaaagctacgtgcttccaagtagctataaattaaacaaaaccgcgtttcttttgcctttctaatcatactgtattctggatgtgtggtttgaatgggtaaacaagattaagaaaacagcaatataattaacttccaaccaagatgatcgctcggacagtacttatataaaaaggatatataatcttattgcggcgcgtcaagatattcaatgacgtactcgttctcatcaattaattaatgtattaatgtgtgcacagatcttcaaattgaagcaaattgatctatatgaacgcgtctcctagatcatcttcttaatcgtgcatgtcaacaacaagaagcttggagcgacaggaacctttctctaccatttcttcttgctctaattccgctagagatcaattcatttcagcgagatggtttaatttccggcatgcatatgtgctaactcgtcctctccgattcatgatcctatttgttgccaacgtaattaagcctagaaatgatctttatgaaggtaagtaattaattagcaacatgatcaacggcatgcttggtcgtcagagaaaacaggtgaaacaacagtttatgcatgcaaggaataacaaagcagaaagaacattgattaattaagcaaagcaagaagccagcaagaacacaattttgatatgcaagaattaaattagttgaagcagggcaattaattaagcaacgaagaattgaagcactcacggccatatatacgcctgaagagggttcgaccggaagacggcggcgacgacgacgacgacgaatcgatcgacggcggcgatcgacgacgacggcgagctctagctacttctctccccttccccttgagagaggagagagagaaagcagacaagcaggccaacctcaaacacgtaccgcccccaaaaaacgcctctctatatatgcaatatgcttgtgtttatcaggagcttaattatccagcctctcctaataaaagcaaattaatcgagcaaaatcaagctgcgaaatggtggcaccctagtacgttgagaagatggcgacaataactaagatcgagcagcaaagaaagctagctagcaaacggctggctttggctgaatatatataggaaaaagggagaaggaaacagcagaaaaacttcctacctactaccaaccgtgtccatcttgcagatatgtatgtagtcgtcgtctctttcgttgtttgacattgcctacactgacatcgtcttcagataatcgtaccggccccattgtttcgtttatcgggggaataagctaaataacatatatatttgcaaacaaaaattaatttgtgaaaaaaatatatacatgttcttaacgatttaaaagtagagactgaaaaataaacttcgatgaaaaaaaaaatcctaaaattaactttaaatttatagttgaaaatttaaatttcggctgataattaagtataagtataagcataagcgaaaatatgaggcgtagtcgtctttgcccgtacgtgcggatgtatgcgtgtgtggtgatctatttttaattggtcaatttgaacatgcacacggcatgcatggctggtgtgctaaagctgcaagtttcttatttaatttaatttgttgctactgatttgcctttgtctcagttaattgaaactctgatttaccagctggtgaatatatatattttcagatgctcgtatactaccagtctaccacagaaaggacatattcatatactagctactagatagtattagtaccttaatttggttgtgaattctgatgccatacacaacgacacgaccagtatttcctgtcaccttatgtatgaccatccaaaggctatatatatctctacttattatttttcagaccaagttcatcaataagaaaatctacatttcagttggacctactgcaacttctctgaaagagattaagacaacttcttttagctatatattattttgtaacataaaactcggatgcttctcttaatgtgttttgagtccagctagctagctatagctaggacgcacgcatgcaacaaatcaagttgccacaaagaccgcgttttttcttctcatagaaccacaaaatcaataataccattaaaagaacaacaaaatctataataagagtactctacacaccgcttttttcccccttaattaagtatgtatctcagagacgtttaatcaaatactacctccttgcacaaatgtatgggacgttggttagttcaattttgagctaaccaattcaaacaaaaaaaaaatggagggagtattaaagaagtgcgcaatatattagttcttgattctcacagcaagtaatcatgcatgtatgcataatgaaatagcattataccaggattagttatactatacgccttcacatgtttgaaattaaaacattcaatttcaatttattttcttcttacattcttatctaggtatccataatatgtttttcctctccaagatcatcttaattatatatagcagattaattagcagtatactgtttgacttcttatcttgtatataatatataaatatatactgaacattttccaaaactatacataatatatatataccgatgttctataacctcaataatccactgcatctgctagcactatttgattatatatgcacgggaatcatatggtcaatttatatatatgaacaaaccatgttc

SEQ ID NO: 19516 - DNA, 1129 bp, Oryza sativa
gccgtgtatttggcctcctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 19517 - DNA, 572 bp, Oryza sativa
ggaaaacgatgatgtttatcagtagtggtagctgtctaaaccagacgtagaggtgagggcactagtcagcagtagacgtagacagcttgcgttgaagatgatgatgcctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataacaggccagccgtgcaggcggaaacaccagtcgacggcggtcgaggcggccggtcggtgaagacgtagacgcccaacaacggcggcataaaggccagcagtgcaggcggaaacaccagtcagcggcggacaaggcggccggtcagtgaagacgtagacgcccaacaacggcggcataataggccagccgtgcaggcggaaacaccagtcggcagcggcgaaagcaagccggtcagtgaagacgtagacgcccaacaacgggggcataataggccagcccgtgcaggcggaaacaccagtcggcagcggggaaggcc

SEQ ID NO: 19518 - DNA, 16709 bp, Oryza sativa
gggatgacgggtgggccccacccgtcagcgagggtggcgggcgggcccgcccgtcagcggcgcgcgcgcggggagaaggcccgggtggcccgcggggagaaggagagagggggagggaactgggccgagccggcccaagaggggaaggggggaaaaggactttttagagcttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcgttttgggacgctacaaggcagcgacggcgacgcaggacagcggcggcggcgctcggctgcagcactcggcagcgggcggcagcagcggcggctggcgcggtagggcggcacacggccacggcgacgcacggcacccggcagtggcggcatggctggcggcgcacggctgcggcagcagcgacgctaggcggtgtcaaggcttgggagcgacatgattagggttacaatatcaacgctaagagaattaaaacctaaaccagaagatcacggttagaagcctcacctaaccaagatgatcggagaggaggagtcagttacgccggtccggcggcaacacacggagagacgtgtgccccttgttcagtgatggattattgctaaatggccagtgatgaatgctcaataacattatgtctagacttgttcatttttttatgtacacttgtccttttttttttgatgaattgctgcccctgctgcccctgtgccccttgttcagtgatggattattgctaaatggccagtgatgaatgctcaataacattctgtctagacttgttcttttttttatgcataagaacagattatctacacttgttcttttcttatgcataagaacagattatcaacacttgtcctttttttatgcataagaacagattatctacacttgttctttttttatgcataagaacagattatctacacttgtccttttttttatgcataacaacagattatctatgattgttcttttttctggattgataagagactatatacactttgggtctttttcatcctagtagttgatttcctctttttttcccttcatgcaaatagtggtaattgatgcataatttctgagcaaaaccgaggccatatctttcatggtatataatgctaattagtataatgatagaaaatttataagctttttcggaaaaattagaccatgacaacgcccggcgcaaacccgtcttccctgacacctgcgaggatacaggaagaagcaaacccagccacagagactgttgccgaaggtcatccctcgacaacggcggtcgaacaacccgaaagtcatggtaatttataggataaattttcactacatgaccacataaattttagctagcaccccttagcatatgttgccttctgtgtgctgcagaatcgccccagcaagaacatacgtcaatatcgggtgggacaagtacgagtaaatcgagtagaaaccccccggacacaaaatatatggccgaccacagcgcaagttataagagaggttgacgctagtggtaggcccacggcgccgaggactgtcattggaagatggtctaactgctacgggctggcggcacgtgtgaatttcgggatcctccataaagatatcggcaaggtcacagaagccgagaaggagcgagcttggacggcaatggagaaatggctcacatttaaggctaaagcaaaggataggctcaagcggaagtcattccataagatgggcaaagcttggaagaattggaagtcgaagctcttcaccgagtttgtcaacccgcccggcaatcatacgccgttcgatgtttaccctcaaataaccgaagaggtgtgggaagaattttgctctctgaagaacacccaagagtttagggaatcaagcgagaaacatcaccaactgcaacagcggaatgagcacccgcatcggctgggcaccgcagggtacatcggcaaggagccaatatgggcccaagaggatgctgccactgcagcagcgaatgtccctgccccgttttcggacatccctgaacacagagctcgcaactgggcgcgggcaaggggtaaggtcaacccggacggctctgtcacatttcagaacaaaagtgatgtcgtcgtctatcaggaattggtgagttcactacttaacctaactaattaccattcgtatgaagtagaagtttgtataaacgactcttgttgtttatagttggggttggttggtgaacaagcttcacaaagcgaggttgagtccgtgccgaagaggcgcgaagatgacatcctcacaaaggcgctcggaaccaaagaacatactggccggactcggggaattggcagcgatgtgccctgaaagcacggactctcgcagtacaactcccaatacaggaaacggaaagtctccaacgaagagagggacgctcgtttcaaggccgagcttaaggtggaggtcattcaagaactacaagctagcatggaagatagggtggaagaaagggttaacaacgtcctcgccgacatgaatataccccgaggcacaacacctgctgtgcatccaactcctcgtgcacaacacgacgcgagtctgtcatagcgtaggagtagttgtgcatccacagaggtgccggccccaggtctcccgatcgcaccactagctgcagtggaccacatagaggtaattgatgttatccgatccatatctaatcaaaaacatttacacattccaatattaaattcaaacttttacatatgcagggcgtagcacagtgtgtcctactggcgaggatccaccaactttcgctcctgaagtcgctgagggcatggctttcaaaccctcggttacagataaggtccacggcgcagacctgctagccgggtatgccaaggtgtccatcgatacagtaaaggacacctggtcaggctatcggttgcccatgccccccaatgatgaaatcatgactttgggcgttgggcgcaagacgttcatacaatggcccaaagaagacatagttgtgaagatgacttctcgtccaaatcgaccgacggagcttacacctcccaaatctaagctatcaattgaggctccccgtggaccggcattgtcagtacctccttctcctgatggagatgatatggacttgggagatataactcaaagcttggctccaataaagaccacaagaaaggccgatagctccccaccacttgtgaagggccagaagcgtgaacgcgtcaaggggaaggtcggggagttagcaccggtgccaaaaaggggcaaggctgcgacgtcgatgccggagagcaaagcggggaaggtcgtgagggcgcctgcccaatttgagctaggcatgccattggtgaaggacaatgtgttagccgtgatgggtattacttgccgagagctacataagcaatacatggagctaagcaatgcctagcgaaaaatgagggagtcatccatagttggacatcacaaccaccagccgttcctatcgtcgcctgcctatgtaactataggctttgatgacctctccaaccttttcaggatccggaagttggacacaggacttctaaaatgctactccttgtaagtgctgaccttccatacttgtgatatgattggactatatctcctaattaaattagttctaatacgtaaatgtttttaggttgtgttggatcgagagtcgttgccatggtaaataggttgggttccttgatccatccatggtgaacgaggtcaatttacgccagagcttcactgatgtggttgactatgtcaaccgatgtttatgggcccaccaagacaaggagtacatcatgtgcgcacacaaccaggaataagaggataatacccttcgtgtatattgtttttgaagttaaggttcttattactaacgctacataaccactgcgcaggcgacattggattctcttagtcatcgtacctaagtggagtagggtttactaccttaactccaataagacgaaagattatgatttcactgatatcaccaaggccttaaatatggcttgggacccatatgtggaaaagggtggtaggcacaaggagggcaaggacgaactctattatgacactaagtttgcatgcgcacaacagatcagagaccagtgtggtttccacgtgtgcacaacatgtcaacactactaagagaggtgaaagatttcgaccctgagattgttactaatggcgaataagctcatttcaataccaatattgctattctaaatgtgaaaacatctgatttattaaacagaaaggtagagctggcttcaagatctcacccatcaacccccccgctatcagaggcgaagtgtgcgccttcattcttgcagaaataatgaacaagaaatgacgttttcacgtcaaatagactcatgaacttggctagataatttattgtgatataaaaaaattgtttttattatggagtgcaatgtaatttactttcatatgtgcaatatttatggtagttcgctaatttgtcatcaaatttgatcaactacgatttatgttgtactattcatttgttttctgctttttttttctaattgacaggtcatggaggtcgaggacattatgactttaatccatttggtaagtatatatgcggttctatgagcaacgaccgaaattatagctttcaatgggtataaatttgatgtgcaaaattgtggcatttgaactgcatatgtgaatgatgtcaatttttaggatggatctgtgatgttatattgggggtgactggaatatatctgtgatgtttctgtttttcagaaggcatggctagcaaatcctgaggctagccaatatttaggatttattttttttctgtgattaactcatcagtgacgggtcggaaccaaaatccgtcacaggtgacctcacatgtgacggactcgcaaataaaggcccgtcagtggtgacctacctgtgacgggcctttactttcggggccgtcacaggtagatcacctgtgacaacttctatctacggagaccatcacctctgacggcctttatttaaagggccatcagaggtaaatcacctgtgacgggtcctaactggccctaggctagcggagaccaacacctctgacggctgtctagtaacttgcccgtcagaggtgggtgtcacctgtgacggccgaccacccgtcaaaggtgactggactcaccagtgaccactgatcactgaccatgctcaaagccgtcaaaggtgagggtttgggcccgtcacaggtgaccttggccagtgtagtgtctgcccgaggaagtagcggtcggcttctccgcggtcaccgacgcctgcatcgagttgcatcatgatcaggtgctgtcctggtcgttcatctccactctagaaccagccacaaactcaactaaaattttccaccctgtcacatcgaacgtttgcacagaagtattaaatgtagactaaaaaaataactaactgcacagattgtgactaatttgcgagatgaatctattaagcctaattgctccatgatttgacaatgtggtgctaaagtaaacatttgctaatgacggattaattaggcttaataaattcgtctcgcaatttacatgcggattccgtaatttgttttgttattagactacgtttaatacttcaaatgtgtgtccgtatattcgatgtgacacgacgaaatttttcacccgtggatctaagcccaaatctcgcgaccattgcagctttgacagacacctcctcttggccagataggtagtacaaaataattaattactactccctctgtcctataatataagggattttgagtttttgcttgcaacgtttaaccactcgtcttattcaaaaaaattttgaacttattatttattttatttgtgacttactttattatttacagtactttaagcacaacttttcgttatttatatttgcaaaaaaaatttaaataagacgagtggtcagatgttgcaataaaaactcaaaatcccttatattgtgagacggagggagtagcaaatgacgatgataatcttagtattatactcattttgttcaacttggttgattaacagatacaggatcatcctaggtctcggctctgcgctacgctatctccacacggagtgggatcaatgcatatatattgcacggcgacatcaagccaagcaacattcttcttgactctttcaggcagcaccaagctggaggattttcggctggcaaggctcgtcgactatggcgccgacccacggactacgcaggttgttatgggcaccacagggtatattgaccaagcatcgagcttgacgtctacagctttggtgtcgtcatcctggaggtagtctctctggccgctggccggagatggagcagacggaccaggttatcccgctactacagtggatttgggatctgtacgatcgggacgcagtcacggatgtgtacaatcgcagtacgatcgtagacacgaagctagctgcaggaggttggccgagagtgtggcaccgtagaccgtgactgcgattggcagctccagcgtacggtcaccgtcgggctcgagtgaacggccgtccattacgagagccatgaacgtgctgcaatcagacgatgtgactctgcaggtcctgcaacggcggcagacttcgtgtcccgacgatttttgcagattgcatagcggcggcgactggttgtcatcagctactactagcacgggcaggtgacacacgtgtaatgtagggacctgggctagataagtactcctccgttttttaatatacgccgccgttgactttttctcacatgtttaaccattcgtcttatttaaaaaatttatgcaaatgtataagatataaatcacacttaaagtactatgagtgataaaacaactcataataaaataaattataattatataaattttttgaataagacgaatggtcaaacatgtgagaaaaagtcaatggcgttatctattaaaaaacggaggtagtactagatagccagctgccagcacttgcacattctaattttattggcaactatacatttgtgacgccatttttttactaaaaataatctattcgtttttactttacgcttacactgtaaatttcagtagttatatgctataaattttctaatacacattacacataagaattatgatagtaaatcaatccaatatgggatataacatattctactattacgaatgtgttaaagagctagtgttattcaaacttcagagctgtacaggctaacgagtaggattctaatcgactaagggtgtgtgtttagttatttcggtgtaaagttcttaaagtatacggacacacattcgaagtattaaatgtagactaataataaaataaattacaagttccgcctgtaaactgtgagacgaatttattaagcacaattaatccatcattagcaattttttactgtaacatcacattttcaaatcatggcgtaattaggctcaaaagatttgtctcgtaatttacatgcaaactgtgcaattggtttcttttttcttacatttaatgccccatgcataggtccaatcatttgacgtgacattttttgccaaaatgtttcaggatctaaactaggcctaaactaggcctaagtaaatagttattaaaaaaattgaccaaatagattaatgtgtaatatatcacttgacaaatttgcaagttcaaaatcgacttctataaattgtaacaaaaatgacaaattaaactctaactagtataagtatatttatagtcaaatctgttattttgttacaaattccagtagttgaatttaaacttacattacatgtttgtagagtgatatattattattagtattctatattgtcatttaaagaaaaacataaccaattagttcatatgcaatgaacaagtactccaaatttgaattcttttgatactgcttgttatcactacttggacctggaccattttgttcggtcttgtaagatgtaggttagatgcaatatgtgttttgaattgggccacattaggtagttttgctctcaagcttgttctaaatgggccttttctgttacatcctgattttcgttttaggatttataaattatatttataatttatattaaatgttcattaatttacaagtgaagttagatgtgggaaataaaattttctaaatataaagcatgattggatttaatttttattaaattctccatgattaattatactctctgaaattttctcggatttttcagagctcaattcttaattttaataatacaaagagcatttcagaaattatttaaatattaagttagtaattaaatggtttgattataatcttgttaagtactttgagtgttcaattagtttcaggatttttcttgaaattatttgagcattggaaatattttaacaattcgaagatcattaatttaattacaaaagtaaattaaatccccttttccttttcgggctgaaactggaaaagttcacctttagttctcggcccattctcccttcctttcagctgcctttattcctcctccgaagtccatttcttgtccctccttcaatcgggctggataaaagaagcccagacaaagtctaattagccttcctgctacagtatcgtcttcaagcttggacagagcccgtgcagccgccgagccgtgtgtgccgctgccgattcctccgcccgatttgctcgattctctcagccgtttcttgaattagttgaggagatttgtttcccttatcctcctctatcttttcccccaaaaatcctattttatccctttgaattcgacgcgaatttggattcgttttcgagtttatctctccttttcccggcgcgattccatccgttcccgagccgatctctccctcttccggctataaatagcagctcctaaacctcctctttcgttttccaccctcgcccgagctcgccgtcgcccgtagcgccctagccgcctccaccctagcgccgccgccatcgccgtcgccgagtctccagccgtgccgctcgtcgccgtccatcgttgccttcggtcgccgtcgccaccaccgggttcgcaaggaggagctgcacaccgtccacccctcggtcgaagccgaagcctgccggagcgccactgacgccgtcaacccgagcccgtcgccgcctcaatctcgtcgccggccgttttccgtcatcgattgtcgtcgccgtcaccatcagtgagttcctctcgtcgtcctcatcgcgtagatgtcctcggttggcccggccgagtcctccatcgccggcggtcatgtggtccagtgccttgttccggcaatgatgtcatgccgacgtcataaagcccctttttcccttctaaaaataaatcttaattgtgtcataaatcgtaaatccttttccgtataaggctaaaatcagtttaatattgtaaaattcataactaattcatatgaagtcggaatgaggccgttcaagtctctaaattcatctaaaatcatgatctacatgtttgtttactttttatgtactgtttatttagtttttattagtctttttcttcgttttgtgtgttagcttgtcgtttccgtcgttgcgaaggttcgtgagtgcgtcggaagtgtttaagaagactaattgaagaccgattattgcaaggcaagtcacacagatcccaaacataatcctttgaacatgttgatctcatatttaaattctctatttatttcaactgtgcatttattttcaaatgtcaacgggtggtgtgaacctattcctttgttatggccaatttgcattgaataccctattacttgataccttgggtaataaattgattagcttgaaccttatatattggtttggtttagctaaatgctatatatatatatatatatatatatatatatatatataattgcttagccatgcttataaacattagcatatgattgggataactaatgttacactaccacttatgattatatttaatggtagctcacgatggtcaatcgtgattggttaattaattacgtgccaactaaaacttgacaatggtgggttgtgagcacatggttttgaaggtcgtgctcataacaattaaggatcggttcgcgagctactgttatgagacattaaccgtgccaaccacaagccagcgtgggcaacggctttagcttttgtatagtatggttcattgcggggcaccagactgtgaagcggcgagaagtccgtgggggtcgctggggagtccatgcctctggttttttgtttttgagggggtgattatgatctaggaatggtgcgctgtgtggattatgttgtgcgaggggtattgtcacagtcccgtttcgaggtaccgtggtggtactgagggcatggtaacatgttttggggctgtgtcttgtgagtacagtggtacacctctggccagagtaatatttttcgtgattagtctcacacctctcacaataattattgatgctataactggtaataatttgcttagctcctggtttggagttagatctgtacagccgggtatggttgttcaggatggttgggcctgtgcagcatggctgtgctgttcagtgttgattaatattgatgattaattactctactgttttactacttctaaatgtttgcctaaatgcgcttttgcaaatgagtctatattatgcgatcctttggtatttttgtgcacttgcatatttgttgtgtggcttgcggagtattccatgttttcaccttgcaataatcaatcaacctcagttgaacaaaaaggatctagaaagagaagacgtttggcttataccccagttgagctgcctgtgggagtggagctgaagccatcgctagaccgttttttccgctgcagtttttttctttacttttgtaagtatgtaacgttatcattatgatggatttgtatattaaattgtcagtttgtgtacctcggctaattcctggacgaggcttttatgcacaaataagttcaaaaattactagtgaatttctgggcatgacattttctaaacctaagcccactagcacggagaagggaggttgttattggttaataaatctgctgggtctcagaataaatagtttgggtaaaagaaaagctcccctcttctcctagtgtctcttctcctcctcctgcaatagcaaaaccccaatccaatctcacctgatcgccggtgaatgctgttatggcgaataccaacgctactgtagaagttatctttgccgggatggcgaaaatcacactagtcccggtcaaataggaactgggactaaagaacatttttagttggataaaaaagggcaatggagctttatgatttttagtcctgattggtgttaccaaccggattaaagacagccggggctaaagataaaaacatttttatacttcttcttcctcctccagcccgagccattgctacaaaggtttggaggaagaagggaggtgctaccaaatttttttgtgaaagtgtttcggtgataatatacaaatcgaaggaatctaaaaggttagcaactccatcctctgataatgtatgcttagtatattacatttatagttatggttatatacattattgtctctgaaaaggtttatggaaaatgacaagagagaaaatttgttaggataaaaataggttacttttaaaattagaaacatgtggataaaaatgttataaaatagatgacaaaggaaaaatatagaaaattaagataaaagaatagaaaacaaagttaatttaataaaatagttagaaaaagtacaatacattaaacatatcattagaactttaaaaataattaataatattaataatatgtgggattattgtatgattatttgtatatagttattgtatgattatttaattagcttgactttcgtggattttatttttacgatttttgtgcatttcaggtagatggatcggcaatggatgtacaccgcggaacgacggtcgacaaagtttattgaaggcttgcattattttttgagtgttgccaatgctaacaagcataagggttttacatgttgtccatacaaaaagtgcaaaaaccaaaagtagtattctacatcatgaactatttatgcccacttgtttcagtcgaggttaatgcctagctaaaattgttggacctcgcacgaaaagttaggggttgcgatggaggaagatgacgtaaaagacgagaacattccggactgggctcaatacggtggatttgatgaaaatacaacaaacgaggcggacgagtgttgacgaaaaatacgaggcctgagagatctgcttaactccagtgcaggtccaaaactcgccttcgggtatgctagcgtgccagttgatttgatcctgcaatcaacaagaaacaaagacaaagaaactgtagttaaatccataaacgatagccgatcggctgagtgccgatgacatatcatttatctttgggctgatgtcatatatgaatcgatcggcagtccttaataaataagaaagaactacatctactcgatcggctgtagatatcaccaatatataatcctgacgtcgatatatacttaaatcaagtgattgggatagatcggttgccatgccgagacagtataaatcacttagatcgaaatatgtactaacaacaagattatatatgttcatagcatagccgatcaaatagatctagcatgtatcggctaattctccgataccactctatattaagatattaaagcaagtagaatataccaaacagaagcctaatatacttaaatgcaataagatcttgacataaagggcagatttaatatgtcagtaaagcacataaagcaaatatagttaaactaggtaagatcggctgaaaccccgatactaccctaatcggcaaccagaagacagggtagagattgaaattctaagcacgacttaatagatcaaactcaactgatgcagtattaagtatgaaaagaagagcaatatctagacaatcaagtcgttggatgtttcatagagtggtggatatcttatataatccaagctaacgtcgctatttaacctaatcggacgccttctattaacagaagttagccgattgtaggttagatgacgatattatcgaagattatataagatatatgataactcgacgaattacataaacaagattagagtgtcataaagatggaagcactaatcccgagaacgcaagccgccataacaagatttacctcttgttgaagatcgaaaccgatgcagctcaacccgaaagcaagaactcgccgaaataaaacgaaagcaaaaagggtggcgatgcgccgaaattgtattgaacgtgtgttagtttgattacatgaggttcggggctatttatacccgagaattacaaaacatgcccataccggacacgactcttatctctaacaaactctaagataccacaagtatttacggcagacttttgcccaagcatatctctaatgaaattacataaaatatcctaattagtagatacaattgccttcccaggactccatccatgtgtggcaatcatcttgaagcacttcaacccaacccgatgttgtacaccaagtcgtattgtcagaatcggctgcatcacctaaccaagtctgactccaactcagccgatccaatcgtagccgatccggactccagccgattcttactctgtttctgcgacaatcttcatcttcgatttcgcttcaatctagtcttcatctccgatactgatattaccaaatttggtcgttaacacatgccccccaagtccggaatattcgataatgtttcggatttgccgcatatcgactccgagcaagtttcgcactccgccgttttccgaccgttatcctccgtgctttaaatactaaccgccaccctgaaaaatctttaccccgttacttccgttttcaccgccgaagcaaaccccgtcctctctctctccggcgatttcctcggtgcgcgaggcgatccccaagcgacttcatctccggttagatctccgcccgcgacgatgtcttcttccgccagcccgtctaccgcaccgtcagctgagtacgctgaggtaagttcccgtcggctagatcccctttctcagcatcagattgatcttccaacacttcatcttgttttccccttcttggttcttttggatttgtagcatctttccaacctagttgcaattcccagcctgtcgcacgaaaattattactttctcggcccagtcggcaaccctgatcccaccgagttcattattggcgaaaccaataggattactttcggattgaccaacccagatttaggtcactagaaaaacactttcaaatcctggccatcccttgagaaaacctcacccgagaaaagttggatcacatggttcaagcgcatgtcggctagcaaaagatttcattgggatgaaattggaatcggccaagcacttgatctcaccatagccaactcagctaaagacgagcccctaatggcagctgcctcctatttttggtccaacaaacaccatcaatgccttcttgttcaatcaagggccgatgactccaactctcatagatatcataatgattacgggtctggatgtcacctcatcggctaaccctatgagcttgaacacgaagaaccaatatgacttttttaccaagagcataggcggctggtcaggctatgtagcggcatatatgggccaaggttctgtcactcctcgagaacatgtagcttttctgctaatgtggctagaaaaaatcctcttttgtggatcaagttgtggccctacaaccaactggcagttcgcagccaaagccttggagacaaagagacaatttcctttaggcaaaatcctcctcggctatttgtaccaaatgctaaacaatacatcggctaagttggccgtcggctcagtagtcggagcaggtggaccatggtggctattacagtcttggctgaatctagtagttatgaagtttgtcaatcggccatctgtaacagaagccgaattcccaagactggaaccgactgtagatgatgatggagaagaacgcactcatcgtagatgcacattttacggagaatatacctccacaccaaccgatgcaggagcaaagctatcggctgaactgctcaaggactggttctgtagtttttatgagggtttccaaaaagacactcgagtttggttcctctacgaagattcaacacttctggagaatccattggactttaggttcgaagatatcaatcatgaaagatatcagaaacccagagaaatcttttcagctgcaatcagtccatgtatcctccctgttggcattcatcatggatgaaacatccaagtttcttatgtgttttatcacccaatgagctcaaccagacaactaggaatgggccaactcccaatcggcttattctttgctgataagatccagtgccgaggggaaatttcatcaaccttaatgatggatcggctgcttaatctccaaggaccccctctaggcagcattgacaacatagagctggcaaccttcaggagcaaagcatttgacagatggtggggtgagtggaaactacacctattccatcaatcggcttctatgtatatgacagacctctttccagatgttgtccctcaggtatgtcttgacttgcttaatttcatttgaataattgtttaaccgactaatcttgattaattttccttttaatttgtagacaacagagtcatctcctcctcactagagcaatagtggcagaaatattgagtatgccccggggctgattccaaagggggtggaccatctcctcctattattggttataatgcccccaggacttcaactctccttcaagggctcgtcagagaaccagccgatgccggtaaaaagagaagaaccagatcatcggctgtggacacatcggctccagccccaaagaagaaggttaaattaaagaagcacaagccaaccgatgatctgcctgccctggatctgtccatcgaacaagctctggacgaagaagagattgaagaggacattgatcaagcggcagccgaattgagtgatattggaggaaaaacaccgtcagcctcgcccaagcaaactcccccaactcctgttgcaccggctaacttctcaagggtaaacatctctccttaattaccttttgcagttatcctattcatagccgatcactcataaaacttgtttttgcagaaaaagaagactgctgtgagaaagaaatcggcagcgacaacacttaaaccagccccaccagtaagattcccttatataaattctttcactaatctgatcatggccgatatttattcaacactttgtctttttgcagcctcctcctccttcttcacctcctgtgcagcaaatgtcaagtgatcgaactccatcggctgcagggagtcacaatgtcgaggaagaggaacaacccgctgttcctaacatcccagtaaatgtc

SEQ ID NO: 19519 - DNA, 696 bp, Oryza sativa
attgtcgggagcgaaaagacatcgaggtcacaatccaggccaatcggcagcttgttcatgaagagaaggccaagcttgatctgttacctgaaggaccaatcaaagccaatattgatcggctcgaagctcgcaagattgagctcttggcacaacttcaagaatgcaacaccgagctggatctggaacacaagaagctagccgatctcccacaagttgtcgaaggacagaaggcaagattaaaatcagctatcaagaatgtcgctgatatgaccaagtccttgaaagtcatccctagaatcgatgctcaagatgcccaggccatcgaagaactagaacaaattaggcagagggctgtatcggttatccagcgctatttatttcaatgacattttgtatagtagacttttggaaatttttgtaatcggctaagatactacgatactttacttaacttgtcttgataatcctttgtgccaattaatacaacttctgaattctgctcgaaaatcttcaaaattttgcaactgttgtatgtatgtgcccccctaattttgaaatgacgaaggcattgataaaattataacctagactaagggcgacataaccatatcggccattgaacatcggcaaaacacaaccgattacaaaaaaacaactaagggcgatataaccatatcggccattgtacatcagcaa

SEQ ID NO: 19520 - DNA, 605 bp, Oryza sativa
ctcgatccccctctcatgaacaagaaatcccaaaaattggccagccgatacaccaaaagcacactttgtcgggttcatcttcaagccatacttcctgggtctctcaaaaaccttcctcagatcggctatgtgatcgtctatctctttggacttgacaaccacatcatcgatgtaaacttccactaaccagccgatcaggtcatgatagatataattcatggctctttgatatgtagctccagcacttttcaagccaaaagtcatcacaacccagtcaaacaagccgattgcaccaggacacctaaaagatgttttatggatatcttcttcagccataaagatttggttgcatcctgtattaccccccataaaacttaaaatcttatgtcctgaggcagcatcaactaactgatcggctactggcagcagaaactcttcttttggggtggctttattcaaatccctgaaatcaatgcataccctgatcttaccagacttgttgataaccggaactatactagaaacccactcagcatatcggcacggacgaataaaaccagcatcatatagatgtttgatctcagccttcacaggttctagcatat

SEQ ID NO: 19521 - DNA, 1691 bp, Oryza sativa
ttgtctctcggccaatcgatctttgatcgaaatttttttttctccctgttgccgtgtgaatcaaaaaaattgccgagccggctgctgccttctgccgattagattggccactaccccggtcagaccggaataggtacgtcggttacaccggcgcaatgaacagtgagatcggcgatcaaaagaacaatgtagccgatctaaaccaatcaaccgagtgatcaatgtatttgcttggtggcagtaaattgatagattaatttcggctgtttagccgaaactctcgatttcgacgaaacagtaattactagattaaacgaaattcggccgtgatatagccgattagatcgttccccggcggagtcatcaaaaatcgtgttggcaacgtttttgacaagtcgacaaacacgatcgcaacacctaaagctttgcggtgatatggagtcgccaaccacctcgatctagccaaaaggctaaattaagatgggtttttatagaaaacagttaaaccggctagcgaagccgatttagagatcaaaatcagcctctaggccgatttagatcgatatgaggataactacctgtctcgtgggcaaacggaaggttttcagaacaaatctacaaagaagtgtcgcactctcgtagtggcggcggacggtttacggcgtaaaccgacaaagatggactaaaactagggtaaaatagaaaacatagtaaaagaacgattcaagtagattgggttacaattgaaccggtcttatcccttaaataggggttggtcttgccctttacagaccctcctccatgtccaactcgggatagaaaccaaagtaaacccgaaacatgccttcccaagcaagaaaacacaagacccgatgaaaacatactcgggcttagactctgacggtctgaccggccacatacctgcggtcagaccgcccacatacctgcggtctgaccggccctctctggaggaaaccgacatagctccaaactttggcaatcttttctatttcaatcctaggtgtcaaatttgggtgtaaacagatagcatggttcctcattttacattgcaaatactgttttcgtcaatgtagattggtattttaaatcgagagtgagccgttctaccttttggtaatattagctgctggacacccacgatattattttattatatttgaaggacatggaaatagaaatatttgttttagacaggtttgcccatggagttcgacacgttcctcaatctcctgttggatcagagcagcaaccatgtgggcatcgacgtcaaccccatcagctccaaggcctacacaaacgtgtccgatggtctggtctcggaagacgccattatggctgcgagcatcagctacatatatacaacaacctcaccggcttcccggcttcctagctgttcatctccagatcggcgacggcaagccgtacaacgtcagtgcgccggtggacatctgtgacggcatacctctgatgggcctatgaactggtcagagatgaccgtcacctttgacgggtcgctagttttgccgttatcgggggggaattcggccgcgacccgtcataggtatcccatcacctgtgacgggccggaaggaaaagccgtgataggtataccactgacgagttttgcttccaacccgtcattggtatcccctcacctgtgacgggccgga

SEQ ID NO: 19522 - DNA, 707 bp, Oryza sativa
gacggacaactcaatcgaagcctgtcaaaggtatgaccaatacctttgacgggctttttttacctaacccgtttaaggtgtgttgggtctataaatactctccaaaccgccaactgctttccatcccgaccagttcactgttcacaaatcggttgggagggcaagagggtgaatttttgctaaaattcaaggtaaaaaacacattattcttcccttcattctcaatatatcaatcatcatatatttttcttcctatgttgttgatttcagatggatcgcagttggatgtaccatattcatcgttcgtctacagagtatagagagggggtcactaaatttgtcacatttgcggagaatgacagaaaaagtaggatgagcatgtacatattgtgtccatgtaaggactgtaggaatgaaaagatgatccttgatagctcaaaagtgcattctcatttgataacgaatggattcatgaagaaatatacctgctggactaagcatggagagcaagaggcgccggatgtcgcagctgaagaagtgttggatctggatgtagagaacaccgccgcagctcgagaaggcatgtttgtaccttctccgttaggtggagagaccatagatttggacactcaatgtctatctacaatgttgcatgacattgaagacgcagaggataacgacagagattttgagaagtttagtaagtt

SEQ ID NO: 19523 - DNA, 968 bp, Oryza sativa
ttgcccgtgggcattctgatagacactgagagtgcccgccaaggtggtctccagatgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgcttgtatttgaggatgtgcggac

SEQ ID NO: 19524 - DNA, 26975 bp, Oryza sativa
  unsure (1)..(26975): unsure at all n locations
aatgacacattgatggtttacaatgagaagtgccgagaattgatgaatgaatttcggctggtgactttgaagcttgtgtctcgagagcaaaatgtagaagctaatgatttggcccaaggagtatcagggtacaagctgatcttacctgatttagccttatatttcatgtgcttaattggtatgcttgatctgccttttatattgagatcttgttgcttttaggtatattaagcttcttgtttgatatatttagcttgctttaatatcttaatatagagtagtatcagagtattagcctgtacttgctagatctatctgatcggctatgctataaacatttataatctccttgttagtatatatttcgatctaagtgatttatactgtttcggcatggcgaccgatatgtcccaatcacttgatttaagtatatatcgacataagtattgtatactgttaatatctatagccgaccgagtagatttagttctttattatttattaacatatgccgatcgatgcaaagatgacatcggctcaaagataaatgatatgtcatcggcaactagccaatcggctatcgtttatggatttaacctcggtttctttgtcttcatttcttgttgattacaggatcaaatcaactggcacgctcatagttccaaaggcaagatttcttggacatgcactggagttaagcagatctcccaggcctcgtggttttcacatcaacagggtgtccgtggatgagggcgaagaggtgattgggcttccacgcctcgttcttccttccgacacccagcgtgagtttttcttttgattttcgacatgcttttcgacgtcatcttcattttcttttatgaagatatgtttcgactcactccgcttttccttgttcccttcttacgcagttcgcacattggaagatatggaagcggaagcggcaaagatggtcggagctctgaccaccaccgaattcggctgcttgcttcagcgccaagccgatgggagggcgaaccgcgtctatgtcggcgacctggctgttcggtcgattatttcgaacgccaccgatgacgacgctgggacatcgaaaaaaagcaagcgggccgttgcgaagggtgtgcgagcacaagctcatcgcgccagcaaggacacggtcgacagcgacgcggataacgaggacgaagaggccgggtcagacgaggatggcggatcgcgcggctacacccccagtcccgtccaggcgaaggttggagcgggtgctcatgtttcgcccgtgcgtccgcgagacgtcgctggtgcgaatgggctcctggcgatctccagttctgcggcgaagccaggggcgccagctaggaagaagaagggggtggtgcaaatcgccgccggcttttctaacagcgaggcgtcttccgacgggacgcctacttcgcccgtgctgcggcgcgctggtcctcggaggcgccggtcaccaccgcccgctagcgacgccgaagcgccaacaggtggcaatgtttcggcccctgctgccggctccggttggggtgatcgaatcggcggcggcgaatgccccaggtaccgggagtgttgctgcagctccttcgacgagccatcggcgggacggaaaggggccggctgtcgaaatgactgtgtctgacatgacactttccgccccgcattttgtttccgccgatttcacctctcggaccaaaattacccccttcgtggatggggtgtgccaaattgtggccccatccgacggtttgagtcttttcaccgagctcaacgagttcggcaaaaactacgcagttacagagagcctttttgagcgggtatggactattattattgtgttccctttcgcttgcgcaatgcttttatccttttttgcctttgttataataaatggcttcggcttctcttactcagggtcttgcggcgcatctaagcgcgaaacggtccgcctcggagcgactagacgggtaccgactccgtcttcggaaagctgaggaggaccttcaccacaaagaggacgaacgccgggtcgtggcggacgccctgaagaaggcgaacgcggagaacaaatccctcacgggggaaaacaagtctcttcgcgtcgacctggaaagggcgaacgggagggccgccgaacaggagcgtcaacttgccgcggccgaggagaagattaggtccctcgagacccggcttattgcggccgaagctgctactgaggctttggcgccggcgacggagtctgccaagcaagcctgctacacccttcggctggctctcaatgacatcggcgcgcgtgcggaaggcgctccgggtgaagatgggacggtgttcaacttctccgagtggacgcaggatgcggccggctcggttgtcgaagtggctagcgcctatggagattgctgcgcgcgcgtttctgcgggttttgtgctcagcttgcttcacgagcatggttgcggccatgttgaaaatttttccgagctcgtgaaaggggactggcctgaaaactcccagccttccggagcggctttgatggccttccgaaagggcttttgggaggatggcggtaaagtctgcgcgaagacacgtctgcgcgagaaactcgagaagatggtgaaagccgaagacgccgctgccgccaacgctggggaagaccctgggccgtcggagcctgctgttgagcgtgagggcgaaggagacgaaggccaagaccaccctgaggtgtgagaccgttcgctctcgtgttccttttgccttttaggctttttgtagtttttgtttatgtatatagttttgcatgtttggctaatggccgctatcgccttgtagccgttatggctgtcctttattaatgaaaagtttgtatttcgccaatcgtgcgtttttattggaatgtgggattgatttcgttagcatttctcccttttgcactgttcctttgtgccttgctggcagggttgtagccggaaaatgtgagttcggcctcccttcatggattggcgaaataagaacgagaagttcatggcggagaagggcatacccaagactaaatgtcctttttggcccgtttatcgcgaaatgttaaaaaacggcaacagctacaaggttataaaggttgcaggatggatgcgagcacatccgagccgaaccctagaggattatgaccgctatcatgtggtgcgtcgcgaagatagcacaattttttggcgaaactttaagaggtcgattcgctaagaggcgatcgctcgtcgccgttatagtttggtttgtgcttggcccccatcccctttaagggttgtgtataatgttagtagtgacgacgaaactggttcgccgggttgtaatatagatgagggcgaaagtgtaaacgatgatgtaatctttttgtgaggttctcacgtgaatacaacatgttttttattttgtttagtttatgctttgtaaattttggaacacatcttcatgctatcattcgcatagtcactgtcgtgctttcgttaggtcaaaacatgtcggcccctctgcgtactatagcgaaaagatatgtttatttctcagctctcttctttcgttttcggctcgtggcaggcgtgctgtcgagcatcgtggcctgtgtgtaagctgaatgcaacggtgttttgacttttattttcaaaatcgagctgtcgcggtttcaacgttcggtgagctatgcttcgaccgattcgtttcgcccccctggcgttttcgctgatcaagcgtttgccttggggtttttccacgagaacattattcacaaaaggggaggatgaaaaagatagaaagattttatattggttcgggcctccaaggtggataataaccctacgtccagtttttcttttttgcttttttcattttcctctttttttgtgctgaacggcttacatagtatgtacaactgtacaattggcgaatcgggtgccacccgttttacacataaaattgtctaagggaagcagcgtttcaggagtggtcgaactcttcttcctccaaagttgccagccgaaaagaacctgttagagatttgtgcttgattaggtatggtccttcccacttagagtccagtttccccactgccacggggttcgccttttttcttagcacgagatggccgggccaaagttccgtcggtcgaacctttttgttgtaggttgccgaagtaccttccgcgtacttgctcatgtgttgtagagcttcgactcgtaccccttgcaagagttcgagcaacacttcgcgcccattttcgcccccggagaacatcacccttggtgagttagaccctagttctgccggcgtcatcgccacttctccgtagagaagcatgaaagggctgaactttgttggccttgtaggggtcatccgaagggcctagagaacggatagcatttcgtctggctatttacccttcgccgccccctcaagtctcttctttagaacctcgaggatttttccatttgcccattcggccgccccgttcgactgcgggtgtgcgaccgaagcgaatctgatttgcaggtttagcccctcgcacatttctcggaatttctcggaatcgaattgtttaccattgtcagtgatgaactcttttggtaccccgaatcggcaaacaatgttcttccagacaaacttttgaaccgcagctgtggttattgtgcctagtggttcggcttcaaccgagcgagagaagtactcgatggctactatggcgaacttgtagccgtttcgcgccactgggaatgggccgatgatgtctaagccccaccttgcgaatggccagattggcgcgattggctgtagttcgtattgtggtgccgtttggcttcagccatgtctctggcagctttcgcactttttgacatgttcaacgcatactttaagtatggttggccaatatatgccttggcgaaatacttttgacgcgacggtccttgctgccaggtgtgctccgcacatcccttggtatatttcctttaccatctcctcacctttggagaaagatacacagcgaagcatgggctgtagtattccagttcggtacaattgcccagagattatcttgtacttcgcggttctgatctgcagctgttttgcctttggttcgtcatctggcagccatccctctttgaggtgcttgacgaagggcgttcgccagtcatctgggtcttcgcccnnnnnnnnnnnnnnnnnnnncataatgtgttggctttctgttggcacacttggtgaatacaggacttcaaagaagacccctagcgaatgcggccccccacaggcggctaattttgccaatgcgtcagcctcttcgttttgacctcggggcaagtgttcgaccgttatgctggcgaaagttttttccatagatcgaacggcttcgaggtattttctcattccttcctcctttgcttcaaaggatttatcgacttggctagcgacaagttttgagtctgttcggattagaagcctccgaacgcctaacgactttgcttttctcagccccgtcaacactgcttcatattcagccgtgttgttggttgtgtcgaactgcagtctagctgcgtagcaaattaatacgtcccctggcgaagtcaggattgcggcgatccccgcccccttgtgagaccacgagccgtctaagtgcatgacccatggctgttcgacgggcatccgtgctctgggacggatgcgggtgtccattcagccatgaagtcggcgaggagttgggacttgattgcagtgcgagcgacaaagtgtaggtcgaagggtgatagctcagcagcccacttgcttcgacgccccgtgatttcttttcctcaaagcacttcgcccaaaggatactgcgaaggtaccacgattttgtcggcttggtaatagtgcttgagctttcttgaagccatcatttgggcgtaagcgagtttttccatttcgatgtatctgaccttcgcccctggagcgcttcggagacaaaataaactggcttttggccaacttcagtttcttgtaccaaagctgcgctgacagcaacgggcgaagccgctagatagagccagagttcgcttcctgccactaagctaactagagttggagggctttggagatactgcttaaactcgtcgaaagctttttggcattcgggtgtccaacagaactttcctaccccgcgaagggtcttgaaaaaaggcaagcctctttcggctgcttttgacaggaattgactaagtgccgcaattcgccccgtgagctttcgtacttgtcgtacgctcgatggtggcttcatttgctgaatggcatcgatttttttggggttcgcttcgatcccccgttcggatacaagaaatcccaacaacttaccaacacgaacgccgaatacacacttatctaggttcagtttcatgccgattgcgtggagattgtcgaaagtctcttgcaaatctgatgagtggtcgaaggccttgcggctttttacgacgatgtcatcaacataagcttcaacatttcgccccaattgggaccccaggactttgtacactagcctgacaaacgtagcccctgcatttctaagaccgaaagacattctgaagtggcagaaggtgccgaagggcgtgatgaaggctgtcttcgggatgtcagccggattcatgtgaatttggtgatatcctgagtatgcatccaagaagctcatgagttcgcacccggcggtcgaatcgactagctgatcgatccggggcaacgggaagtcatccttcggacacatcttgttgaggtccgtgaagtcgacacacattcgccacttgccatttgacttcctcaccagtactgggtttgctaaccactctgggtggtcgatctctcgtatcactcccgcttttagcagcttgttcacttctgctttcaccgcctcccggcgatcggccgacattttcctcaacttttgcttcttcggccttgcttcaggcttgactgcgagatggtgcattatgaggtctggcgagacaccccctacttcgtctggcccccaagcgaagatgtcgatgttcttcttaagcacaaccatggtgttgtcaatttcttgttcgctcaggtctccaccaagcgatatgaccttggtggggtcggaatcatctatttgtcgctagatgaccttgccgtgggggtgggcttcggaactggttttgttttctcttgtccttcaacctctacggtgtggacttccctaccgaaaggggccactgtagcggtcgaaggctgggaacccttgacaactattacgccggtcgagcgtggcatcttgagcttgaggtagttgtgatgagagactgcttcgaacttggtcatagtgcccctgccgaagatggcgttgtagttgtatgggatgtcaacaatgtcgaagagtatctcctcttctcttctattctcttgcaagccaaaggcgactttgacgagggtttgtcccagaacttgcactgtttcacctccaaatcctctgagcgaagttggtgcttgggatagcgccaatgtcggcagacccatcttggcgtatgtcccggcgaacatgacatcagccgaacttcctccgtcgatcaggatgcgccggacttcaaaaccagccatttctgcagaaacaaccagcgggtcctgatgcgggaaaagaactccttcggcatcttctggcccgaaggatattggctgtgacaagtatcttggtgccccatcttcggccgaaacgatgttgtgcactgttcgaagttgcatcttcttttgccatttagacacttgtgaggggggatcagatcttgtaatgacttgaatcactcttcgccgcacgtcttggcgttgttctacttgaggtgcttggttagggatcgcttcgcgcggcgcctcttcgacccttccttgttgctgccttggcgcttgagcgttacattgctgtcggatgtttcgacattactcggttgtgtgcgaagagtgtccatgaaaggcgtagtacaagaccttcttgactttcttgtggaagggctgctgctgtccacccgcctgctgggagtcgaactcctttcggagggcctgcacttcctcgaccgccattaccgccttgccagctcgttcggtcctaaatttcctccaggttatcggggcttggttcgaccttgggtgttgtccttgattcgccgggagggttggttgaaccaggacaggcgccgaacttgcaacttgaggcggaacctgagcttgggcgttggcttgcgaagtggctgctgcagctgcggcggccttgtcatattcggcttgtatctcttgccttcgcttggtgtcttcttcgcctcgagcgtatccgtcgattatgcgaaagaggtgtttgagagttttgggttccttgcgtgcgagctttcttgtgagttcaccctcgagcaagccggccgaagttgcgttgacgacagatgcttcggttatatcctgcacttggcaccgtgcttgcgagaatcggcgcatgtattcccttgtcgattcccccggcctttggcaaatgcccaaaaggtcttggtgagttttcggctcctcataagtacctcgaaagttaaggacgaaaacgctgcgcaattgctccaatgagtaaagctattaacaggcagattgaagtaccaagatcgggctatgccatcgagtgcgaggcgaattacctttgccttagtgttctcatcgccgtgagccgcctcaattgcggactcgtagatggacaggaactctttcagatccgtttcacccgaataccttgggactggagggaacttgaactggggtgggatggggtgacttttgattccccagctgaggggcaaacccttttcgccacctggcttggttgtagccccttgttgggaaggccagttcagttgtgggtacggaggcgtgaatagcgaagctacagcttgcacttgaggttgagccgtagattgatgtcccatgccgaacatcactgcctgattctgctggtctgtcgaagtagcttgcctcgccgtagcagggtcaaacatagcttgattccaggcttggctttgcggtggggctgttccgtacccatggggtacggccaatgcgaaagtcatgggtgcctgggccgctgtgcttgggtcgaactatggcggtgggccttgagcttgacttagcaaagcgaactggctggacagctgtcccgtcgaagcaccttgacttgggcctccctcggccgtggccggagatgaatttcttggtatattgttgtggggttgattgagttgttgcaagaaggcttgaaactgcgcttgcaaggtcgaagctgcttccatcatagcttgcggcgtcacgccgaaaagcgtggtagcaggcttcgggtattgggcttgaggtgccgccgggcgaaccggtgccgggatcatttgaggcgttggacgcgcggcaatggccggggcgggcttggcgaagtacaccgacgcctgcatagcgtatggagaaagaacttggggctgagcgtagaactgttgggtgtgagccttggcttgtcttgctgcttcgtacgcttgttgctgctcttgcatctggcgaagcgtgtcttggagttttgtcatattctgacgcatggcctccatgtcagcttcggcttgtgcttcaaggttggtgttggcttgcgaggtggtgatcgctgttgatgtcgaagctggttgtgcgaaaacggcggtcgaagggccccccgctacttgggatgaaaagattacgtcggccttcgccgctgcttccgctttcaccgcttccgcctcaatcgaagatgtgggcgccgaagacgggagagttggtgccaccggagttggtaccgttccggcttcgcccgtggaggccgaaggctctgctccctcttcggctaacatctcgtcttcgacgtcaccttcctttcgcctgacaactctctccttgacggttttcttcggtggcatcagtggtttcgctcggaggtccccacggtcggcgccagctgttgtcgaatggacaactgcgtcacgccgaaaggcgtgattctctcaacagtggttggaaataaagacaattgtattgctttgtaaaattttttggatccccccattacaaggcctaagggggctatttatagccctattacaggttccttcctttagggtttaggttttacaaggcaatttacatggctacccttatgataggaacattattgggggtacacagtgtcctttacatgtatgggcccttattgggcttagatggcttggcccattcatccggcaaatcctcctcgagagtgtaacggcccgctaggcctcctcgcggtggggttcggcgctcggcgaagcccgtgtctccgtgctaaggctttcgcctcaccatcttcgcccgcggagcccttcgacaaggtctttgcctggcgaagcccgcgttaacccgagccacagccttcgcccgtacggtttcctcttcggccttggccctttgctttcggactgagccttatcgcccgagcgggtggtttcggcaggtctggccgaaggcactttgtggtatacctccaacaatatacataaaagaatattaacacgagagtatttatattggcatataaaacataaaatatatttttttgaagttaatacgtgcaaaatgaaaaatcttgaaatatacacactgttatattaagcaaggaggctgcataaaaaatttcatatttattcaaaacttctagtaagttcgtcaactgtaacctcttgtaagtcttgaagagcattttaggtattttttaaaagtatccacccctaatggtatattgtagaaaaaattgacaaagtcagtggcatattataaggaaagacaaagttgatgacaaatcatcgaactagactaaactcagtgacatagaatggattctatgttttatcgctcatctcttgatctaactgtagttttcttgtgtgtaggtctagattatttgcataagggttgcaacctgccaataattcatggggatgtaaagacaaataacattctcttgggtcggaatttaaaagcaaaaatagcagattttgggctttgaaaaacctaccatagcgactcccagactcacatatcagccactgcagcaggatctatgggctacattgaccctgagtatgagcttctttgtacgcaattaatgctaattttgtgctgtgtttcatatatattaatgattctattcaattttatccttaatcacttggtgcaatcattgtgtttaacaatgtgggccatttttaggtactacatcaccggtaggctcactgagagtagtgacgtctttagcttcggtgttgttttactagaggtaactagtggtaaacctcccataatacctgaaaatggccacattattgaacgtgtgaggcagaagatggtcaccggtaacatcaactcagttgccgatgcacgtcttggaggttcttataacatcaactccatgtggaaggttctagatgctgccatgatgttcacagcagatagctgctcaaaggccaatgatgtcggtcgtggtcatgcaattgaaggaaagtctggaattggaggaagctcatggggacatgggcgacatggaaaatgtagcaagagataacaagtctttgatgtccatgttcggtccatcgccaagatgaagaattaaccattgataactagctttgggacatatagtgggttctctgcttcaagtctaaaataaaaaaaactggtttgcatagatgatttgttttgtgttaagacacaataatttatacagtttgtattcgtgacagagctgacagtaagctgtttgtttcaatgtgcaacagtaagctattcgtgagagtagatcagccaaatgctgagaaggtggttgtttacaaccaaagattatgtactagaatcctctgccattttataatttgatcgaaatgttccacagcctcatggataattcagcacaactgcaaagggcagcacctcatgacagagctgaggagcatgtcaggactcgaccatcaagcaagaacgaatgatctcgttattcccgtttccttttttttttttttgggggggggaggggtggtttctctaatgtgtaaaacctatgtagatgtcgttattcatactgctccaacgatgcagttatgaaacttacaaatctaaaagacatgtttcgttgattttggttaggcgtagttgcataacacattgcaaagtcaaggtaagaagatctttacttaggtggatttcttcctaattctaatcatgtgagataggatatctcataaattgatttttctggacgataccctttttaggttgtagacggaccataactgcttctgcctgcaaaaatccctcacacggggtgagttcaaagcgctgcatgcaaaataacatttgcatgcggcctcttaagagatccacatatacaaatagactaaccttttcaggtgagcctccttagtggctacatgcgaaaatcagattttcacaagcgcctccttaagaggtccacttggaaaaatcactgcaaactaaatataaaaacgaaatccactccactcctccacctctcctctcttatcttctccccaatctccctctcgtgagcgcggctggagcagcgggagggtcggcgattggtggcgggcaggagcgaccaacgtcgggctggagtggtagtgagctcggcaatgtgggatccagcgtggaggacggtgggagcggcggtggcggcacactcgtattgggcatcggtgccctcggctacggaatctgacgcggaggacggcgggctcgggcggcggtagcaacgctctcggctagggattcagcgcggacgacggtgggagcggcggcggtgccctcggattgcatggtggtgccctcggttgcaggatgtggagctcggccgcgggatttgatacaaaggacggcgggagcaacggtgatggtatcgggtgacgacggcggtgtcctcggctgtggggtctggccggagtgacaagctcgatggcgaaggatctagccacgccgtcctcgagaggggcggatccaccaccctcatccacgaaaggggtgaccacgacattgggtagcgacagtggatctgacggcgccacccttgggatgggcggatcagccacccctggccccgagagggtgtcgactgcagtgggtggagtttgagggtagcggatccatcccccctccccccagcgcgggttgatgggccttctttatggcactaaaagagatcttatgatagatgacgcttcatttacgttataaacattgaattttttgtcatgtttcataatatgtgacgctcgcgtgacgaaaattcattcgtcacctatcatgcgtctctaatggcgttctatgacgaaaccttattttttcattaatctagtgacgatccttctgtcatcgtaactttgtgatgctcatattcgtcattatctagctaaaaaacgtcataaaatatctgatggcccattaaaatcaatgtattgagcactctgtttatgggctttagcccaatggctagcccgactagattttagcctggcccatctatgatgtagcatattttcagcccaattctattatatccatttgctttaatatcaaataataaatgggccaagtccattgcaaaagcccatataggcccaaacattataccacactattttcagcccgtcatattatattcattatattagtatcaaataacaagtgggctaagcccatataggcccaacaatcaaacataataacaacccatataggcccaacaatcaaacataataacaacccatatagcacaaaggtttcagcccaattagcatccaacacaacccgacaaacatccaatacaacacaaaatttacaacacagcaaatcagcaaatcaactggttggccactcgtgggaagtgtttgaactgtggcagggataggaagtgcttgaactgcggcagggacagggacaagaagtgcttgaactgcggcagggccggcctcagcttgctcaggaacccctatatcaaatacacaaagtgcaacagattaggcaccgattgactcattacatgataaaattgtgcacagctcagaacgcgctataatgtacggctccattatccatttgcaaacaagcctaaatagaagaataggcattgaaaaatacctcaagtaatgaagtttcagcaataaatcacatatatgaatcagggaggatagatatacatagaatctggaaaaaggagagcaaggattgattagggactgcggaggattgaatcaggaggaatgtcacttgcttctacttaccatgctgctgctgctgcttgccttccgcctgctgcatcgcgcctgctgcctgctgcctcgccacttgccacgcgcatgtccctgccgcgtagccgtgctgccggacaccagcgctggatatgagaaacacataagattgttgacaaacaacatactatattcaaccatgaaactacttttgaggtgctcataatcccaggcgcccagcaaacaaacctaatattgcatcttcgatatatttacaggatttgagccttatgagcttcttattagatagagctatgggctttgagcccaaaagagcttctgagagctcatgagctagctagatcttggcttgttaagaagacaccgactcgtttaattaattttacgagtcgagttgagcccataataagaagatgagaacaagcttagcttttacagtaagtttgtaactgttaattggcatgttcttgtcaaaaaagttttttaagtggccatgtttagtaacaggactaatccagaatgcatatacctgtaaatattattcagtaagtaagttttttcaaggcaatcatcagtatgtaagcttattttttcttgggatgtatgataaaagtggttatgaagaactttggaacataaagggggtaaagaaagttgtgcagactcgtatgaaaaaaaagacagatttttcaaagaaccttttctctgaagcatactttgttggtcttcatctccatgctcagttacttgagcaacctactaacctcgtcagcatgcagagatccagagtttagatgagccaagaaatctgcacaagaaaaaggtatcacaatcttctttcatctgcatgagaaataatgccaagagaacttcccagtttgatcagtttgggagaactaatgcagttgccctccctctgaagaaaggtactcctatatctgaacaaataggatttttaatagatttatccttgcgatatgcccttgatgtgtttaaacatctgaataaattttgctccatgcatctgaaattctaaatgtctgatgctgcaatgtcgtgctaattgatgttggtactactacattacaggttacaaattacaagtctttgcacttctcattttttaaaaaagaaaaaaagataggaaaaagaacagacctagacaggctgctgcaagagaggacatggtgaagcagcagcagtaatcagccgccgccggtgccggtgacgccgaggtctggcttgccgtcgtcctcgctgcttgtatgaggccagctccaagaacccccgctgcttgctcctgtaaagcagcctgcgcagcacccacccgaacacaacacgccccagccatcaacaaccgccgccgacgacgaagtatcagggggaaagaaacaagtagagaaaaacgggatgggcgcacctgttgatgaggcgacggcggctctcgtcggaggagaggtcgatggtggtggtggaggcgctgttctgctgggtggtggtgctggtggtggtggtgaaaccgaagaggacgcggtggggggggagggagtcttgacgaatccggtggcagtgcgggaagaggaggaggagaggcgctggtcggggtcgctccaccacggcacctggtcgagcgtcacggccggctccacccggcccacgcccggcgccgccgccaccgaggaggccgaggccgacgcggccgtcagcgagcgctggatcagagccgcgagcgcgagggtttggggaaaggaggaacgagatctggactcagatttggaatcgtggctgagggaagtagcaattttgatgcgattttaccagaataaccctggtatttggaaacttattatacaagttacttggataaaatggtcatttaacctgaaaattttaaaatactaaaaattcgaatcgaattttatcatactaaatgaacttatgtgaaaaaattgtcaaaaacaaagttgtataacttattgagatctaccaattttattttggttatttctccgtatgagtttgattgaccaatataaaattcggattttaaaatataagaaattcaaatatttttttttcaggtagttaatgattttaactgaaaaagtcatcaacaacaaagttgtataacttattaagatatacaacttttgttttggtcattttgctatatgactttgtttcaataaattaaatttgaattttaaattataacaacatcaaacaacattttcaaataataaatgatttcaactgaaaaagtcatcaacaacaaaattgtatagctcatcaatatctgcaacttttgttttggtcattttgctatatgactttgtttcaatatatttgaatttgaatttcaaattatgacaacttcaaacaacattttcaaatattagatgattttaactgaaaaagtcatcagtaacaaagttatataacttttattttggtcatttcttaatccagcaaactgatagtaatattattcacaaattttacacatctcttatgtggttttataaactataagagagatgtaattttcgtgaacaatgttactatcactttatcggataaagaaatgatcaaaatataagttatagatattgatgagttatacaactttgttgttgacaacattttaagttgaaatcatctagtacttgaaaatgttgtttgaagttgtcataatttgaaattcaaattcaaattattgaaacaaagtcaaatagcaaaatgatcaaaacaaaagttgtagatattgataagttatacaactttgttgttgatgacattttcagttgaactcatttagtatttgaaaatattgtttgaagttgttataatttgaaattcaaattttatataggtcaatcaaacccaaatggagaaataaccaaaataaaattggtagatcttaataagttatacaaccttgtttttgacaactttttcacataagttcatttagtatgataaaattcgatttgaaattttaatagtttgaaattaattgagaggagagagccaaaatgaacttctggttggagggaggaggggaaggggcagcttggctgctgggccggcaagttgagtggcgcggcccatggaggagtagaggaggccttcacggctcgggccgaggtgggccgagggagaaaggagggagagggaaaaaggccgagcgggctggcggggatttgaataagactttgggacggattcggcccaaatgacaaaggagggtttgtttttagtttttatttttaataaactctattaattgtttttttcttaataaatatttcggtgctctgaaaattcaagtaaacatccaggacatattttagaccgatgagaatttatgaaaaatactttgtgccacattcaaattttttcttgcacgtattttagtgtttgccattttcttttaggattttacttaattatattattcattttagagaataatttttaatttgggtgaatttatccggatgtgacaattattttagggcgttacaaagggcagttcaagcattcatcattttaaaaagaaaaaaacttatgataaaccagcattgttaggaacttgtgacgtttgttggtaggtctcttatgacaaaataatattcgtcacaatgcaccattagactagtttatgacgatctgtatttgatcttagtgacgaccaccctatttttgtcactaaccagcaccaccccctatcaaacgtcataaaacgaaatggcatagtgacgaaaagcaccgtcgtcacgaggaattcgtcatagaagatcatatttcttgtagtgtggatgggcaataaaatttactttcaattctgacaaagctacgtagcaaggtagtacatggtcaggactatactagccaatttttgcgtgagctgcttaggtttgtgaacttcttccccttcatgcttattattctctttatatttgaggaatatctagacggtaccttgatgctctcaggcattcaaacatactttccttctcttccttgctcagggtgtagctagctggactcaagtaatggcttcctttcttcttcggttccgaatgatggccctcgcgttgttccttatgcttgagatcattatgtgcttcaaatgtatctttcgacttcctatatacacctgaagcccagcaggttgacgcaaaggttcttagtgaggtgcatcacatcgattgcgtgatgggcgtccaagagttcccaatagggtaactctcaaaaaatagacttcttccacatcgccgtgtgactatcttcgctctctataggttggctgccaagtccctttccaaatactactttcagatctttcaccatagcaaacacgacttttccattgcgatgtttaggcttagtacgatggtctgccttctattcgaagtgcctgcctttcttccgtatagagtggcttgcaaaaaggaatcgacaatggcccatgtacataactttcctacaatgttttagatatgtacttttagtttcatccatgcagtgggtgtgttaacaatggaattttgcattagattcagaaaagaaggaacaagatcaaagtggatttgatgaaggagcaagttgtatttgaggtctgactcaacatctactgggcatcgtatcggctggagacagaataaaagtttggcttagccgatatggcaagtggtcgataggatataaattgggcacggtttggggctagattggaataaccgtcattgccaattagagataggatatttatgtcaatttgttagagatttggtaagagaccaccatatggtcttgtttgtatcttatctttaggaaagtttgagtcgtgtctatcatggactaagtttgtacttggggtataaatatgaaccccaaaccattttaataagggaaacaatccaatacaacttcggcgcatcatcatccttttttgttctacttttcgtcaagttctcttgacaagaggtaactcgtctcgatggcttgcgctatcggggttactatgtcgttttagatgttttagtccttttatcataaccatctgctatcatatgtcttagttaatctagtcttagtatcttaattgaactctatcggctggtactcgttttagggttcttgctggtattggctaaatcgttttactatattagattaactaaggcattgtcacacccgaagtttttccccctttcccttagtttctaaatcattgctaaatcgtctatagaaaaaactctgttaaccaggaggaaaccttaaataacaatgtgtttaataatcaaaattgtcggggagaattttttttcgaattctctttgcttgaaatcactaacaggatgttcagtgaaatattcagagtagaggaagtactaatgttaatttaaaatgtcaggagttgaattaataattccttcccctctctcctttggtcgtgaaccgcccccggttcactctccctgttcgtggtacgctgtatccgccaatcccgttgctgccgcggtttcgttttgtataacgagccgagtcctattctttctcgggtcccgttcccttttcctttcccgaaacggcaaagcatctatttatttttcctttccctttttggtaccctattctattaggtttttccccttctccctctcccctagccgccgcacaccacctcctactccccatgtcatgcgcgccacctcctctctcccaatccgactccccttctctctcctttgccgagtaaattaaggcccacctaatccatcttaattccccctatataattattcatacccctctatttttcctatttttccctcggttgtgaaaccctagctgaccctagtcgccgctgccgccttgttgccgcgccgctgctagctgtcgccggtgagctcccattcgattccctcggcatggttgtttccgtagtttccgcttgatccgtctaacctaattaatcttgctttgatctagcgtcgccgtctctccgtgtgttgccgccggaccgtcgtcactgtctcctcctctccgatcatcttggtttggtgaggctcctaaccgtgatctcctggtttaggttttaattttcttagcgttgttattgtaaccctaatcatgtcgctcccaagccttgccaccgcctagcgtcgctgctgccgcagccgtgcgccgccagccatgccgccactgccgggtgccgtgcgtcgccgttgccgtgtgccgccctaccgcgccagccgccgctgctgccgcccgctgccgagtgctgcagccgagcgccgccgccgctgtcctgcgtcgccgtcgctgccttgtcgcgtcccaaaacgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaagctctaaaaagtccttttccccccttcccctcttgggccggctcggcccagttccctccccctctctcctcctccccgcggcccacccggcctcctccccgcgcgcgcgccgctgacgggcgggccccgggggggggcgcgcccgcccgccaccctcgctgacgggtggggcccaccggtcatccccttcctcccgccgctcccgccgctcgcccgtgccctagcgccgccgccgccgcgaatctcgccgcctcccgccgtccccgcgcgcaataaagaggggggaaatattccccacgattccctctctctttccccccgtttttccctctctctctccctcggattcgcttggattcactcccgcaaacctcgccggcgccatcaatggcggccggatcctccgcgccggtttccatctcctccggccgccttccctcactcccaaccctatttaaaccacccccgtgccctcctccaccgtttccgccactcgccgcctctcctccccatcggaatcgagcccgcgccgtcgcaccctctctccgccgtcgccgccgagctccggtcagccgccgtcgtcgctccggaccgtctcccgccccgacgccgcctccttcggcttcgccgcgtccccgccgacctcggcacccctccgcttcgctcgccgaccgccggaacgtcgtcgaccccgtcgacccgacccgcgccgttgccttcctccgctccggccgccgttttcgtcgtcgccgtcaactcggggtgagccgtggaccgccgttcgttttcccctttccctcccctccctcggccgctgctccgccgtgccggtggtcgccggcggcgaccatcggggcgagggcgccgcctcccgccggtcgcgccgcaatggccgcccctcccccgggcgcaccgagcggctgccacgtggggcccggccgtcagccgcccgcgccctcgggtgcggctgacgcctggggcccacggcgccggtcggcgtgatccgcgtgcgcccggtccaccgtggaccgtgaggctgccgcgtgggccccactcccgtggacccggtccgcgcgccctctcccctcggctgacgcaataaatccgattttaaattaaaatttaaatgaagaaattcgcaaatattcatttaaagagcatataaacttcaaatggctataacttggccatttgaactcggaattggaccgttcaagtctctaatttttccttaagaagtcaagaacccatttttgtgatttgtttctgcttgttatatggagtttattagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttatgaaattattttgatttaaattattgcattatcgctttatttaaattcccgcgttatcactgttttatttagccatgcctatttacctttgttatgaccttattattattgttattgttattattaccttgttcaccctagaataaacaaaacccccaactagtggacactctacttgtggtatcactagtatgattttaggtagatgcttcgctaattaattaggtaacattaggtggttttaaaactctagactgtggtaatattcatatcacttggacactggaattgttggattattgtggaattggattcaccccgccccctctattcaaaactctcaaaatggttttaggctgggctcggggtgcatggttttgatagtcgcacctcggccatataaggaccggtcttcgggcctctattgcaaagcaccaccgtacttccacatgtctaatgggtaaggcttagtttgtggctcagtctggttataaacaaaagtacacggatggagatggacgaagtcgggggattcgatggacatctctaggacaaatgaaggctacacgagctgcggcccggtagtcgagatgtcatggcacagggttggtgccctgctgctaggggctcagtcctgcctacctgtcccgggggttccggccgtaggtgggattgggtcggtactcttgtctatggctaggatgggttgggaactatgtcacgtcttccgtctatataccgtggtggtatgtggcacgtgggtatacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaagacaggttcgtgtgggttcacggccttgtttaataatatggtacggctctaggatcgtgtttacaacatagttttgagcaactaagtgtcttttaatgctatttactgcaactcctaacccctatattataattccattgtactcctttgcaattacgctgcacttgtgggtgtgtcttgttgagtacggtggttgtactcagtcttgctcaatttttcccaaacccagaagaggagcccctggaagatgaaggctttggtgtctagctcgtgcctgccgtcaagtgcctgtggtcgtcgccctagtcttccgctgttctccgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacgcccattgggttatttccggtcgtgacatgcctagccactgtttgtcgctcggtagttgagttgcctagctgcagtcgtaaacccgagtctctaccggcctattgtttgccgtaccgggccattgccgcaaaccaagttaagtctactggtcatgtcgcagccattcgctagccgctaatcgttcgttcgcacgaagtatagtccaaagcctcgttcgttcggtcatcccgagtcgttctttagtaatagagtcattctaagccaccggttccgttcgttggtttggttgaccgtttgagtggtcccatgtcacggtgggttgactcgttgagttgataacccatggggcttgattactgttgttatatttccattgatctatttcgcctttgggcattaatatgtaataattaataaggtttttcggttaatagtaattacacagctcatattctaaaattcatatctaaattatccaagctccgttttaacccattcaagttgtagtgaattctttaaaaagtatagaatccattaaaattggtttcttttgctgtttcaatagacttattggatgtatattattgtatgctttgtttgtcatttagattctggcagttccgatgctccagtttatttcgaagtggttgccgaggttccgtcagctcaagagcaaggcaagtcatacatacaacattgatcatgttgaacctattttataaaatcccctgatttctattaaatcgcattgtgtttagaatgtcatgtgtgatggatacctatcgtacgcagcctgttgataccttatgccattgatagcttgggatataattgattagatgattggtttagggatgcttagaccaattagctcacaatgggattcattataatttagtccttaattatatgatgatgtaccaccatggttatggtttaattaaactaaaatatgctttaatggtgggttgtgggtgtatggttttggaaagtcgtgcccatgacaattatggaccggttctcgggaatccctggaagatataatcgtacttaccacaggccagcgtgggctccaggctaaatctagagtacaacttaacctagctgacataccatggcaagggtagaggcgatggtgcagtttggacttggctctagtctctgctgttttcggatttacctaggcacgagaggggactgccgggcttttctaaaaaggagggggtgaaacctaaggtggttatgttcggttagggagggttatatgaagggttttgtcacgatgtcccccgttgcagtatcacggtggtacttcggggcatggtaacatgtgtggaatcgtgtcttctgggtaaagttgtacacctctgatcagagttaaaactattcgaatagccgtgcccgcagttattgggcggtcaaccagctcaccatgagtagtctcatctttaaataatatgacttaatgaactggtgtagttcaggtggtttggttgggcctgttgcaacgtggtttagtgttgggtagtgatatttaatattgcttaattacaattattgttttactgtattcaaattatggtttataaatgctgcttttattgcaaatatcatataaccattcctttgtgaatatcttgcatcataccttcccgttggtgtgacttgttgagtacggtggttggtactcagtcttgctttattttttccaaccccagaggcagagagtggctgagatggtgagttctatgaggattgagcttgttccggacgttgaggatgcctgtggtttacggaagatgctacgctttttgtcgtgaagattaagtttaggttatttttttatttctgttgtgtatcaacttgtcgtttgtgtaccctggctggtcctagacagagattataataaacattctgcttgaaattcgggtagtgaatttctgagcgtgacatgtagctatcatcttgaaaagtaattaattccttaattgtttagactttaggtttctttacctactttgagatgcatcatccctagtcttgtctagaaccctagaaactaacctgaaattaattataattagagatagtatcagagtcttacctaatatacatgctacttttacatgttttatgtgtatttgccacttatatagatagatcaccatatataaatacatcaagtctagatcaataatcagctaggttatcaaacctggtaattgatctatatttgatatatttctataaatttatttgtttatataagtttgtactagactattagttagtccattatctttatttacctatcttgctctaaatattgttccatcggctattctcatgatatcgtcttaaatctatattatcaaactaagcagatgatatttagggttttatattcattgatctactcagtctatagccgatttggtctaaccacatcggctgagaccatcaatgatacgtcatcggcctatcgaccaatcggctatcggctaactcacattgtttcttgtttccttgctggttgcaggatgaaaccagctggcacgcccttggagcactcgaggaaagccttggacctgcactggagttaggcagatctcacaggccgccgtgttttccgtcaacaggtacaagccttataccccgtgtttgactgttcggataggttgctaactgcaggccaatcgttaatggtaacgaacaacaacgcttgtaggttgaattgcttctatttgacctcatcccacatgaggacacattctttcttccacagcagtttcggatcgtcaaccaatggtcttaggtactcatcaggccaggtgctatggctgttgctcatctcttccaaatagattcatgtcatccatacttaaaccgaaccttacgtttcatgcatcctctccgaagtcttcaaatgttccgtcggtggggtgtctcagcaccctgtcttgttaacattattttgcatgccagcgcatcattctagcatgcgatttgttcctgaaccaacgcccgagccatggtattatagggaaataccacatcaccatagcaagaactcacttcttcgaaggatgtctgttaacatcacctgg

SEQ ID NO: 19525 - DNA, 30122 bp, Oryza sativa
cccctttcatgaactaagaatcccaaaaactgaccagccgatacgccaaaggcacatttcgttgggttcatctttaagccatatttcggagccctttcaaaaaccttcctcaaatcggctatgtggttctctatttccttagacttgacaaccacgtcatcaatataaacttcaaccaaccagccgattaggtaattcatagccctttgatatgtagctccagcacttttcaaaccaaaagtcatcacaacccattcaaacaagccgattgcaccaggacatctaaaagttgttttatgaatatcttcttctgccataaagatctgattgtaaccaacattaccatccataaaactcaatatcttatgcccggaagcagcatcgaccaattgatctgcaatcggcattgggtattcatccttcggagtggctttattgagatctcgaaaatcaatgcacaccctaattttaccatttttcttgataaatggaactatattggaaacccactcagcatatcggcatggacgaataaaaccagcatcatatagacgcttgacctcagccttgacagcttcaagcatatcggctttgtacctccttggcggttgctggtatggtctgacccccggtttgataggtagccgatgttcaacaatcgatcggctgagtcctggcatctcataatactcccaagcaaagcaatctctatattctttcaaaagctctatcaacttggttctgaactctggagataagtttttcttaataaaagtcggccttggtgtatcacctggacctatatcaacttcttctaaatcatcagccgacatgaaaccctgtccttgcttgtcatcgagatcatctgccgtgtccttgttgtagacgtttgaaccctccacgactccctcaaaataataacttgggctctccatcttcaattggctgtatatcacaatcggacacttttagaaaacctccatcccaaacttttccagacaggcaatcaattccacccatctcccaaatagctaaatctgcactagcaacgttaactgacctgtcggctggcacaatttcaatctggtcgccttcccattgaatcaaacattgatgcatggtcgaaggagtacaacaattagcatgaatccaatccattccaagcaacaaactataggaacccttcccatcgatgacaaaaaatgttgtagggacggttttgctaccgactgtcaactccacattcaaaactccttttgtttccgatggattgcccccaaaatctttgagaaccatgtttatcttaatgagatcctcagaatttctgcccaacttcctgaatgtagcatatggcatcaaattcacagcagccccaccatcaaccatcatcttagacaccggcttcccattgacataaccgttaatgtacaatggtttgagatgccgattctctgtcccctctggcttctcaaaaactgcttgctctggtgaaaaaaccaattttgcagaggtttcctcaacttcatcaacatcggcttgattggccctaaattcggcaggtagtgtaaaaaccatgttcaccgatgcaattacgacactcttccctttagccaacctctttgcctcatccgcttcaacctcatcggctgtggcagcttggttcttaacacgccactcttgccctggctttgtcttcctcagccgatgactgatctcctgctctacctctcgaaaacgttctctgttcctcaacctttgaaccctcctcttctgattctttgtgaaaataccagaaggacactattaagcctttctatcctcatcatctccttgatcatacccctggtttactgggcctaatctttaatgaacaaaaactcttgtttgtctcagccgattacctctattgtaagatcggcttgaatgtcacaccctgattttcgtttcaggatttataaattatttaataaattattatcagaatttatattaaatgttcattaatttactagtgaagttaaatgagggaaataaaatttcctaaatataaagcatggatggatttaatttttattaaattctccatggttaattattctctctgaaatcctctcagatttttcggagctcaattcctaatttttaatcatacaaagagcatttcagtaattacccacatattaaattaatcattaaatggtctaattataattttgttaagtactttgagtgtccaagtatgttcaagatttttcttggaattatttgagcattggaagtatttttaacaattcaaagatcatttcagtgattaatttaattggaaaagtaattaaaattcaccttttccttttcgggccgaattaggaaaagtcctctcactctcggcccagtctcctctcagcctgcagcccttttcctctctttcccgaagtctgctttgcgtccctcctttaatcagtccttggaagtagaaaagcccggcaagaagtctactttcctccctggcactgttcatcttcaagcttggacagagccgagccgcccgtgctgtgccctgtgcagccaccgcttcctccgttaaatccgccacatcccgagctccgtttgcaaaattagttgaggggaaatattcctcttatcctcctctatccttttccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccctctttcccgagctctctagtgctccgtagcctcgtcgccgccgccgtcttgcttgccgtcgttgccggccatcttcggcgccgtcgcgccgccgcttccgtcgtcgccgccggtcgccgtcaccaccgtggggtgcgccaaggcgaggggaagcccggcctcctgtcccccttcgtcgccggccaccggagctccaccgccggcgaggtccgagccgccgccgccgttcacctcgtcgccggtcaccgtcggtcgtcgtttggctcgagggtaagtaccgttgggttcgtctcgtcgtcctctacgtgtacatatcctccaaattcgcagccaatcatccaatctccggcgaggtcgccatcttggtccggccattgatgatgtcatcatgacgtcatcatcggcttttctttttcccgattttctaatagattaaatcttcggaaaatcataactaaataatcgtagatccgtttcaggtggttcaagttgctaaatttttctaaaatcaagatctacatgttaaaaatatccacatgtactgtttatgcttgtttttgtactgttttgttgaattttgttctttcgctttagtttccgacgttccgaaggagagcgttttcgttgaggaaggttcggaagtgtttgcggaagcccaaggcaagtcacacagatcccaaacaaccctttgagcatgttgaacccgtttaaagttattattttatttcaactatgcattgttttcgaatgtcaccgggtggtgaacctttcccaattaattaatggccgaagatgactttattttcctatgggttataatttgattagctagaaccttatatattggtttggtttagctaaatgctacatatatatataattgcttagccatgcttagaaacattagctcactaattggatgaatcatatatactacattattatttatggttatatttaatggtagctcacgatggttaatcgtgttatgataattaattgataattaaaacttgattaaaggtgggttgtgagcacatggttttgaaagtcgtgctcatggcaattaaggaccggttcgcgagctactgttgcgagacattaaccgtgccaaccacaagccagcgtgggcaacggctttaccttttgtatagcatgattcattgcggggtgccagactgagaagcggcgagaagtccgtgggggtcgctggggagtccatgcctctggtttttgagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttataatctggtaataatttgtttagctcctggtttggagttagatctgtacagccgggtatggttgttcagaatggttgggcctgtgcaacatgggtgtgttgttcagtgttgattaaaatttatgattaattactccactgttttacttatcttaaatctttgctaaatgctgcttttgcaaatgagcctatattatgccatcctttggaatccttgtgcacttgcatatttgctgtgtggcttgttaagtatgctcattcttgcaataatcatcaaacctcagttgaagataaaggttccagaaggagaagacgtttggcttataccccagttgagctgcctgtgggagtggagctgaagccatcgctagatcgttattccgctgctgttttcttttcttttgtaagtatgtaacgttattattaagatggatttgtatattaaattgtcagtttgtgtacctcggctgattcctggacgaggattttatgcacaaattagttcggaaattactagtgaatttccgggcgtgacattgaactttctgcaacattactgcatccaggacaatcttcaatagatggtagtctcataccctcgttccagcaaaatctgaaaaactcacagcccccccaatgaggatcaaaaccaccatcttcttcataatacctctcctgctgctgcttgtcatacttcttctggtatttgttgataattctagccgaattcatctgaaaatttctattccttcctccatcggctgccctcccagatgtatgcaccatattaactggaaaaggattaccatcaactttcatcggcttcttggaatcatcaaatttgatttttcctccttcaatggccacctggatctgctgcctgaagactttgcaatcattagtagaatgagagccagaattatgccacttgcaatacctcctttttcctagcacttcagccgatggtatgacatgaccagcaggaagctgaatctgtttctcccgaagtaataaatcaaaaatcttgtcagccttggtgatatcaaaatcaaacttctcttcttttccagaactcctctcccatgggcatggcacaaccttcttgcttctaacccattcggctgctgctacttcggaatcatcatcttcatcatccgaattatacatgcatggatatacatgattgatctttttaaagttgtttttagcctctgcaaatctttgctcatgcagagtcactttttgtgcaaggtgagataagctctcaaactcctgagatgaaaatttctccttaatcggagctatcaaaccttgaaaagccaaatcggctaactgagaatctgttaaagccaagctgtagcatctattccttgtttctctaaacctctggatataatcctgcacagattcatcatgcctttgccgaatggctgtcaaatcagacagtttcatctcatggactccactgtaacaatagctgtgaaactgtttctccaaatcggcccaaccattgatagaattgtatggtagagaagagaaccaagtaaaagccgatccggacaaggacaaaggaaatagcctaactctcaaggcatcaatagccgatacttcaccacactgagctaagaatcggctaatatgctcataagtagaaacattatcttgccctgaaaattttgagaagtctggtaccttgtatcgggcaggcaatggaattctttcaaaccactcagggtatggatgccgatacaagttcccagtatccttcggcttgagcccaaatttctctctcattacatctgcgatcatatcggcccactgtctatgctgaggtgccccttgtgcttgttgcgacacaagctcgaattgattgaactgaggagcaaactgaggctgaggtgatcccccttgatgaacatgaggtgaaggaggctgatattgataattcaagtatcccccattatagttctgaatattcggatgtatattacgcaccaagtgttcaggtataacttgaggtatcattgtctgatctggttgcacattatgaaccaggtgctccgggacaacttgagttgtaacatgctgccttagctgattatcaggcgtcctcatcctagccgatgcatttagcaagttttgttgctgaatcggctgggtagcctgctgtcttgatggcgtttgctgaatcggcagtgctggatcggcagctggtggatttggcaagaacatggtagccacctgctcctgagtcagccgattgatgttttgaccggcatcctatggctgttccctggtcagtagcctaggattagtcatttgtcttgatgccgatgatggtgcaacttgtgcagctgaagcgggagccgtaaccgatgccatcggctgagttagtggtgcactagcaggattttgctgattgcctgtaaccaaaggcctgtaatttggaaaacaccacctggcaaatacactggtcctgtagcttgatgctcagctattgaaccatcgaccacagatttcaccatgtttgttagagtattaaccagcactccagattggttgatcaaagcatgttgcacggcataattgacctgatcctagaaattgtcaaactgcagttctagtccattgccatctggtccaagatcttcgaccatcccctcctgaagaccatcacctttatcacccgagccagctgcagcacctttatcgccctgagacgagcttgagccaacctcatcagctgtaactaccttcagcttgtatctctgaacgatggtccctttgcgagtctcccgaaaagaattcatgaactgatccttgacattgctgatcatctgttcgagctcgcccctttgctcggtcgtcagcttatccaatgtgatcggaacaatgttgctgggatccacttcagttgacggttgttcgcttcccgttttacccacgggaggcttgactcctgtccccggtgacggtggtggtttctcagccatcgggaagaagttgtcaaaaacccttgtcccaccgggcgtgccaaaagcgtgttgatgtgaaaaacacaaggcctgggagatctgcttaactccagtgcaggtccaagaaatcttgcctttggaactatgagcgtgccagttaatttgatcttgcaaacaacaagaaataaagacaaagaaaccgagcttaaatccataaacgatagccgatcggctagttgccgatgacatataatttatctttgagccgatgtcatctttgcatcgatcggcatatgttagtaaataataaaaaactaaatctactcgatcggctgtagatattaacagtatacaatccttatgtcgatatatacttaaatcaagtgattgggatagatcggtcgccatgccgagacagtataaatcacttagatcgaaatatatactagcaaggagattataaatgtttatagcatagacgatcagatagatctagcaagtaccggctaatactctgatactactctatattaatatattaaagcaagctaaatatatcaaacaagaagcttaatatacctaaaagcaacaaagatctcaatataaagggcagatctagcataccaattaagcacatgaaatataaggctaaatcaggtaagatcggctgaaaccccgatactaccttaatcggcaaccaaaagcaggctagagactatgattctaatcactacttataagatcaaactcaactgatacagctataagtatgaaaagaagaataatatctagacaatcaagctgttgaatgtttcataaggtggtggatatcctatataatctagatcaacatcggaatctaacctaattggctgccttctagcaatagatgttagccgattgaatgttcgataacaatattgctgaagattatatagaatatatgataacttgacaaattacataaacaagattagagcatcataaagatggaagcactaatcccgagaacgcaagccgccataacaagttttacctctaattgaagatcgaaatcgatgtagctcaactcgaaagcaagaactcgtcgaaacaaaacgaaagtaaaagggtggcgatgcgcagagattgtatttgaacgtgtgttagttttttacatagggctcagggtctatttatacccgagattacaaaatatgtccatgtcggacacgactcttatctctaacaaactctaagataccgtaagtctttgcggcagacttttgcccaagcttatctctaaggaaattacataaaataccctaattaataagtacaattgccttttcaggacactagccatgtatggcaatccatatgaagcacttaaacttaacccgatgatgtacaccgagtcatattgtcagaatcggctcaatcggctaaccttgtctgactcgaactctgttgattcaatcgtagccaattcggactttagccgattcttgctctgctttcagcacgatctatctcttggattctgcttcggtttcatcctcatctccgatactaaaattaccaaatttggttgttaacacaccactcattcatgagcaaggagagagattcgaagaaggcagaactcctcacaaaggtcgcgggcacttagcctccgtgcaaccttgcgaaggaggatgagcctggactcgagtgtgcggtcgacctccacacttggcttagcgacgatggaaacaagtagccgtcgaaagcgaagccagttcgccttgtcgtcctcagtagggtacgggttggcaacgtagaaccacttctgcattcagctgcggtcccatttcaccatcaacgcaggcaccggccatgcatccgaacgctccggccgaagcataaagttgacacagctgaagaccgttttccttgaactggccggtatgtttacgtctttggtcatagcgcatgccgtgaacaagatggcgaacagctcggcggtaggagcgaacccgcatgttcggcacatccatgtgaagacggccagcttagggaacgccgagggactgagctggggtagcttgagctcgtacatctccagcacgggcggaagaaaattgtcgcatggaaggcgaagccctgcggtgaggaaggcggcgaaaacaatcgttcgcctatcaccaggcgaagggacaacggcctcgcccccgcacgttgcctggccccttgcaagggcgccggagtggacgaactcagccaggtcggattccttgacaagtgacttgccaaggtaacacgaccaaccttcgccgaggcccccggggtctttgccagttgacccggctttggtgggtttgcaaggagccattaagtccgtgtcgaaaggaggggtcgaaaagcgaaagggagtgagaatgtccaaggagcaagtgcgaaagcaaaaggcagagagcgcagagatggggcagcggtaaaaatggaaagtggagggggagaagcggtaaccagcggcagggttatataaccccgtcacgcgacgtttcgtctaccaaccaatcagagcccgacacgtgtccggtggtagacgaaacgataaattcccatcgggccgaggccaaacagtgaaaagccgaaagcagaaacagcaaagcccatggagcccatcactgttcaataacagcatgacgggcaatctaaccccttcgccacccatttgcgaacatagtaaggaaatttccttcaaaatttttcgttaacacaagagcaaactttttactatcgcaggtgcgtagcataggtttcagcatgaacatcggccgaaaggagcgcctcgcggtataccacatgacttgcacggtctcggccgaagcttcctactcaccctttcccgtgaggggcttgttggaggtataccacaaagggccttcggccagacctgtcgaaaccacccgctcgggcgataaggctcagtccgaaagcaaagggccaaggccgaagaggaaaccgtattggcgaaggctgtggcttgggttaacgtgggcttcgccaggcaaagaccttgtcgaagggttccgcgggcgaagatggtgaggcgaaagccttagcacggagacacgggcttcgccgagcgccgaaccctaccgcgaggaggcccaacgggccgttacactctcgaggaggattcgacgaacgaatgggccaagccatctaagcccaataagggcccaatacatgtaaaggacactgggtagccatataaattcccctgtaaaatctaaaccctaaaggaaggaacctgtaatagagctataaatagcccccttaggccttgtaatggggggatccaaaaatttttacaaagcaatacaattgtctttatttccaaccactgttgagaaaaccacgcctttcggcgtgacgtagttgtccattcgacaacatatatcatcattcacatgttgttccttttttattgtgatgtggctatcttttgtgtatatgattcctctttcaaacactatatgaaattattatttaaaaaacttgaaagaaaaatttgaaatatacacacaaacttctatattttgtaagaaggctaagtacacaaaaactttcatattttttcaaaacttctagtgggttaaacaattgtcaactcttggataactcgaagggcattctaggcatttcagaaaagtatccaccacaatagcatactgtaacactactacaggattgatttttctggacaccaccccattttgtttctatgcagtccgtaagttagaccgcacggaaaaatgaggggagcgaagctgggtcatcgcccgcacacaaaaattaattttcgtgtgcgggtcacttaacaggtccgcacgcgaaaataaccctattttcacgtgcgggcctcctaatccacccgcacaggaaaatagacttctctcccatcatattaaaagaaaattaacttccttctctctctccccccaggcccccttctctcctctctctctcttttatcttctcaccttccttctcctcctctcattttcctctctctctcaccttcttctcaccatatggccgacgcctccttctccacacagcgggctcgacggcggctggcgggagaggcgggcaggagcggcgtgcgtgcggcaacgagctcgtggcagcgggctcgcggcgagcggacgtgaggaggcggcggcgggcgcaggcggcggcgacgatgggcggccgcggctcctcccctccctctcccctcccatcccctccccggcagccgcgggagtgcacgggcggcggatccggcatcagcgacggtagccggcggcggatccgtcgccggcgaccgcgggggcgacggcggcaggcctcggctagggtggcggtgccggcggcggtggcgactggattagggttagggtttgttttttcttttttttttgtttcgatttttcattttcccgtgcgggcggcttaagcgccgcacgcgactttcgcgtgcgggtgcgtcgcccgcacgaaaaaatcacgatttttgcagacgataccttccagacagtcgaaacctgcgcacgcaaaaattgaattcatccgcacgggaaaatgcttattgtagtagtgtaaagtcagtgccatattatagagggagataaagttgatgacaaattgttaaagtaggataaattcagtggcatataatagattctttctctgtgtatttgtcattgccttcttactgtagcataccttgtgcagcttcaagcacaactcttatgcgtgttgcccaattcatggttccacccatgctagttttgccttcatacattacttatacgcaattagaaggtgggggagggaggggaagagggggggggtgttatttgacaagtcaaaacagtattattcctttaacaaaaggatagaatcaatgtaatgatttattagatagatacaaccatgtcttgatattactatgtctgcacaatcagtcgagatagaccatcaataatgcaaaaacaattattttgtatacaattttaaacatccacgcaatttattattgtgttgtcttaatgagatgtcttgataatgagatgatgaacaattatgacaaaaaaatggtactgcaagattaacatattccatacgtgagggcagaattaagggtagttttttgttttctatcgtactaaataattggcactattagaaccatggaaagtttgggtactactaattttttttttagggtagagttgcatggatcatctttggttagaaccaatttagagtcaaatttgattggtacatgtagagttaccatattaatttaggcattgctaatagtttagctttaatgcgaactactcacatctactattcaaaaaaccaattgattggtagggcacattttagtatccaaaaattgctctaaatatattatgatatctttagtgagtttaagcgatggccatgaagccccttaggtagagactaactatgctctctccatccccgaaaaaaaaaaaaaaaaaaaaaaactatgctctctccagtcttttttttcctcaaaaagtctaactatgctctctccaggtaagcagtactacttgtcatagttctgcaaactgttgtgcaacatgagtcaactagtttgtctgcgggcacacgcggagtatttaagttgtaaagaaggaaagatgactatagccaactagtttgtctgcgtaatgtatatgtccaatatcctccctcagcactactacagatccggacttcagtgacgggtcatctgtgacaggccaacgcaactcgtcaaagatgagtcatctctgacgggccgaaaaaatatcctcttcaatatatggctaccagggaggacccgtcacagatgtgaggtcatctgtgacggcttgcacttgtaacccgtcacagatcgtctgtgacggtcacaaccatggctcatcacagatgacatgtcatctgtgacgggtgtagtattatgaaccatcacaaaagagaccactcaactctgacgggtctttaactaacacacgtcacagataacgttatctctgacaggtggtagttatgacccgtcagtgatgagtgaaaattcaaattttaaaattttgcaaaaaacctcagattgagacatgtcttacataaaagttgtagctctcaatgatatccacaactttataactaacaacatttctattagagatcgtttacatccccgaacatgcattacaagttgatcagatctacttttaaaaacaaaattttgagtttttttcaaatgacatggatggatacatgccccgtatcaaagtcatagaactcaatcagatctacaacattataattgaaaatattttcatttcacaaagtttacatgttcaaaatacatgttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataacaacattgggtgagtagtcaatatgtgctgagtaggtgtattggtaagggagctctatatggaggttgaggtcttgagttcgaatctcacgtgtagcatgcaagttatattgtgtgaaaaattgtgaatttgtaggtagtgatgtataggatggctattaaaattcaaaatatttttttgaggtttttattgttgcgtttaaaattcaaaaattatatttcttgctttgtcatcagtgacgggtcgtaagttacaacccgtcagagatgagtcatcagtgacggtagttacgacacgtcactgatgactcatctgtgacgggtgacaagttttaacccgtcagagatgacttatataccggtcagagatgggttcacccgtcacaggtgattttgtcatcagtgaccactaatcagtgaccaagaccaaacccgtcaaaggtgagggtttgggcccgtcagagataacctggtccggcgtagtgcagatttcccaaatattcaatacttaaagattgcaatggacaaacctctcagataatcactaagattgccactagacatgtactcgtagacaagcgctaaatgatccttctcccagcagtaaccaatcaaagaaacaagattcctgtgattcaccttggtcaagctctgaacctatgtaatgtgataaaacaaatggtcaaatctcttgatgggtacgaaacctcacagtggatgtgactaaggctgtgttcgtttgtgtgagatagggtgagaaaacacctcgttttccgcgcgcacgcttcccaaactactaaacgatgtgttttttgcaaaaattttctataggaaagttgctttaaaaaatcatattaatctatttttgaaatttaaaatagtttatactcaattaatcatgcgctaatggctcatctcgttttacgtatcttcccaatcttctcaatcccctgtctctcaaactcaccctaagtttacatgcacatatatgccattctaaatattgaatattttttactgaaaaactgtaaatattgattttatttgtggttaaacataatactaactatatttggcacctcagctaagaactcatcaagcccgtgggacgatgattcggttcgcatcttgacagcaacctcagtactgtcttctaaacagctgtaatagacatttccaaaccctccatgtccaattaaacgtttgaagctatcagtgaacttcgctagttcctcatatgtgaatcgatgattcttaggtttttgtagatggtcccaatgatttatccaatgtctgggaggacctatctgttctggtaccatgggagaatcatctgtagaaactggtgcagaaagaacagatttagcagtattaaaatgcagatattaaacaatgtgtttttcaatgcagattatagtagtacacacaatggggctttcttttggctctccagatcaaatatgctacaacaagcatggcgactacaagcactggagccactacataaacagctaaggtagctgctctttttcttgatgaggacgaagttattggttttttgcacatatcttcgtcagactcgtagctgaaattacataaaacaatcagtccatggttttaaattggtatgctcgtcaaattgtgaaattattgtcatgattaatatttgtgataaacaattggctgtgtaaatgatttaatcaatgaattggtttaaaaagatgtgtggatgttggtgtgagtgcgtgtgactaatgtgggtcatgttgtgatatctgtgcccagaaacggttgttttgtctgattgtgtgcaggtgacttgaggtcaaccttggtcaatggtgaggactgggactatgctcagggaggagcagaggtctagtgcggtcgggataccatgtgagaaggtgactagagtcaggattcttggaggtcaacttcggtcaacggtggggatcagacggtcaaggataccggatgacgaagttggatacgagatggcatacggtggatggacaccgtgtgggagagatcttcacaacgggcttcacgaggtgtgcgtgcaaccgtcggtgttcatgaaggataaaagatgtgctacagtacgtggaggtactgtagcgtgcagtacgtacatgtatgtgtatgcgtactgtgtgggctagcatgtacatgtggctgtacatgtgcagctagtaggttggcatgcgtgtgtgtttgtgcgttctgtgcaatagcagcatgcagcggctcggttggatggagatcgagtcggccgaggaggcagtccgaactggagacgatttgcttgcgttggatggagtccgctgagatcaggattccggtttagatgagtttggagattgtaatttggataaagtcctagtggaactaggagttatgctcctaatttgagtaggaagttttcggtataaatagagggagagggtgtggccctcctgtatcagttttaggaagccaagtttgagatattagatagggttttgtgagaaacttttgaggggttctctggctgcaccttgtgaacaatatactttagcaataaagatcatattcaatcgtcaaggcatcgacgatctattccggtttcgtaagttttacgtttatgtttggttttggtattaacttgtgattgttcgtgttgctgtgattttgttcaagttaattcatccaaaacctttctaatacttcatagatcacatctggaaagtttcgttgattggttctggttagatttgaatttgcttaacttttaggttttgttcagatttgctgcaattctgatacatctaactttcgagggtgttttctcttaaaccgtttattaatttgcaaatccctccagtaaagttgttccttagtttgtctagtttattctgtcaagttttcaactcgatccaacggttggtttaagagaaatcgtgtttttaccgaagcgctgtcgtgctgttttcaggctgacggtcagaccgcgagaggacctgcggttagaccggttagagttcggtcagaccgatcctagtaggtcggatagaccgccaaacgtgtgttccattggcttttgaggtttgtcgaaacaagatttcggcaatactaaaagggggtggctatcaagctagaaaagtggatgggtttgaagacaaaggatttatacaggttcaggccttcttattcaaggagtaataccctactcctgtccggggatgaatccgccgagtgtattattggatgtataatctccagaaaagttgatgtcccaggaaggactcggacccctccttatataggggaaggagtccgtattacaaggtataactcatatccttatcagaatatgagagtacagataaaatacaatcgtaaccgactaagtctcagggtatttccttgacgtacaagttaagaaacaaacccgagatacagataaagatattctatctatattcggtatcctatatccagtctaaatataatcgccgtgtagatatggggtatccataatctccacagtagcccccgagacctttgcagtcaacaatcatagctttctcaaaaataataatccgagtgctttaatttcttcctgctaaggcctgccgagtagcgaagacaaagactgtaatgggcgaaaagataaaaaacattgtgcatcgaatagatgcacctaattaggtgtagcccccgactatatgattagttaacaaacgaaacatgtagtcgagaacaaaattatagcataatcatgtatcatatgacaaaagcatatgcggcgcccaacaaggcatttagccgactgctttccagccatagtaaaaagaatctgagtgaataacactctaaaaagttcacaaatgaacacatttgacaggcacccgagtagaaaactctaaagataacccatcaaatattataaaaattatggtaattaataagtctaatagcctaggctatgactcttcaccataattaaaataggcatataacacgccaagagaatgaccattgtaaaaacaagtcatcccaaattaacccagacagcttttgcagcctaaaaaagcttacaaaaatagtataacacttttctgtcgggtaccttttaatttgcattgcaataattccaaagaattatataaccgcattaaaaaggattttatcagcattgagccacaccattgtgagcataaattgccaaagcaaaaatgcctaagtccctaaggagcacaacgggccacgctgttaataatattgggctgaagtactgttcaggcctaggcccattagcacccccgaaacccttaacagaaaatcccgaaatctaagctgcgcttcgtcttccccaccgggactctcgccattttccccattccttgctatagtatagaactgcgccggcgaaactagggttcaccattctgctccaatccaccttcaaaaagttcaccaaaatcctccccgcgactcaccgcttcaattccacatctctccccagccatccctcgaatcagatcagctcattcggatcaaatcgatggcggaagaaaaagaaagctttgaaggccaatgggcgtcgtccgacgtgacagaggaaaacttgaaggagatggtggcgcacggcgttctcccagccaaggagatcatcggatggcggccagcatgtggtgaagctttcccaacccccgatacacatgaggtcgtggttttttctcactttttctatggcggatttgctcttccaacctcaaagttcttccgtgggatattgaacttctatggaatcagtttacatcatttgaatccaaactccatagtccatattgcaaatttcgtccatgtctgcgaagcttttttgggcattaggcctcattttgctctgttccgccgaatcttcttccttaagccccaaccgaacaaaaacaaaccatgcgtagttggaggggctggatttcaactgagagggaccttgagccaaaagtatttttctatgcccttcaagacttcaaacaaaggatggcacgccaactggttttatattcaaaatcccgagcccgctcttcccgagtactcctgtcttcccccagtataccaagatacctggaactctcttcccatgggagatgaagctgcccaagccttagaactgatggaacgcatgttgaagctcaaagagcaaggcttacagggagagcaaatcactcgacatttcattaagtgccgattagctccaatcaaagagagatctcgcacagcattcgagtttgacggcaagcatgatccaaaccgtgaagacccagattctctggactttaagatcatgaaggagaggatgtacaagatattctcaaacgccattgtcgtcagttattcgcatctgctgccagtcgtgccatacaatgcattcaatccacctccgctggtatgtatcagaactcttcaaaccgtgatcaaaacataattttgtcttcttgttgaattaactgaccgtggaggcatttcattcaggaatttgctttgataaagtctgaccccccaatcgctcaacgccgatctcctcgtcatcagaccggtcaggggagtggaggaccaaaaatcaggtcagactcccaatcccaaactcccaatccgactgggcagacagattctcacaagagaaagcttatgctgaacgacgacgaaggcgacgacaataataaatttggggataagggatcacccaaaaaattaccaaagcacactgctccgaagaagaaactgtctagccgccccatgccaaagtttagaaaatcctccaggtataaaccatccggtaccgtttcacttcaacatgcttctctcatgaagataatattgaaaactggaaggaaactttgcaagaaaccgtccgacatagatccatccgggaaggattctgatccggctaacacagaaacaggttcatccaaagaagctgggccgactactgaggaccagccgactagcgcccagacttcagctgataacgtcaatccaagcgaccagcccccgactggaaaccagtcggcagaagcagaaaccgcaaaaaaccaagagcccccgactggcaatcagtcggaagtaggtccagatcaagaaattcctgaagttgaagttcaggctacaacttcccaaggaccggacgctggtaacgacccaacgcttgggtctccagataaagggcaaggatcacctcacgctcaaccggaaatcacctcaggtaacccatcttctcaagtaatgctaatctgaataactccgattcacttgtctaatgtctgggaatacatcaggaccactaggcggtgacggagaggaaatccctcgcataaaggcagctgctgactctcgtccccctatcttaatcaaatggtgggacgagaactcgcaacctgcaggcattgtcataaaccgacagaaagaagacgaggaggtgtgccagctgaagaaagcactcggagaagctacccgtattgtaaatgtaagtcttccaggtggctgcccttggtgaccttgttttttctcagcaagactaaaccgtgaatcatcgcgcagagaatccatctccgtaatgaggccaaaaccacaactttagaaaagctggttcctcatttagggacccttgaagcagttagggatcagctacacgaagccaaagagcttgccaaaaagacagagcatgatctaagggaccggattacccaactccaggattcgaactttgaactgagtggctcatcaaaaggtaacctcaagatctgccccattaatttgtgctgttataattgtatcctcaaccgtctggaatccaaacagtgcaagctgccaagatagctcaactggagaaacgaattgaggccttagaaaataacaaggcagaattggctgcacaaagggactcggctttgaaggaggttgaaggtattgtcagccaacaacctaagtttctctctttgatgcagcagatcattgacataaatttgtttttgtagaccgcaagatcaagtcccaagcccagttcgacgtcctggttggcaagatcaaaagacttgaaggagccagggacgaggtcgccaatgccgctaccccacttgtccaggcgatgttctataataacaatggcccgagtagacttgatgcttccgaagtgtttgacaagctgagaatcgctccggacacctatttcaagaacattagagaagccggaagcatgggagtaggcttagcattagcaatgaccaaatccctgtaccctaagatcgatattttgatggttttgcggacgggacaagcgaagaggctgcccttgatcttatcaacgacgctcaaaaagcagccgacaagattgctggtgacgtcgtagatcggtttcaggataccgaccttcggccgactagtaacaataactctgatgatgagaagactgatactgattaaatgtaaatgcatcgaatgacgaatgatgaggctcaatttgtacaataccggtatatttatgctgtgcttggtgtttctggcttagctgttgatttcttaaaagcctttatcaagctttgttgagcctaaaacccgcaaaagctattaaaaactttcagtcctcgtaaactaagtagaaaaatcaaacaaggcaatgatagaccaagtaagcaaactaaattgataaaaaatcacactccattattattatggtagcccccgactgacaacctcaagaagtaagcttgatgttgacagtcaagatagggagatacatggataaacttaagcgtagaaacgacgaagatgttcgatattccaagaattgtcaatgagtgtaccatcttcgcgcttgagtcgataggaacctggccgggtgacttcagagatgataaatggcccttcccataaaggagataacttgtgctgatctcgtgtagtttgaattttcctcaaaaccaggtcgccgactaggaaagcacgggatcgaacattgcgattatgataacgtcgcaacccttgtaaatatcgggccgactgaattaaagctgcttcgcggacttcttccaatcggtgcagatcatccactcggtcctcttcgtagcgttcttcgcgaaaattgcgaaagcgcaaagattcgaattcaacttcactaggcaacattgcttctgccccgtagacaaggaaaaaaggtgactggcctgtggcccgactgggtgtagtacacaaggaccaaagtactgatggcagctgttccacccattttccagcatagggttttagccggtcaaaaactcgcgcttttatcccttgaagtatcatgccgttggctcgttcgacctgtccattgctcatgggatgcgctactgaggcatagcaaattttaattccgaagtcttcgcaaaagtctttaaaaactccgccagtgaattgtgtgccattatcggtgataatccgattaggcactccaaacctatgcacaatgttgatgaagaaatcttgagctttatctgctgtgattgtgacaaccggtttagcttcaatccacttggagaatttgtcaatggccacaaagagatgcgtgtaaccgccgactgcctttttgaacgggccaaccatgtcgagcccccaaaccgcaaacggccaagacagtgggattgtttgcaactcttgagctggtaaatggatttgtctggcgaaaaattggcaaccttcgcacgtgcgcacaattttgtcggcgtcggacactgcagtaggccagaaaaaactctgccggtaagctttgccgacaatggtgcgtgcggcggcatggtttccacatattccagaatgtatgtctttcaacaattgtctcccttcctctagagatacgcagcgttgcagaattcctgaagggcttttcttgtatagctcggcttcatgaataacataaagcctgcttcgccttgaaatccgctcggcttcatctttatcttgggggagttcttgagaagtcaaaaatcgtatgaggggctctctccagtcggcttcaatcatagctatgttatgagtgtccgcaacttgagctgtttctttctgaggtacggtcggctcataaaggtgttcaacgaatacatcagaaggcgccacctcgcgcttggatccaaagttggcaagtctttcggcggcttcattgttgtgtcggagaacgtgactaagctcaagtccgtcgaacttgtcttccaatttgcgtacctcttgtcgatatgccgtcatgttgtcgtcaaggcaggaccactctttcataacttggttgacgaccagctgtgaatcgcctcgaactattagacgctttatccctagggagattgcgatccgtagtccatggaggagcgcctcatactcggcgacgttgtgggatgcggaaaaatgtatccaaagcacataacttaatctttctccagctggggaaattaaaaccactcccgctccagtgcccgaaagcctttttgatccgtcaaaatgcatggtccagtgctccatcttttctgcgggggtatcctcctggcactcggtccattcggcgacgaagtcggctaatgcttgagacttgattgaagttcggggcttgaaggatatgtccaaagacatcaactccaaagcccatttagcaatccgtccgtttgcttcgcggttgtgcagtatatcgccgagcggaaacgatgtgaccaccgttaccgagtgaccttggaagtagtgagataatttcctggtagtaatcagaataccatataacagcttctgaacctgaggatatctcgatttggagtcggctaggacctcgctgacaaagcaaatcggtcgctggactttctggacgtggccttcttcctcacgctcaacgaccaagactgtgctcacaacctgggaggtggctgatacatatagtaacaacggctcctgcgggtgtggtgaggccaaaactggtggctcggtgaggagtttcttgaaatcttcgaaggccttctgtgcctcgggtccccactggaaatcgtctgttttctttaatagcttgaagaagggcatcccccgctcgccaagtcgtgaaacgaatcggctgagcgccgccatgcatccagtcagcttctggacgtctttctgggagcttggcggtttcatgttgaggatagcagtaactttctccgggttggcttgtatgcctctatgagacaccataaaaccaagcaggttccctgacggtactccgaaggtgcatttttcagggtttagtttcatcctgaaagcgcggatgcttgcaaaggtttcttctagatccgagattaaatcatccttctgcttagtcttgacgactacatcatccacgtacgcttcgacattgcggctaatttgcatcgagaagcatctctgaatcatacgttgataagttgctcctgcattttttagtccgaatggcatggtgatgtagcaataggccccgaagggtgtgatgaatgaagtcttcaagcagtcggattccttcagtcggatctgatgataccctgaatagcaatccaaaaaactgagtagctcacagccggcggtcgagtcgactacctggtcaatgcgaggcaacccaaaaggatctttatggcaagacttattgaggtcggtataatcgacacacatgcgccattgcccagttttcttccgaactagaaccgggttagccagccagtcgggatgaaggacttctttgatgaagcctgctgctaacagcttggttaattactccttgatcgcgtccttcctgtcttgtgcgaagcggcggagtcgttgtttaataggcttagcgtcttctttgacatgtaaggagtgctcaatcacctctctaggaataccaggcatatcaaatggtttccacgcaaagatatctttattattttgaagaaaggtgacgagtgcgctttcctatttacaatctaactcggcgcctattacagcagttttagtgggatcagaaggatctaggggaatctttttagtcttggcttcgctttctccgctctttaagatcttggtcgcgggcacttctccttcgcttgccgtggttgcagccagtcggatatcttctcgggcagacgccatctcgcgagtctgggccatctcgcaactttccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcgtggtacgctgtctcgaaatcggcgacttcgaagcagatattctccgtgcggaagttttcccgagtgccaaaggtgaccagaagggtgatctggccgagtggagttgcagataaccctggaatgactccgtgaaaaggcgcattgcttggttttaactcggagcgaggaatctgcatgtcatccaaggttttggcgaagaggatatttagtgcgctgccaccgtcgatgagggttctgcgaagcttgacattacggaccactgggtctagtaccagggggtaccgccccgggtggaccactcggtcgggatgatccgagcggtcaaacttgattgctgtctctgaccatcgaagatattggggtgtgtcgggctgaacggcgttaatctcccgttcggtcaacttttgctttcttttagattcataagccaaggggccgccgaagatgtggttaagctccttgcggtggtcttgaaaacctgccggggggtcgccatcgtccttcttcttcgacgtgctttgttcttcgtcggagttcttccgtgtagtcttggtgtattgttccgcgaactgtttgtagacgaaacaatctttggccgcgtggttggagttaggatgatgcgggcattgggagttcatgatcttgtcgaatgtgttgacgcgcgaacgctgtcgagaagagtgagtagcagttgcaacaagttcctcaggcttacgcttgcggtccttatgattgttacttccaccccctcccgtagccggcgtatccttttttggcttccaactggagcccgactgctttgatgcgatgacggcgtcttcagccttggcgtactcgttggctttttcaaacataagtttgactgttttgggaggcttacgcccgaacttgccgaccaattcttcgtggcgaattcctttggtgaatgcggcgatgataacatcgtcggtgatgttagagttcttgttgcgttgttcagaaaatcaccggatgtaatctcgaagagattctccggacttctgaataacgttgtagaggtcgaattgtgtgctggggcgctcgaaggtgccttggaagttggcgatgaagtggttgcgtaattcggcccaagatccgattgtaccacggggcaatccatggagccaggaccgggcggaatctgctaaagccactggtaaatagttcgccatggccttgctatctcctcctgctgcgcggatcgcgagaccgtagacggtaagccatgattccgggttggtggtaccgtcatacttctctattctagtcggcttaaagccggctggccaatccactcgacgcaggtcgttggtgaaagcggctactccgtcaaggtcgttgtcgtggcgatccgccgaatgatgatggcctcgagctgcccggcgttgtatgatcgtctcgcgaagatcgacggggcgacgacgaggtggcgaacgaggtcgttccactcggcgctccctatgatggtcgggaggcgagtggacagatcgctcgtcgtgacccctgctcctgcgattagatcccgcgccagcgatgctgaggcttggctggtggtagtcgtgagatcgaagatgagggactcggctgccgctcggcgtgcggacgcttccggagttaactgggaccgaagccgcaatcatggtctttgtctggttcaagatgttgacgacgtggtcagattgattgagctcgttttccttgaggagggtgtcgaggagggtgatcgcggcaacagcattctgttgtggggtgcggaaaactggtgtcccctcaacgtcttgttggccgataagatctcgcgctcggtgccctgtttccaaggctcgtagccgccggtcttcagcctcctttgcagcccgctcacgctcctgttgctcacgccgtagccgttcttgttcttgtacttgacgctcctcctccagtcggcatcgctcggactcgcgtcgtgcttcggtttcccgggcttggcgttgctcctccgtctcgttatcggccataaagacgccgaaatagagaggggtgtagttgtcttctaggctttcatcgaagtcgtcgagatccgggtcgttgttgcgaaagccgaactcattgtactccacgatctcggtcggacgcgagtcgacggcgggagagctccagtagccatccagctggtccgtcgaaactgagccgagtggctggtggatgacgccgacttccctggagctaggcgagatcggtgttgaagccgatttccgcctaggcctacgggatggggacgctgtggtggtgaagacggccgccaaatcgtcggggagcttcattaggatcggtgggtaagccccatcatctcgatctgatgacgttggagaagatgcaatctcgcccgagtggtttgaagccgactcgattgagatggacttggagtagatttcagccgcgtttggaactccaaacgggactgagatccggctctctcccgactggtccgattccgagtcgaggagagagatcttgccgaagttattggtgacgaagtcgaggctgccgaaccgaaacgcctgcccgggttggaagacgaggtcgtcgatgccggagacggaacccattgcactgatcggtgaaaagcttgacgcaacccctacctggcgcgccaactgtcgaaacaagatttcggcaatactaaaagggggtggctatcaagctagaaaagtggatgggtttggagacaaaggatttatacaggttcaggccttcttattcaaggagtaataccctactcctgtccggggatgaatccgccgagtgtattattggatgtataatctccagaaaagttgatgtcccaggaaggactcggacccctccttatataggggaaggagtccgtattacaaggtataactcatatccttatcagaatatgagagtacagataaaatacaatcgtaaccgactaagtctcagggtatttccttgacgtacaagttaagaaacaaacccgagatacagataaagatattctatctatattcggtatcctatatccagtctaaatataatcgccgtgtagatatgtggtatccataatctccacaaggttggggtgtgttttattctatttagattcgattatttgacttccgctgacgtaatctaccattcacccccctctggttggcttggttacttgaattcgatcctacgcaaattaaaaccgacacgaaaattaaagcacatcaatggtgggaattagaaaggggcaattttgtccttagaaaaatctgagcccgtattcatgttggtcccattgatcgagcgatggattcacggtgcaggcggcagttcgctcgcgctgccatggccgcgatctcccgtgagcagcggccgccaagcttcatccaccaaggcaacgagcaaaaccgccgcctcttcctctaccaggctccttccgcctctctgctgctacccctcacgctcccaactagctatggagcagcttcacgaccacattgagcagatcatcccacatgatcacaaccataagaggttgtcttccttgtaaacatttttcgaacgattcttccttctaaacatcaatcaactgcaactctgcaagcaaatatcaaccctcaaggacaatcgaactcctgaccacctcgaccggcctttccctaaataagcaatgtgggactattcccaacagccaaacagggcgttcgtcccagcgcatggccccgatgacggcagctggcatccctactcaccggagctttgctgccaccccgaacgcagaggcgcttggcagcctgcaaggagcatgatgggtggcagcggagagatggaatcgtagcgaattaaccgccgcgagtcggtcgctcgatcgatatggataggggctcagtttttctaagtataaaattgccccctcgctaatgggaggattactctgttaatccacttttaatctccaccattgatgtgctttaatttccatgcaagtttttatttgagaagcatagtatcacttcccttccctactttcttttaggatgtccaaagattacaggaagaacaaccccacaatctggaaaatactaaaagggaaatcaataataatgaaagtaggcacacctgaaaacaatcgatccattgcttttgcggaggtagtctggaattgtcccggttagttggttgcatgacaagtttctgtataaagtgggatacaatctggcattaaacaatagacatcctgacttggtaacaatctgcaaacaaatttatccactaaaaatttttatatgaagggccggcaaacatggtaatgtatcaggaatcatgcttcgaaccactttaattacggaataattaactatttgccactcttatgagtagttctaaagaatttcccactgaacggccatatgtcataaacacatgagggcccacatgtcatagacagcgagtggcaaatcattaacactactggagaaccccatatctctcccggttagcaaccccctctactcccgggtagcgaaccgggagaaagaatccgggactaaagatgccagtctttagtcccggttcaaatacccgggagtaaagactcatctttagtcccggtcggtgccgaccggcactaaagatggcagagccacgtcccggttgatccccttttctttttttttattttcattgctcctttgctacttgccagggttaatccttgtatttcctcccaaatcaattggctgcatatcccaaatcaaaccccaaatccccaaatcaatgtaacaccccaaatcccaaatcattcacatcacaaagcctaagttacttatacaaacacatcaactacatcacaaatccttaaaaaaattacacaccaaataaatacaccacagattatacatcctcagatccatgcaatg

SEQ ID NO: 19526 - DNA, 18691 bp, Oryza sativa
  unsure (1)..(18691): unsure at all n locations
gcgcaggccgctggcagtcgccgatcgccgcttgtccgccgctggatgggaggggaagagggggaggagaggggagaggaggataatgaaggggaggaggggagagaaggagaggggagtgtaagaggaagagataagatcggatctgagggaaggagaagaggagatgttccgatcttatctaaatatttcgtctgggacttaactgattaaagatgggagaaaatatttactcccggttggtagtaccaaccaggactaaagatctaaatgatctttagttccggttgatagtaccaaccgggactaaagttgttatctttagtcccggttagttgtatcaaccgggactaaatatcctcggccccctggcaggcttttgacagggggatgaaccaggattaaagatcatctttagtacaccaaccgggactaaagatcaaaaattatttaaccgggactaaagattatctttagtcccggttctttttggaaccgggactattgtggaaatcgcccgaccctccaaagatcatttctccagtagtgtaattggcacatcttaaaagtgacaaataattaaatgtcccctttaattactgcctgatatatttcaaatctatacttctccgcagagggtgatacaatataagtggcaaaagcgtgatgattgttggcttagtgccaatcggacatgaaagaatttgctcgaattttttttttaaaaaaaaacagtaaacaggtatactccatcatgcaagtggaaatctcacataaaagaattcgtttatggcaaaaatgagatgtgtaaaaggagaattcttttaaacttcagtgcttcattttacttcaattcaattgtaaaaggagatgtgtcgataagtatgctgcagcagaaggtacattttcccttttgtgaggtgccataaatttctggtgtatgttgaaggacaaaaattataaatacactattgtgctctccagtgccaccctcttaggtaggtaaaaggaatttatacatgattttatgcaacagacaatggaagtatggtcacgcgcttctcattaggaatttttattatttttttgaacatttaaaattttaaatttaaaaataaaccatctcgatacttatttctaaatctgaaccttcttacccattgcgcctcgcctcgcttggcgaaacaatagtcacaccacccgcacttgcgcgtggcaaaaaaggaacatatttgaaaaactaaaaactaaaaggttcaaaaaatttaaaaaaaatctctgattggtcatatattatattttttatgttggatttcatatttcttacgagcacagagcttttcaacatgattagtccaattccctgttatactaccttggagttgtacgcttgtgtcatgctcaaacagctagattgttcaactcatccaattttcagatgatcttaacgattgattgttgcagggtagtggcatacaaagaacaaacaataattttgtttctaaaatagctcaaaagaatacttagtgcaattttatcagggtgaatatatatgttgggatcatgagctcccagtctcaaattccctcgccgcaccaactgtgccccttttcaatcaccggttcttaaaaatatatgtttgtgtgttttgggtgacacagcaggaaaatgcaatattttttttagtgtttttatatgtcaaaaacgtgtgcatgtagcaggctaaggatgaagcctgccgaaacacgagcacagcaatccccgtaagcaccggcaacttcgacaactgagccggccacctcttgcgtccactcagaaaagtcgaaagctgtcccgtcatctcccggggcgccctccgtgcgcgtgccgagatcgttgagggccagcctgagcgtgtaacaggcttgcttggcagattccgtcgccggcgccaggccgaaacgaggtgggcctcaagagacctgatcctctcttcggccgcagcaagctaacgatcatgctcggtgccccgcctgttcgccgactccagtttggcacagagggacttcttctcccccatcagggacttgttctccgcatttgccttcctcatggtgtccgccacgacgcgcctcttgtcctccttgtggcgaaggtcgtccttggccttccggagccgaagccgataaccatccagcctttcaaaggaagacttcttcgcactcaggtgcgcggcaagaccctagaaaagggagactgaaaccattacggcgtgacataagagagaagagaaaatttcgcacaaaaaataacacaaacaaacatacccgaacggacaagctctccacagctgcacagctttcgccgaactcgttcatctcggtgaagagaccaaggccttcggagggcgcgataacttggcacaccccatccacaaaaggggcgatctccggccgagtggcgaaatcggcgggaacgaagtacggggcggtaagcgtcacgtctgacatagtcgcttcgaccgccgaagccttcccttcccactggcgagctggcgaaggaatcgcttcaacccgttcgtcctgagagacgttcgccccggccgccggcgccgaagcactcccgcctgttgccgcttcggcgtcactagcaggtggaggtgacgtgcgcctcccccgagaaggagcgcgctgcagaaccagcgaagtcggtgtcccgtcagacccgtcgctgtccaaaaaggcacaaccaatctgtacgaccttccccttcttcttcttccctcgggcgactgatcccggcttcgccgcagtactagagatcgccagaagggtgttcgccacagcaacgtcttgctggcgaatgggtgaaacatgagagcccgccccagatttcactggggtcggactaggagtataaccgcgggagccatcgtcctcagacccggcctccctgtcgtcttcctcctcctcaccaccgctttcggccgtgtccttcgtggcacgatgagatcgcacttggccacccttcgcgaccgcctgcttacgctttctcgacgttccgacgtcgtcgtcaccagccttggcggggatcgatcgacctggtagttcgccaaagtgaactcggttcaccggccgtcgagctgacgcgaaagcaggcgggcaaattcggccgaggtaaggcccccaaccatcttcgacgcctccacttcagcctctccaagtgtgcgaactggacaaaaaaaaaccggaatgagtcgaaagatgtccacatgcatacagagggcgctgataaacacgaggaacttacgcttgactccaggaggaaaagcgaggcggggaagcccgagcacctcttcgtcctcactaacggacaccccccattcgcgagcaaggggagagatccgaagcaggcagaactcctcgcagaggtcgcgggtacatagccgccgcgcaaccttgcaaaggagaataagccgagactcaagaacgctgtcgacctccacactcggcttagcagcgatcgaaacagcaacgcgttcgaacctaagctagttcgccttgctatcttcagcagaatatggattattgatataaaaccatttttgcatccagtttcgctcccatttcgccatcgaggcaggcacccgccaggcgtctgagcgctcagggcggagtatgaaatttacgcacccaaacaccgtcctcttcggaccggccggtgtgctcacgtccttcgtcgtcgtgcacgccataaacagaatggcgaacagctcagcagtgggatcgaacccacacattcgacacacccacgcaaaaacagctaacttcgggaacgccgatgggctgagctgggaaagcctgacctcgtacatctccagaacggatagcagaaagtggtcgcaagggaggcgaagaaggcggcgaagacgacagtctggccgtcaccggacgaagggacgacggctttgcccctacaggtcgcctgccctacacgagaacgccagaaaggacaagctcggctaaggcggcctccttgacaagtgatttgccaaggaagcacgaccacccttcgccaaggctgccagggtcttcgccagtcaacccagccttcgtaggcttgcgaggagccatcgagtctgtggcgaaaggaagggactggtcgaaaggcacgagagcgcgcaaaggcgaaggtatcaaatcctaagggcgcgagcgtgtagtagcagtgaaagtaaaaagcgaggggagaaaagcggtaacccggggcgggattatataatcccgtcccacgacggttcggcttccgcccaatcagggcacgacacgtgtccaggggcagacgaaacggtaaattcctatcgggctgggccgcacagtacaggccgaaatccaagaggagcataccggcccacgaagggccccttactgtcgcatttcgggccaaaatcaaggcaatgcagtctcgccctttccgaaagggcgaatgctaaagttttctaaccaaaccatgaaaacaccaagtgttcacgttttttctgcaggactctaagaagaggtttcggcaggtacgtcggccgaaacggggcgcctcataccataccacatggtttgcatggtctcggccgaagctccttactcacccttgcccgtgaggggcttgttggcggtatgtcatcaggccctttggccgggcctgccgaaacctaagaaccagcgaggattcgagccaaagatatcagagccaattgggcgaagccctatggcgaaggccatgggcggagatggcgaaggctgacaagccgcgttgggtccatgcgaagcaaaggcatcttgggcgaacggcatatagcgaagggcatatggcgaagccacgaggcctccatcaggacgggttcaggctgcttcggcctgacgggcccattcaccataagccgggcccaatctattggcccattagaagcccatgtatgcgaatgacactgtgtaccgatgtaaatgtccctttcataagggcaaccatgtaaattcccctgtaaaacctaaaccctaatagggggacctgtaacagggttataaatagacccctagggccatgtaaagcggggacccaagaaaaattctcaaagttaatacagtttattgctttccaacattgttgagcaaccacatccttcaacgtatgcagttgttgtttcgacaacaacggtactttcctaactgggaagtaccgaggctagatagtaacagccgttggtgcggatgcgaacaaccagataattctagtagcttttgcttttgttgaaagtgagaactatgaaagctggttgtggttcttgcaacatctaaagtggggagtggtgcaaaaacgcacatcgatatgcatcatccatgaccggaatgtcggtctgttaaaggcaatcaaagagctccaggaggatgctgatggtgcatactactggcctgacatgcacagctgttggtgcatgcggcacatgggagccaattttttcaagcaattcaacagtcggcggctgatgaacatgttcaagcggttgtgcaaggaaaatcagtctacaaagttcgatgagctttggaaacaacttttcgaggggacaaggacacacatctggtcaaagcagagcaacaacaacccgcatgatgtacatgtcccccaggccctggaactaatggatgatcttattccatcaaatggaaataagcgtaggtcgtcaaagaatatcaaatgttttacccattggattgagtgcgagccgaatgataaatgggcactcctgcatgacactaatggggctaggcatggcataatgaccactaatcttgcagaggcgtacaatgcggttcttcccaaattaaggcctttacctccaactgctattgttgaaggcattatgcacaggacaacgatgtggatgaggacgaggcaggccgcggcgttgtaacaaatgtctaacacacaaacacctttctgcaaaaaaatggcagagtacctccaagagaaggctaagaaggcaagatttcacacggtcattaccactgggaacgtcagacgaaaatgggaagtcacatgtcgcactaaagggggttttggatcttctactggggtcatgactcatgaagttactctagggcacgaatctgataacacatgttcgtgctcttgcaataagccgaagcttcttcataagccatgtagccatgtcctggccgcgtgcgctaaaattaagcttgattcaacatcatacttgtcgatgttctacctaaaggatagagtgttgaatgcatagagtgctgagatcctcgggtggaggtccctccaacacctagttgaaagtgggggtgataaaaggatctatgtgccagacttggatttgttgaaggctggtaagggtagaagacaaacacgatgcttaagaaatgatatggatgcatccgaagcgggagggcctgtgcggcgatgtgaggactatcttcagtacgagcaccgcactagagactgcaagaataacaaggagggcacatcttctagcatggaatctaggcaacaacgtgcaatgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgagtttataaaaagaaaaaccctaaaaagtctttttccccccccttcccctcttgggccggctcggcccacctccctccctctctctcctctcccccgcggcccaatcggcctcctccccgcgcgcgtgctgctgacgggcgggcccgcccgccaccctcgctgacgggtggggcccacctgtcatccctatcctcccgccgctcctgccgcctcgcccgtgccctagcgccgccgccgccgcgaatcccgccgcctcccgccgtccccgcgcgcaataaagagggggaaatcactccccgtgattccctccctctttccccccacttttccctctctctctccctcggattcgttcggatttactcccgcgaacttcgccggcgcatcaatggagcccgagatcgccgcgccgatttccttcccctccggccggcctctctcactcccaaccctatttaaacgctccccgtgcctccctcctccgtttccgccactcgccgctttctctccccgtcggaatcgagcccgcgccgtcgtcctctctctccgccgtcgcagccgagctccggttcgccgccgtcgtcgccccggacctcctcccgctttggcatcgcctccttcggcttcgccgcgttctcgtcgacctcgtccactcctccgtttcgcccgccgaccgccggagcaccgccgtcctcgtcgacccgagccgcgccgccgcctctttccgcttcggtcgccgttcccgtcgtcgccgtcgacccggggtgagccgaggaccgccatttcgtttcccccttccctcccctctctcgggcgccgctccgtcgcgccggaggtcgccgccggcgaccatcggggcgcgggcgcgccgcctcccgtcggccgtgccggcgaggccgcctttgggcgcgccccgcggctgccatgtggggcccggccgtcagccgcccgcgccctcgggtgcggctgacgcgtgggacccacggcgccggccagcgcaagccgcgtgcgctcggtccaccgtggaccgtgaggctgccgcgtgggccccactcccgtggacccggtccgcgcgttcctcccctcggctcacgcaataaatccgattttaaattaaaatttaaatgaagaaattcgcaaatatccatttaaagagcatataaatttcaaatggccataacttggccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagccgacgtttgggaaagcgagcaaggcaagtcacatcatccttgaacatattgaatcccagtttacaaaattatgttgatttaaattattgcattatcgctttatttaaattcccgcgttatcactgttttatttagccatgcctatttacctttgttatgaccttattattgttattgttattatttccttgttcaccctagaataaacaaaaccccaactagtggacactctactcctggtatcactagtatgattttaggtagatgctacgctgtttaattaggtaacattaaggtggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcatgtcttccgtccatatgccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaataactaaaatgtcgaatggttggcctgggttggcttgggacgagctgggacccagggtcgggttgccagttcggtctggatcatcgtaggccttgggttaaggcaggttcgtgagggttcacggccttgattaataatactgtgtagctctaggatcgtctttataaaatggctttgggcaactaagtgacttttaaatgttgttttctgcataacttaacccctatatcattaccccttgtacccccttgcattagtcgtgcatctgccggtgtggcttgctgagtactgtggttgtactcattcttgctcaatcttttcccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacatgcaaggaggaatagaaggggctctcaaggggctcacgatagggaggaaggaaacctactgtagttatcatctacactgtctggttatgtatgttcggtcatgatatatatgttgcattacgttgtagttcaataagtttgtaatatgtgtaatataagtatgtgtaatatttattttattctggtaatgttgtaatatttgattgtaaggtgttaccaagtttgtaacgtttttaaacctatttcgtaaggtgtgctcgagtttgtattcgtactctgagaaaattgtattccttttttttatgcattatgtactttttcgtatatgcacttgatgaaatttctaatttacctttcatgatgtacatgcagatatggaagaggagtggccttacccgttgcttagcaaagagatcgatgcacgacatcgtgcaaaaaagatatctgatggaaattcttgttctagtctagctgtcctgataccgcgtacagccggatggtgggtgattgatccacgatggaagccgaggtgcataaatggttaaagtttacaacataatgatatcgtactataacatatcctaatgtgacgcaggtcttcttacctaacataaatttcatcataggttgtcagctgcaggtcttcttaccttcgttcagatgacgcaggcaacgatgcattacgatgctagagaatctaaacaaaaacaaatgggggcacatagaaaacgacgacaaaatatcgacaagtccctacttatggcattggttgataggtggaggctagagacacatacattccatctaccgtgcggagaaatgatcataactttgtaggatgtgtctatgctcacggagttgcccatagccagccaggcaattgtacttccagacccttcggaagattggagagatgatattgtatcacgatatgcctgtattctgccacagtacgctaccggtgatacagacgatgatgaggataaaatatttttctctgaaaaataaactcatggccccacattgaagtggttgtcatagtttgaggtaattgaatatttttaattaaggcatattccattcacattcacatatctcacaacacattgtttttttaggtgcgatatatgcctgacaatgtccaggagtaccaactgacgttgtaccttgaggcttatctactttggctgtttggttgagtcatgttcaccggctcgcacgggaacactgtggacgccaggcttatcccccttgctcaccaaattgctgaaggtaatatagtgccatctgcacagtttagctggggatcagccgtccttgcagccacataccgtggattctgcgacgcttgtgttaagaccggacaaagggaggcgattttcacagggtgtccacttttggtcaagttgtggtcgtacgagcacttctcgttcggacatccatacatgagcgtggccgtggcccacaaggacgattacgctgacacagttgatgatcgtcctaccttcggtactcgctggtgctacggaccggtacgtatgcttgcattaaaggaatatttctgtcaattcaatgatactgcataactaaatctgcaatctccgatcgtgcagccacagtgggcgagaatccaggtgcacaatgtgtacaagtacttcaccgagacgttcgaaagccttagggaaaacgaagttcggtggacaccgtacacgaacgaagaggccattttgcgtggaccaaatggagttagcatcttatgctaccgcgatgaagcgtactggatgacatgaaaaatgctggtgtacgacatattcgtcgaggggtataatgttcaaagggtaatgcgtcagatgggactgtaccagcaagttccagttcctgttggacttcaccttccaccagatgtgcacacgtatgttgttattttacatcgctttaatttctgtgctctccaacattgtgagatataattaacagctaattgttgtatttttgtttcatgcaaaagaggcaagctgacaacaggtatcgtcgatctatgcacttaaggatgaccccatggatagaggcgtggtcgcaggccttgaatgatgtcgtccacgagaccagggcatacgatcacaacacttacgaacaatacatggcctggtactcatcgcagactcgcatccggctgcttgcacccgaggatcccgacgagcgaggtccacccactattgagcaaatatatgatctgtagctagcaccccccgctcacttgacggtactactcgcatttaaatattttattgcatcggtgtctccttatacatggggttccaatttctaacactgttgctccgttccatgcagaccgacattgcaggggagttagtaagggatgcgaaaactttgtgggagaagcttagagatggtatcgcgggtaccaaccaggaagttatggccacggtcgactccctccgtagaaaaggtaaacgaatcatgcggctcgcgtcgtgccgacattcctcgaacgtgtatactccggcaacatcaataaggacgttcgagcaaatgccggagcgtccctctacctcttcccggccatccacctcagcccgcccttcagcctccgcgcgatgatccagtgatgttcgtgctccagtaaggtcaacttcgtttcgtgaggcacctactattccgactatcccagaaatcactcaaatgtcggaacgcctaggaggcttcggttcaactcaacgtaaaatacgttattacacaatgccaaattaagtgccatttatattaacgactaatttatatgttcgcagcacaaccggaacgggtacccccacatagctctgcgcccatcacctctcaatggcagggtgggtttgcggcgttcgctggtacgggatagctcataaaaatgctgattttttttcccaattgtttatgtgaaatgactaaatgatgttttccaattgatgacagagggaacgcgaatggtccgtcccgtggctcagatgcctcatgcaaggccacatatgattcctcaaatgcctcccgatgtgccaacctcacactggcagggaggatttgcaccatttgcatgtccgtgtacattcagtaccatattgtcacgcatatgtccacacgtaattttacttgttgctaattaattgcatatacaaggactagccaaggtatccgtaccataccccgagtggaagcagaatttatcggtcaaggagggtttacgtcattaggcggtcagtctccacttacatctaatttcacattnnttattattcaatntnnataattttcatgtataggaaatctattgactatttacttttctgaaataacaggncctactcagtcggttccactgcatgcacctacatatggcaccaacccatggaaagcacaatccatagattcggtgggtacgcacanccatcactctctatacacatatatcgatggcatttccctgtcatacatgactcgcacttcaccaacggataataactccgtgacattttatatggatgcaaggcacgtcgtttggtggtggagtacatggttatatggacttgttgcaacaaggtgattggctatttggtcaatattcctcgcatcgtaatgaaattccatatatgcaagcaccgtcaacaggtttggatttttttttgtgttattgttgtttgctccagctttgataatttcattgatatctacattgcttatgtagggtcatttcgccctgaactaatgtcagggtttaggccttacactgcatcgtacggtgacatttccagcttcggtggagggtcatcattggtacccaatgagcttcgggcttcgcaaactgatgatgcaccccgggtgacacagcccacacaaccagaggttgacgatttacaaggaaacaacaatgacccgcatagatctaaccgtgagcgccatgagccaaaccgtctgtcactctcaggccctcgacatgccgcaggaggaaagaaaaaaactacaaaaaagcccgctggcatatctaggactatgactgaccatgatgacgagtagaggttaacattatgtctttaagttcactggcaaccctgtctgaaccttgctatgcttttggctttctattactagcagagaacattatttatttgtactggttattcttcatgttatgtacgatgtttcgtcgttcataaatatctcatatattttcgcccctattttgtacgcagttaacacatatgatttttgcttaactaataatttttcgtacgagagctaacaaaaataatagtctcacaaactaaattaatagtgcaatttcgatgttactcgtgcggttaaaattggatagttgtattactttttactactgtgacttaaattacatactaatttcttttcacagagatgcaatcatacgcacctaaaatggcatcctctctttccaatcatgggacatgtcacagagaatcaatcattcacaattaaacagtgaagattccactgcgccgaaagtgccttcgtcgcgtagtaattactaaagcaaacagttaagcagcatgtgccaccgaaagtgacggtgtccctttgtaattattcacttcacgagtgaaacagtccgacgcgccgtcgtctctttctaataattgtcactatgcgtagcttcttgcaatcccctataaataacaaccaaacctagcacacaactacatctcttcttcataaacgttccgctggttccaacttcgtgttgcatattcttaggcccgatcttgaggcaggaactgagtagttggtgaactcgctctatgttgttcattcactcgcgacacggttcctgtcccaagatcgggtctgtgaatatacaaatgtgattttttttaatacattcttacacccactctttttttcaagttccagcatccgtttgtgaatatgacctactactgcaaattcataaactcggtgttgcatattcttaggcccggtcttgtggcaagaactgagtagttcgttaactcgttacccggttcttgtcacaagaccgagtatatgaatatgcaaaggtaattttctctgtgaatatgacatattctaaattcctattctttgtcaactttgtaaaaattgctcccgaatgatctctctactcctttatatatttttcctatattctaaattcctatattgtttctttcctatttgtatagtcgcactccgtcgacaccatctcctcctgcctcaaggctggcatgtcgggtaatgaacctgcttgcgtcgccatctcctcctcttagcagtggctgctcgagctgttctaatcctcttgcgtggtgttgtgtggtgtgaattgcagtggcctgatatgatttcttgtggagagacgccgagtaccaccaggaaacccttgaaatcctcaagctcgccatcaagtccaccaagaagctctgggccgtgagtccccctcctcaccaccttcagatatactgcagttcgatttattcatggtcatggtctcttagtgttgcttttgttgtttttgcatactgacatttgcgttctgtactccattggcaggtcatgcttgacacagtcggcccagagttgcaggtggtgaacaagagcaaagcctccatctccctgttattctcaccccttaccaggggcaggaggcctcctcacatgtactgccaattaacttcgctgggcttgctaaggtaatacctttcagttctattttttccggaatcttattaggctgtgcatgaatgattgcaagcggataggtaatacctttttgtgcaaaattttattatgctgtgtacgaatggttgcaagcagacatgtccttcttttatagaacttactattttgtcactgtgatttccagcatatgctcagtttgatataaaaaatgacttttttttttgttctttgcaggctgtgaagccaagtgccacaatatttgttgggcaatgcttgttcacaggcaatgagactacttcaatttggttaagacgtaaaaaatattcggcatactgcacttagcgttctgcatttttttttccttatgtcattgtcagtagaatttactttctgcccaaattttctgataccaaaactctaatttgccttgtttaggtttcagaaaacaaagccgaatttacatgtctacactggtatctccgaagtgcctcgttttcaacgtcaagaatcgtcagatgctcaccaatctgaacggccatagcgttatgttccttagaggactactcgttaaggtgttcctacaagaactacctgttaaggtgtttgttagctttatggttcagtatttgtgtccagtatccaccatgcagctgtttcatgcaaatccttttgtataacaaatattctatagactcttagctttctaatattgctgctctttccatctaatagatttgtcagtttatagtcattcctatattacttacgctactgttccagcgtcagcatcccactgcagattaaaagggtgcattgtgtttcttattttactctgatttatatatgtgcatgtggcgtgggttagactgaatattttgtttcattcacttagaatgatttaagttagattaacagctttgtttttacacctttctttgaatgcccatttcgacgtctgttttattagttctagcagtcattctaccgttaattgaacatcagtccaaccaagatcgggctaaaagcatatggttctgggcctaaatacacactgcaaggacatattctgctaatcactcatcaatgcttgctaattacagcctattattacccaggatgacagcactctgatccgactgaatttcttccaggcggcgcgccaatggcgcgccccatcgtctagtttggtaatcctttttttctcgctgaacgatctagtgaatgatgcaactacggttacagattaataaagcgcgtcaaatggcttctctcaaaaaaaaaaattgatagggtgcggatgctgatgcaaataagattatttcggatattaaaaatggcacatacacgatgtgataatggattaaaattgtgaggtgttatgtatatacgcaatcaacacggttcataggtactattgatgtgtaggggtagtgttgttgtggaagttggggaagctacaaccgttgtcaatggagtcatgtgggctacgactgattaacgtcacctcgctgtcgtcggtttttttccttttgaaaactcatgtattaatttacattactgaggttacgtaatactaatacattagcaattacaatgcatagagcacacatatggactatggcacatcctagttttctagaggactttgaaagatttgaaaatagaaacaatcgagtccttagtaatgtaaattcaagaagcttgattccaatatagcttaaaataagatgagttgcacatgattgaaccactgtactatcccaaaagggatctcacacaaatggatttttaggcgatggcatacaatgtgatatttcagccacatcatagaagatttttgccaaagcattagccaaagaagacacaacagaagttgttccaaaggtctagccccaatccatgacaccagcgaagcaaacataataagcacagcaagatgcaaatgaacccgaagaccgtacccaaaaggggcctccatgcataggaggtcggggtcaacttgggttggctcgacaccattagtcacctcatgaagaacttccaccgaagatgaaaaaggccttcacccttggaatgagctcaccagagatataggtgtagaccggtgcaacctattctcgtgcagatctggaggcattctaaccagtagaaaggacccgtcgacgtagtgactcatcggtgggatcaaatcccatagtgaactccatgatggcagcaccaatgaccagctctagaacaacaagagcaagatcgactagattaatctagacaaacgggagaacccgactaaaacaacaactactagtaggatggtacctaacccctctttcactcttcgttggtgacaaatctccagagagaaggatgaagaggggtcggagggatgagagtgctactgttggggaaatttaggagagaccttgcatgtttcccttgtgggtttaccatccggggactaaattgcccgatggaagatctacttgttttggcattggaaccgttgttatcaagtgacagaagctaaaaggatgttgcctcgctatatggcgtcattgggaaatacgttgacatgggagtgtgggacattgtgttccattttgtgttggggcgcatcatcgtttgccactcagctcgatggagagcagagtgttttccttgggcgcacgtgtgagtgggcgcgctaacatgagaagttatgtagaggtgggattggagatcatgaggaggagacagagaggaaagatgagagctagctaggttgcaagagggcacacggaggtggatcgacttctccccaggcgtcgacagcgacacttgcaagagagcaagccgtctcgcgtgacgaatccaacggcgctcgaggctcttctctagtggcggcagcgactctcggcactagaggtcataggggacggtgaccctaatgacagtggtggcggccatagagggcaaatcatgatttgttcctgggtacatagggccacacataagcgttacatagggcaactctcaatgactcaagttagaagtcatacatagagcatcaggcatctgaaattggcccatttggctttccgcggacagcccatttggcggcccgacgcaggataagatgggatcgtccgatctaatggatggtctcaattgatcccaacctagataaatacccggtagccaaaaccctaaccctaaattcatttctcccgatccccttgctctctcactcccgtcatcgctgccggcaaagggagggggg

SEQ ID NO: 19527 - DNA, 6232 bp, Oryza sativa
  unsure (1)..(6232): unsure at all n locations
gccccaacatcccctccttgtgattttattttttgatgaatgttttaagagatttccttttgctgttttttcctctttttgattttccccttcctatgattgaatctgtgatgaattggctgcccaatgaggtgaatctgcgatgaatcggctacgaatccatgggtggtttattgggtttctctcttttttttacatcgctaacaaaatcggattaaattttcatcacttaaaaaatcagtaatcataaattttaaaccatttattaattttttttatccttctttatgcgtcgttgaactcaatagagactaaattagcaactaaagactaatattagctatgttttaacttgtaaaaaatatgttgttttcggtcctatcctgacctgcatggctgcatgtcaaccaaactgtcaaaaacaaattttaaaaaatttgcaatgcacattaaaacatcatatatcaattagaaaacataaagagtcaaattatatgtagaatatttaaaaaacaaataaaggctctatttccaaaataatattccacatgtttctcgtaaattgcaattctcacatgtgaacatggagatacgagaaaagaaagcaccatgagctatttttaccgtctcttacaatctttcttattacaaataattatcctgtaattatggtcagctagctagtactaaaatcaacccatatactatagtctaccctctccaatccccaaaactctcttgcttcttcttcttgccgcccaatttcatatgaccaaatattcatactagagatgatcttctttatgctagatggtgagtatgactttggtacaaatgctgcttcaccatcacgaacaataaggtcaaatggatggtcttaggccactcatacaacttgggaaggaaaaccttgttttgcatcgacttgaacttagtcttcctcatcattgttgtgtatgttcccgtgaacagcgcccgtccttcccaggtctctaacttgtcccactccatcgtcgtctcattgagcttagtgacatggataggtgcaccattgtagccgacgaggacagccatgagctcaccttggtccgactcaaagaggtggctgtcaacttgttggtggtcaataccaaagttgtcaggttaaccaagaagtctaaaattatcggtgtggctacatggatcatacaccgccagcttcccatctccaccaagaacgtacagcaagccatcgtggagcaccgggttgctgatcgcgccgccggaattagctgtgtccctgcttccacgttgaactccgttcggtcgagcgggtgagctgtagcgccagggtcgtgttgacgcagtacaccctccgcgagccatcgtcgtatacgatgaagtcgtaggagtaatggggcgtacacggcaactcgtatgcgacgctcgtcaagagatcgatttgggagatggagaaaggtgagaacaacgtgaggcgttgttcgttggagcagaagatcctggtggcatcattggacgacgccgccttctgcataataacctcgaagtaggggctgtagtacctgatgttggttcgaccgacgacatccgcgcagctgagtaggagcggggtgatccacgctggatagaagggcgacacggcggagcgccagtgccggcacgtcagcgcgaagccgggggtggctcgaccacccgagccgctcaaggacgagcgccagcatatccgacgggagagacgaccagtcccgttccgccgccatctcgcttccttttttttctttttcttttttcccgtacgtgggataaagttcacgagtacacgtgcgtgtcagcaatggacatggtacgtatatacgcagcgttttattatgcacaaacgctcgatgtatgggtcggtttcagcttgtaacccgtcgatcgggttcttattggttgccaaattaaaaaaacgctgctgcttccttttcctaatttaattaccggtgcagattatggttggtactaattgatctgatgtcgtgtaggcgtgcatatactttatattttccaagtgtaattcgatcgggtggattctttttctgtcatctttacaattgcagtctttgcaatagaaatcatgagacaacacgatcaggcaaccgcaaattaaactacccttatatatatcgtgtataagtaagacacggcacaaataccggccgtctctcacacaagaaaagatcgatcgatccgtcgaattcatggaggagaaagacaataatgaatgtccgtcgtcgttggatcccaagcttgctcctctgctgctgttcggcggcgacgacgacgacgacgccaccttcatgtacagcgtgcggacgagagccctgctgccgaggaggtcgacgacgacgacaacatggacgccacgacgagagcccaccggcggtggaccacggcacagggctggttgctcatggcgccgcgccgcggttcgccctcaccgtgcgcgacgactttcctatgggaccctttcaccggccgccggatcgccctgcctcccgaccacgacgcacggcacccttctcacccacagctgcgaccggatgtgcctcctgtcacgccgccggcccacggaccccggctgcgtcgtcgtcgtcgtcgacttcgacgacacggtgctctggtattgccgccccggagacctccatggggtggtgcatcactacctgcagcccgggacgcctcaccacgagcaccgtgactgcgtcggctgggcgataggaaatcttacggcgatcgatggcaagttctacaccgacttcaccgaccacgtcgccgtcctcgagttctcgccggagcccgtgttcaccgtgaccgccgtcgacggcgaccacggatgcccagcagggtacacgcggctcaccggtaacttggtagaatcaaacggggacctgcaccacgttttcttctctcaccccatcggttgcagccggatcgttgcgcgcgtgagcgtttacaaacttagcgtggcgacgcagaagcagagatcggcgtgggtgaaggtggattcactggatggcagagtattcttcgttgggatagacagcttgggagttggagcgtcacttgatgcaaaagaaaccggcttgaaagggaattgcatctattactggggtatcaatggcaaagtgttgaatgtatacgacatgaaacgaggaactacggttgtgatcaatcccggtgagaatcttccgccgcaagtcttgatgcctacccgatgagtgtttctatgttactccctctccctctccctctgttttaggttataaggtattttttactttggttgaagtcaaaatgtttcaaatttaactaagtttatagacaaatatagtaatgtttataatactaaattaatttcatcaaatcaataatttaatatattttcataataagttgtcttaggttaaaaatattactactttcttctacaaaacttggtcaaacttgtagtttgatttataatctctactacttaaaaaaaaactgtagtggtgatggtgaagccaacgtagacgtgcatccaacttagaaacgtatacacgtgacagtggaaaaaaaacgaacgcttcatatcgacgtgcaacagaaaagatccggaatcagcgcaacagaagcgcccccaatccatcttcgcgcatccccacatcgccgcgcccgcgattccgcgtcgatctcctctgcgtcccccttctgtggccagatcaagatcggcggcgagccccggcgaccaacggcggcgccctctgctccggcaacctcctccccgactgccgctctgcattgcagcgcccgcttcctccgcatccaacctcgcgccgccccccatcgccgcgcccatcctcctcgcctcgccacgcctccaccaccggcccaccgcaccgcctccccatcaccgcctccatccccagtgccccggccacccagccgagccacatgtggaccggggtcggcgaccaccgtgccgcgtgctcatcgtgagcaccgacgcaggggttagttcccagatggtgtgcttcgccacgtcccccagcaaggaatcaatcatccaccccctaaggagccccttcgtaaggccactgtagattggaatcagtggcggacccaggatttataccttgggtgtgcccacaaatacaagcactacacattggtctagagcatatacacaaaaatataggcaaaccgagcattttatacaccaaaatatggagccctgtacatggcctagacaaagcataatctggattttctaatgccttgctaaaagaagacaatgcccttgttcctcttcgtattaactgatttcagaattttcaatttttcaaccaatctctagctctcctttaaaagaaaattcagggagacaaagaaactaaaaatagtgagagactaaaagtcccaaagagtatatctgtatctgaagttttagatagatgatgcgaagctggacctgcttgcttgccttggtcaatgtggttgctgctggctgcattccttgcgttgctcacagactcaccgggcgcgcatcgacgttgcttcgccatgtctctaaatgctagtggctgcggctctcgtctccaccgtcggcgctccacactcgtcgtccaaccaatatcggtgctctggcctgttgaatgtcgtgctcttcggtgtcaccgccgccgctcgctgaatgtggaacaacgcctgatgccctgaccctagctacctttcatacgatgccaagtggatacgcgaatgcgaggtgaagcggggaacttgcacgatgcaaagcgcacaacacatcacacatgcatctatgatgggctggctcatgcgttcatacttattcaaacttttgccccaaactaatacatgctatatactataagtttttcgtttttttgggtgtgccggtgcatcctgggtccgcccctaattggaatacatattcgtatagtcttctagctctaggatgctgaatactcggttctacaatggattggaatcactattgtggtagccctcttatgattctctcagatgatgaatattcatcttagatgatggtcttttagatcttttttgtccccatcttaatttactgtcacaattagctcgatttaatcctgcgacagtttacaaactttgccaattgtagtttgtttaggagactagctaatggagtgttcttttgtttttgctggcaggtggagattcatgtgaggaagatttattgcatcaattaacctaatggatgcctcatgaagtgaggctaaaattgaaaaggctggacaggtatgtatatgcgatctacttgctttctgcttgcaggatcaacacaattttgtgttacaactattatgcctcaaaatattaaaatcatagcgatacagaagaaattaaccattgctgccatttcagactgaacagaaccttgacatgtagaatattttttggatttttcatgatgatttttatgccctaaaccgtaagtggttgagtcatgaatggtgagctaatttgtatcttaatcttaactacttcagtcacgtacctattttctccacctccccattgttttccatcattaggggttaaaatacaagtaactgcagcggcaccagcacgagcctcatgaatcactcgtggcgaactggggtagattacccttgatgctcatcctaatatgacatggtttgatcatgcagaatctgtttgttcacgagcccgcaggagtggggagtataggctgtcacacattatgaggttatatgtatgcgtgattcatgtgcctgttggtttctgtgtctatacagggtcattcgaggaaatttgagtgctcaagttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19528 - DNA, 864 bp, Oryza sativa
  unsure (1)..(864): unsure at all n locations
tactttgaagcatatatcctgagaacaaaatattgaagctaatgatttggcccaaggggcatcggggtataagccgatgatcaaagatgttaaggttgaaatctctgcaataacacccgatgattggagatatgatgtgcatcaatattacagaatccatcttaatcggcttctcggaaattaagatataaaacgttgaggtatactttattggatgatgaactctattatcgcacgattgatgggtgtacttttaagtgtntgagtaccgatcaagctaaggttgtaatcggtgaagttcaagaaggaatntgtggcactcatcaatcggctcataagatgaagtggttgcttcggcgtgcagggtatttttggccgacgatgctgaaggattgtttcaaatattacaagggatgtcaagattgtcagaaatttggagagattcagagggcaccggcgtcggctatgaatcctatcattaagccattgccatttagaggttggggaattgatatgatcggcatgattaatccaccatcgagtaaaggacataagtttatattggtggcgaccgattattttaccaagtgggtggaagcgattcctttgaagaaagtcgattctggggatgctatacaatttgttcaagagcatataatctatcgatttgttattcctcaaaccattacaactgatcaaggatcgatcttcgtgtccgatgagtttgttcagtttgccgatagcatgggtatcaaattgttgaattgttcaccatattatgcacaagctaatgggtaaactgaggcatctaacaagagtttgatcaaattgattaagagaaagatttcggattatcgtcggcag

SEQ ID NO: 19529 - DNA, 395 bp, Oryza sativa
atggcactgactttacactactacaataagcattatccggtgcggatgaattcaatttttgcgtgcgcacgtttcgactgtttggaaggtataggctgcaaaaatcgtgattttttcgtgcgggcgaccacccacacgcaaaagtccttgcggcgcttaatctgcccacacttgtaaaatgaaaaatcgaaacaaatagggaggagtatacataccctatgcttaattcagtcatcaccgacgccggcaccgacaccctagccgaggcctgccaccgtcgtcaccgcggtcgctggtgacggattcgccttcggctaccgttgctgatgcctgatccaacgaccgtgcactcacgcggctgccggggaggggatgggaggggagagggaagggag

SEQ ID NO: 19530 - DNA, 9900 bp, Oryza sativa
ataccctgaaaagccaaatcggctaactgggcatcggtcaaactcaagctgtagcacttattcctcatctctcggaacctctgaatatactcatgcacgggctcatcgtgtctttccttgattgctgttagatcggacagtttcatctcatgcacgccactatagaaataactgtggaaatgcttctccaaatcggccccactgttaattgacccatatggcaaagaagaaaaccaagtaaaagaagatccagataaagacaatcggaacaacctaaccctcaaggcatccacagccggtgcttcaccgcactgggccaaaaaccggctgatgtgttcataagtcgatgtactatcttgccctgagaattttgaaaaatctggaactttgaaccggttagggagaggaactctctcaaaccatttagggtaaggttgccgatacaaatttccagcatccttcggcctgagcccaaactgctccttcatcacatctgcaatcatatcggcctatggtcgttgttgaggtgctccttgaggttgctgtggcatgggctcgaattgattgtattgaggagtgaactgaggttgagccgatcctccctgctgatattgaacttgtggcgaagcaggctgataccgataattcaaactacccccctggtaattctggaagttcggctgaatattgtgcaccaaatgttcaggaacgacttgaggtatcactgtttgatctggctgcacatggtgaactaaatgctctgggacaactcgattcacagcgtgctgccctagctgactgttaggtgttgcgaatccagccgatgcattcatcaaaccctactggtgaatcggctgaatagcctgttgcctcaatggcgtttgctgaatcggctgcaacacctgttgtctcagtggtgtttgctgaatcgtctgcacaacctgctgcctcggtggtgtttgctgaatcggctattgctggactgggtcaacagtaggttgaggtggtaaaaacatagctgcaacctgatcttgtgttagccgattcacgttctgtccactatgttgtggctgttctctcaccaacaaccgaggattaactaattgacctggtgctgacgatgatgcagcgggtgcaggggccgatacttgtgccgtcggctgagccgatggtgcgttaggagggactgtttgaacggcttgctgattgtcagtaattaagggtcgataattcgggaatgtacccccttgaagatacaccggccccgtagtctgatattcagctattgaaccatcaaccatcgacttcaacatgtttgacaaagtattgactaatatcccagattgattgatcaaagcatgatgcacggcatattttacctgattctggaagttgttaaactgtagttgtgccgcagtgccaccttgattaataccatcaccttgaacttcttgagagccgacgccctatactccttgagagccatcaccttgattttcttggaggtcgtctgcagcacccttatcactcggttgagccacaccatctggagtttgtttcacttctccatccttgggagaacttgtcccaaggacatcagcaaccacctttaccttgtacttctacacaagtgtccccttgcgggtctctgtgaatgaactcaagaactaattccgtgcttgctacatcattgcgtcaaggtccttttgctgctcaggtgtcagtttatcctgagtgacgggcacaatgtgttgacgtttgatgtcgcgattccgatatttgcatggtatggggatcattgatgctaggatatatgcgagactgaggtaaaagagatggagacgaagatttttatacaggttcgggcccctgaattgtcaggtaataaccctacatcctgttggtcggagccggcgttgcttttattcaccataatcacaccagtacaatatttggggtagcctatctaactgttgtcgacgtggcggtctgaggttctgactcgtagtcgacaacagggtagccttcctcctcgagttcgtgcccggcgagatcagagatagcgctttcgtctctcctgacggtatccagagacaccgtaggggactagccgtgcttatccctgaagtcgatattcggcgtcttgtcttggcatatgttagcttgtatgttgtggcttctgttgttccgtagattatggtggttgttgattgaggtggtcgtgtcccctctcctcctagggggccttgtatttatacacataggtgtccccttgtccaagtagaactagggaaacccatatggatataatccgagtagtccttgtcgtttccatatagaactctggttatctttccttatccggaactccctccatatccgaagtcagtttccgtataagacatggtatgtggtgggtcctgccgagatgttgtcgactactattaggtatgtggtatccataaccctgacagtagcccccgacttcaatgaaaatgaacaggttcatattctcaactgcagaccttggaagaactgttatcgagctcaagtgaccgttctctgtgagttcagagataatgttagactttctttatcagcctcgtgcgggaacctaaagggtttgtctgagtccatctccgacgtcaaccaagaaagtacagaacatacgactaagtctcctgtcttgctgtaatcgagaatttggattgaagtcaagaaattttatctcggcgggtacaccatctcttcattctgtattccttgtcgagatccaccaaccgttctcgagtgatcgataaggcgcaaagactgcgacggagccttgtcaacatttgtcgtactcgccttagtcgatcttggtgtagaaccatagagacatggagtcttccacaatgtcgaatagaattttcctgaaatcaatactcagaaaagaatattagatagaaatagcccccgagcgaatgctcaaagggtgacatgctataatatgtatggaaaactgaaaatgagttaaatttacagaccaatgttttgtatatgagcgtcttctctcttaccgacttcgatcagtcagtttgttgagttatacactctccctagcccccagccttgtcgtcagagaatcattctcggaggagaaggctcttggacccttgacctgccttggttgaacaagcactgatcctagcccccagccgtgaagttggaaaacccaatttccgattacacggcttggttaatacggacggcgagaactcttacacgaccagatcttacatggtcttttgtctctacaggatccgacaaggccttatcggctctgggcatcctcagctgaagttcccttaggttcctcgcaggccttgacaagacggcgtaaagggacatgaggataggtttcaacgctaggagtcgtcgtggtaagggatctctgggtaaaacacttggcaatattgtctacctgataccaactttgttggagtagaggtagtgggaggatcgctacacctctggtagtagtcgtaactcgaccacttaaagtaaatgtacgagagatcgctacgcttaactggttgagaaccagtgagtaggtgtctctcgatcatttggagtcgtggtacgaggaccactacgctgccgatcgaaaaccagtcatagctgttcctcaaccatctgaagtcatggtgcgaggaccgctgcgttattgatgtagtcgtacctcgaccatttgaaattgcagtgcgagagatcgctacgtactggttcgagaaccagcaagcgagtagaattatctctcgaacaccaatgtaagttgcggtgcgagagattgctacgtgctggttggagaaccagcgggcgagtagaactatctctcgaacaccaatgtaagttgcggtgcgagagattgctacgtgctggttggagaaaccagcgagcgagtagaattatctctcgaacaccaattgaagtttgcggtgcgagagattgctacgtgctggttcgagaaccagcgagcgagtagaattatctctcgaacaccaatggaagtttgcgatgcgagagattgctacgtgctggttcgagaaccaacgagcgagtagaattatctctcgaacaccaatggaagtttgcgatgcgagagattgctacgtactggttcgagaaccagcgagcgagtagaattatctctcgaacaccattggaggcgctaaagttggtttattacacgtgcatctcatgtggccagcatgactcacatacccaacttatagcatatccggatgtccgttcgcaatcatgtcgggtgatcaagccgacgacgttcgcgaggaattatccgttaacaaccttttcttgagtagtccagccatggccggtgctatgagataggtcgtcggtcttcgttggtaggttgggcgcgacaactccgcatttgtcgagaatgttctcgatggtggggtgtactcgaccacaacctactcgagtgctcgattgttcctgaaaaatattttctagaaggcaagacatatagcagagaatatcgagtatgtactcaaaaaactgcataaatcttctagtattatcaggatataacgagcagatgtaaatatcagggattatgtaaaccgtaaacaagcatgattcatacaaaagagaacagagcgagcccccagcgttagaccgtggttggcctaacatcggaagcactcgcacaataaatattgtataaaaaacatgctctaggtaaacataataaattatagatctgacaatgctgtatgacctgaataggtacgataaattgcatataaaatattgcgtacctttgtagatacatgccggatatatctacgaaattagtagatcaattaagttaattaactgtcacgcccggaaattcactagtaatttccgaacttatttgtgcattaaaccctcgtccaggaatcagccgaggtacacaaactgacaatttaatatacagattcatcacattaactaaaacgataaatacttacttaagaggcacttagtcctcaccatgaagaaaactgcagcggaaaaataaaatctagcgaagctccggctccactcccacaggcagctcaactggggtataagccaaacgtcttctccttctggatcctttatcttcaactgaggtttgattgattattgcaagaatgagcatatgacatactcaacaagccacacagcaaatatgcaagtgcacaaggattccaaaggatggcataatataggctcatttgcaaaagcagcatttagcaaaacatttaagagaagtaaaacagtggagtaattaatcagaacttttaaccaacactgaacagcacacccatgctgctcaggcccaaccatcctgaacaaccatacccggctgtacagatctaactccaaaccaggagctaagcaaattattaccaggtataacatccataattattgtgagaggtgtgagactaatcacgaaaaacattgctcaactcgcccataaccgcgggcacggctattcgaatagttttactctggccagaggtgtaccactgtacacacaagacacgattccacacatgttgccatgccccgaaataccaccacggcattgcaaagggggaaatcgtgacaataccctttgcacaacacaactcaccacagtgcaccgttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgccatgagcacaaccatcaaaaccatatgctcacaacccaccttaaccaggttttaattatcaattaattaacatcacacgattaatcatcgtgagctaccattaaatataaccataattaataatatagtacatatgattcatcccattagtgagctaatgtttctaagcattgctaagcaattatatatataacatttagctgaaccaaaccaatacataaggttcaaactaatcaatttattacccaaggtatcaaggaataggacattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacagtacataaaaaaaacaaacacgtagatcataattttagatgaattatgagacttgaacggcttcattctgacttcaaatgaatttattatgaattttacaagatcaaatctaattaaagcccatttaaaaaaaattaaataaatttaattcaatttatggacaattttaatatgtagatctttattttagaaaaatttagcaacttgaaccacctgaaacggatctacggttatttagttatgattttccgaagatttaatctattaaaagaaaggaaaaaggaaggatgatgatgtcacgctgacatcatccatggcagccacagcacgggtggcgacctcgccggagctagggtggtcggccgggattttggagaacacctacgcgaagagaacgacgagacgaacccgatgatactcaccaacgcgacgaacgacgacggatgacggccggcgacgaagaagcgacggcggcggctcggcttgcacggtggcgacggctctacgggtcacgggagaggacgggagagggggcaaacgaaagaggaggactagggggtcctatttatagccttggattgaagagatcggactcctcccgcaagaaatcgatccgggaaaatcaaaactcggttttggagataaactcgaaaacgagtttgattcggataaaatacccaacgatttgctccgattcttgggggaaaagatagaggaggatgagaggatcaaaacccctcaaaaatccggaagaaacggggtcggattggagcggatttggaggcggaaggcggcgcaaggtggcggctcgggctcggcctggctgcagccggctgaaggttagggacgacactgtagcagggaggcaaagtagacttttgtcgggcttcattttcctcggcccgattgaaggagggaggcaaaacagactttgacagagagagaggagggggcgggcggcggcagctgggccgattgggccgattcggccgcgcggagagagaaagagttgggccgaaatcggcccaacgacttagggaaggatttaaaaactttttccaattaaaataatcacttaaatgatctttcaattgttaaaaatacttccaatgctcaaataatttcaagaaaaatcctgaaaatacttggacaatcaaagtacttaacaaaattataattagaccatttaatgattaatttaatatgtgggtaattactgaaatgctctttgtatgattaaaattaagaattgagctccgaaaaatccgagaaaattccagagagtataattaaccatggagaatttaataaaaattaaatccacccatgctttatatttaagaaattttatttcccacatttaacttcacttgtaaattaattaatgaacatttaatataaattcttttaataatttattaaataatttataaatcctgaaacaaaaatcaggatgtgacattaacctaccaattacttgattagcctaggtagctgatttgaattcgtcctctggacacacagtaactagcacgtatgggtggcctacatgggccccacaacatgcatgctagtatacgtgtagatggcagtgcagtccgctgggttcttgctctcttcggctgtcctgctgctgcacgcctgcgcttgatgtcggggcaccgtcgtctgtcgacccgacttgtccacggtaagacaggcagggtgacgagttgtagttctcttgtgagttatctgctctccgttcccgagaagaggtcatgtctatacaaatagacgatttgaaagttggcctcgaaataatcggattcgatgcagttgtaacacgacagagaatttgatgacgacgtcgtggcaggaaacattgaattgatgttctccgtggcggcagcgacatctttggagattggatgatctcagtagatcaaaaaccgttgacgatgatggtttcgatctcgtcgggagacatactttggtcaggttagatctctccatagccgaagtcatcgagtagcttgttatcggagaatccatctcttgaacccatctcgtcgaaatcctaaagcaccaaaatccccctacctggcgcgccactgtcgacgtttgatgtcgcgattccggtatttgcatggtatggggatcgttgatgctaggatatatgcgagactgaagtaaaagagatggagacgaagatttttatatagcttcgagcccctgaattgtcaggtaataaccttacatcctgttggccggagccagtgttgcttttattcaccataatcacaacagtacaatatttggggtagcctatctaactgttgtcgacgtggcggtctgaggttctgactcgtagtcgacaacagggtagcatttttcctcgagttcgtgtccggcgagattagagatagagcttttgtctctcctgacggtatccggagacaccgtaggggactagccgtgcttatccctgaagtcgatatccggtgtcttgtcttggcgtatgttggcttgtttgttgtggcttctgttattccgtagattgtggtggttgttgattgaggtggtcgtgtcccctctcctcctagggggtcttatatttatacccataggtgtccccttgtccaagtagaactagggaaacccatatggatacaatccgagtagtccttgtcgtttccatttagaactctggttgtggataatactccgataccactctatattaagatattaacgcaagtagaatataccaaacagaagcctaatatacttaaatgcaataagatcttgacataaagggcagatttaacatgtcagtaaagcacataaagcaaatatagttaaaccaggtaagatcggctgaaaccccgatactaccctaatcggcaaccagaagacaggctagagattgaaattctaagcacgacttaatagatcaaactcaactgatgcagcattaagtatgaaaagaagagcaatatctagacaatcaagtcgttggatgtttcatagagtggtggatatcttatataatccaagctaacgtcgctatttaacctaatcggacgccttctattaacagatgttagccgattgtaggttagatgacgatattatcgaagattatataagatatatgataactcgatgaattacataaacaagattagagtgtcataaagatggaagcactaatcccgagaacgcaagccgccataacaagttttacctcttgttgaagatcgaaaccgatgcagctcaacccgaaagcaagaactcgccgaaataaaacgaaagcaaaaagggtggcgatgcgccgaaattgtattgaacgtgtgttagtttgattacatggggttcggggcaatttatacccgagaattacaaaacattcccataccggacacgactcttatctctaacaaactctaagatacgacaagtctttacagcagacttttgcccaagcatatctctaat

SEQ ID NO: 19531 - DNA, 509 bp, Oryza sativa
cactcattctataacagcaacagcagcagcaaattcattctataacaatcatcaaaatcaggcaatcaggggcagcaggggcagcaattcatcaaaaaaaaaaaagaacaagtgtatataacaatcattctataacaggagttcattctataacatagggttatataacagcagcagcagcagcaattcatccagtgcatcaaaattcattcaaaatcatataatacaaagaagctaattcatctagtcctgcattcatccgaatcatacacatggatccaaaatcatccatcactgactcaaatcaatccattcatcaggaggaggaggggtggcggcgtacctggtcagggagaactggccgaggagaagaggtctgagaggcgatggcggcgctggtcgccggtcgtcctggatcccggcgttgtggatcccggtgttgtggatcccgatcgtcctggatcccggcgttgtggatcccggcgtcgtggcggccgacgtccgatgtc

SEQ ID NO: 19532 - DNA, 26619 bp, Oryza sativa
tatagactaataacaaaacaaattacaaattccacctgtaaactgcgagacgaatttattaaacctaattaatctattattagtaaatgtttactgtagcatcacattgtcaaatcatcgcgtaattaggctcaaaaaattcgtctcgcaatttacatacaaactgtgcaattggtttttttctctatatttaatgtcccatgcatgtgtctaaacaatttgacgtgacgtttttggtcaaaatttttttaatctaaacagtgccaaaatataatcatcaaaatgtactaatttgtggtcaaatcgtgatagctgtcctcaacaatacaacgtcagttttccgcgagcggaggagttaaattgtattgagtgaaactaataatgtttttaaatatgcatgtgctacattactagtatcatgttagtgaatagtgagcccatgttatatcatggacgagtgagctggagacgactagtactactacagtagtactccactagcatactaagggcccctttgaatcgcagggtagaaaaaacggaggaataggaaaaacataggattctgacaggaattgaagtgtaaaacagaggattgcaaaacacaggaaaaacacaggaatggtcgtttgattggagcgcaggaaaaacgcaggaatcggatgagagagatagactcaaaggaaattttccaagagattggagctcttgctaaatttcctccaaaatctacatgcaatgtgtcattccataggaatttcataggatttggaaagcttcaatcctttgaatcaaagggtcaaataggaaaatttcctataggatttgaatcctatgaaattcctacataaatcctttgattcaaaggggccctaagggtttatttggggagttttgacaggttttttactcagattatgctaaaatatagttgtagaatctaaaaaattaccaacttctccgtatttttaaaagctgactaccaaaccgtttttttaaatcttaaactccacataccaaaatatggtcctcaagctgaccaaacaaaaaaaaaaactgaaatcctttatgcaataatactagctggcccgtgggacaaaaagagctctatgattggtattcgcacgtgatctttacagcataaaagttcttttctaaaaaaatgcagattatgcgcaagttcaacttacaatgaggaagatgttttttttaaaagaaaatacggagtatactgcagtttactgatttaaggaaaaacagatttaaaaaatactgatatttgagctgaatttgtgtgtcataattgttctgagactccacatatactgacaagtaagattgcatagagccacacgctcggcctgactccgtccggatcttctacgggcactgccttgtggttcagaatatatactcccaaggattgcttcaaacaaattattaacaaaccttttaatttctacttacctttattgacatttagtatttctagtacagtaccatgataaggaatcacaggagtaagattgttagagatcatggcaaatagcatagtatgaaatattacaatatttgtttataaacttgatcaaacttaaaaaaattaaaacaacttatagtataaaacgaagggagtatcatggatagtaatatactaatgtgtagcatatcacatgaacatgttataaatgattgaacaaatgagagcttcatggtgcaatatatttagttaagagtaattattttgtaaattttcatatgtaacgtattatagtaagatggtgtggtggtgtttaatctatgcaccaaacaaaatgtaacatgcacacatatcatttactccatcagtcccataatataagggattttggagggatgcgatacttttcctgttcagattcgtagtcttaggaagtatcacatatctccaaaatcacttatattatgggacagagggagtaccctttacattataaactgcaaccaaattttaaattttaaaacttgagatatcttttatcatggtttattttccagaatttgttttttaaatactaagagcacatataaaagttttattcaaaaaatatttgcttataatcagcataagtgaaatgatgactgtaatggatgtcagctaccaaagcaaccagatttcaccatcacacacttaaaaggagagatatttactactatttgtcatcgggcaagtgtcaactgtcaataaaacataaaatataacattattattggttttgctagttggacgcatagaaaaaaatatatatgaccagatctttctaacaatgtcggactatcggctatgaaaatgaaaatgatgaccagtcaccttctctatctctcctcttatgtgtgacaagcgactaggttcatatagacaatctcttaagtactgtactgatgacagataatcgacttagtacatatatatatataaatcagtggcggatccagaaagaaatagcagtagggtctaagcaaagtagatcgagttacagtcccccctcctatctacatatggtaaaaaaatttagtggggttttcgtagagattctcaaagtcttcacgccaataatagggttcgaaaccccgccgcctctatgctggatccgcccctgtatataaattagaatgtgcaacaccacaacatttaagaaaaaataattatgcaccccaaaatagaggaaacccaatgatattccacataaattcctttagaaaagatatcaccccaataatgaaaaacagatatgcagaaaggtgtataatccgaacaagtttcaggagatccggtggtattgatggctcacgagctagacgaccgccgtactatgcctgacgcaagggtgccaggtcaatcaatggcatattggcatggctgccatggcatgcctgtaataaatgtctcattatctccatttacccttcccaacggctacctattcatctcaggtcctacttgagccttcaccagttttcctcatgccaaaaatggcaaactactataccatttttttccttttctcatgaacatggaaagtcaatagcaagaaagtggtaattctcaaagcaaaaactatgggtgtcaataaaaaaatttgagcattttagaaagaagcaataatatagtgagtatatttgaggaaattctgattagcacaatgacagttccaggtacaagagtccacctaccagtggtgttgtaaattcctagtcccactaaaatgattctttctgttagagcaaggtcaatagtgcagctagcagtaggctccagccttttgtcatgtctcaggtagagctaacttaaagagcaattcatataacaagctaactacaagttagctataagttgccttgattcaaacaaattaacaagcattttaggtcacaaacggattttttattttatctcctggccgatacagcgtggggcgctgtgcaagcgccggcgccagtacaagcgccggcttctttctcaatatgtgattttctttccttaatctcgttttaggctaattaacaggttttggagccttcctaatagcactattgtacctgctcttagagggtacaattgtgtactatatgtgagtgtggagtgtatgtataatggtgttagtgtcgcctttgggtgtgtttggataatgagaaaatgaggagtgggattgggattggaaaataaatgaagggttaggattaaatggaagagggggataaatagctaggatttaaagatgtcttttagtggatggaaaattattttccattcccattagccaaacactcctttatctttcatgtaattgaaaaattattatgagcatgtcatatgagccatattcgaataggagtgaaggtccttgcatttcttttattatgttttacacctctcctaaaattgacaagtaacacaaacatgacataataatcagaactaacaatatgccaagtgcgaggagaattacttacagcatgctatgaacaattagcaaatctggcataagaaaaataatggaaaaaaattgtccaggtacattagttatctcctcatccattttcatcctcgtctacattcactgtaccacaccacaaaatattttcaattcaaaattatttcctcacaccaaattaaatactctatctgttagtgagatcccaaaaaaaacattaaacgaacagaaaatccaaacctaaactcgcaacaacttatgagctaataatccggatttaaaaaaacaatattttcaattattatttttcccacatcccaattcaaaaaggctagaagcccccagtataaagtccccaagagtcaagcactgttcttcatctcttcccaagcttcaacttcaagaacccacccacttctcctcctcttctccatccgctgcggcaagcgcgcaattcagttgctgcgagctcgctcgccggcgacaatggcggcggcggtggcggtggtggttggttgcgttcttcttggtggtgtgtgggggttcccggaggaggatttggtggcgcggctgccggggcagcccgtcgtcgggttcaggcagttcgccggatacgtcgacgtcgacgagaaggccgggaggagcctcttctactacttcgccgaggcggcggagggcgccgccgccaagccgctcaccctctggctcaacggaggtcagtctctctgcttttctctctctctctgactctctctgctgagttcttggatcatactgtgtgatgtgatgtgatgtgttgtgtttattggatttgatcttgaagcattgtgtttttttctcatctttttcaagttgagaatgagatgtgattcttgaagagaggtttggattttttgttttgttttgttttaatcttggagattggtgtggatttcttccttgatgtttttgtctcttgctgcatgtcagtgtctcactcggttctctgaactttctctgattgttttcttctgaatttttcttatggaggtatgctgactgtggagatggtagagtctcactgttgtttgatagagattgctccctttatgtgcatggctttcggttgattccttctagtatggttttctttttgtatccgtttggatctccactgtttgtgcaactatttctgaattcttttcatgaacagatggaattggagttgtcattgtcaatggtactgtgtactactgttccattaatattttaatggagacaactttttttttggccattttatgagttgtgaagccaggaaatgagcttccatttaccatcttctctgatctcttctcagatgcaaaaatgtattttttttctattttcattttgttcatatatattctccatgttttttcatcaggggactatgatggcaggaggtgtttcctgaactggaaacataaaaagaactacatctgctctacaccttccaagaaaaaagaaatcaaaaataattttaacttgcatgttgatatccttttcactagtactcctactactttgcaacttgcaaaggaggaatagggtatctttgaggtcaccatgtgtccttggacccttgcctcattggtgtctgtgtgatgtggtcctagagcatttaaaaagaagtgatgcatcatttgatttccatgtagcaaaagactacctaaagaaatgatttccatgtagcaaaagactacctaaagttttaggtagcatttttagaccagttttaggtatcatttggtttcatctccatcattccatgcacaaaatgaagttaggggtgaattttttccatggaacaatacattgtcacataatgaactgtgaacaactttaatgctacagaatcaaatgtgacttgctgattgccaatgtttgctgtaagattaactgatttataaccgctggccatgttgttatcaggtcctggatgttcttcggttggaggtggcgcgttcacagagctcggcccattttatccgagaggagatggcagaggcctgagattgaacaagaagtcttggaacaaaggttgaacttttagttgcaatctccacccagcacatgttttcagaatgcataaaaaatgtagctttagctctaactgtgttaccttacctcaaattttgcagtatccaatcttctgtttgttgaatcaccggctggagttggatggtcctactccaacacttcatcagattacaatactggcgatgcacagaccggtaagttctaatgatgtttcttcagatgaaaaggaccagttaaacttgaatatgttggcctgactgtatgtatgcctgctcaactatgcagctaatgacatgtacaaatttctgttgggatggtacaagaagttccctgaatacaggtcaagagggctacttcttagtggagagagctatgcaggtcagagagtattcctgagtcttatttcacatttaaatgtttaaattctgtcgtgcactttgactgattggcgaataattcagggcattatataccgcaactcaccgatgtacttctcacacataatgagaaatcaaatgggttcaaattcaacatcaagggagtagctgtaagaatttgatcgcacattggtcaatatctgttaactttgttcttctaaatgttttctgtaactctgatattaccttgaatagatcgggaatccgcttctcaagcttgacagagatgtccccgcaacatatgagtatttctggtcccatggcatgatctctgacgaaatatttctatcaatcagccacagttgtgattttgaggactatacctttagcaacccccacaatgagagcaagtcatgcaatgatgccattgcagaggcaaacagtatagttggggattatgtgaacaattacgatgttattcttgatgtgtgctacccatcaattgtgatgcaggagctacggctgcggaaatatgtatgcttactcttgttgatacaatcttctacttgagaacatatggtcccttgtggtatgactgaattgttgttctatgcaggtgactaaaatgagtgtaggtgtggatgtttgtatgacttacgaaaggtatttctatttcaaccttccagaagtgcagcaagctcttcatgctaacagaacacatttgccctatggctggagcatgtgcagcgagtaagtatttatctgtcaacttctgtctattatctgtttcttctaagtacttcggatgctgtaagtacggactcaatgagtataactgtaggcccttctagtaaagtttcaaatagatatttttctaatgaaactaccgatgatttgaaatttttttagaaaatatttatcatgtatagaatgccaaatagtatttagtgaacaggccttagtttccaagtctaactcatattgaacatttacatgtgccagtgtgctgaactacagcaataaggatggcaacatcaacatcttgccattacttcagagaattgtagagcacaaaataccagtttgggtgttcaggtaatgtgtatttccacttatattccagataatttgtttctgtttaatgtgaagaatgttatgacaatatcaattgacactacagtggagatcaagactctgtggtgcccctattgggctcccgaactcttgtacgagagctagctcatgacatgggcttgcatgtcacagtcccatacagcagctggttccgcagagggcaggtatactttcgcccttttaaacaaattagctgatacactatgaaaacataatgcaaatttgtgaaagttactaatagttgaaatatgtgaccctttggcattcaaggttggaggctgggtaacagagtatggtaatattctgacctttgcgacggtgcgaggagcatctcacatggtgccatttgcgcagccagaccgagctctcggactttttcaatcattcgcacttggacggagactcccgaatacaacccacccacctattaactaagtgtacctacgaaaggagctgaagatacaaacaaatagtctaggattttcagttttgctacagaagattagttcataagggtgtattagatggtcaaatacgaatattttatctattagagagaacagggaaataatactagattaaattctttattgttctctatctggattgtcagattgcattcctggaagtctggaacattgagcaatctgtataactatgtcattttaggggttttgggggcacactgcattttgcaactgtacctatctatgtctgaggaatttcattagtgcaaactgatggaaaaagttggctcattgaagaagttgctgcctaaattttagaatgaatgttctaattgagtctatctaattggagtattgtgatttacatatgctcgggatcttactgaaaaaatggaacaactgtaacaccttgatccataagttttttttttagttgagatagggtgacaaactttatcttctaatgtcacattatccaagctgtgaactaaactaccggcaatgctagtcggcagggacaggatcatacctttaaccagtcctttttgaagaaatttatgcttgaccagtgtgcaacaccacaaggtcaagggagtataaactgcatcaagggtaaaaatattcaggcttatctgctttggaagatacaaagaatgaaatgtaatggtaggttaagacctggagagaacacgcagcatagaagctaccccagttggaagctggatgtcgtctctttgctccccaaaggccaaaagctgacaacagcaattgaaaatacatttttttttttgttgttcttgggcagtaccaaattgttgtcaccaagtgagttctggatgggagctatgttggatagtatcgaggtgccaggtttagcaacttgcatttgataaaacttgacaactttttcatcagcaattttatactatatggttataaacaacttaactttgccattgtcattatgtgctctccaatcttgcttgggacgaaatcaatgagtagtttcaccctcatttgcactgtctcatatatagtgtagtaagtacaaaaatccccagtacaaaatgtatttgtaacctccctggcttggttgaaaagatgatgaattgttcccaacttgcacaaagatttcagtgctgcgatatctattgctatgtatgacatacaaataaggaccacatccaaagttgctgcactatctattgcgatgtgtggcatacaaataaggaccacatttcagtgctgtaatgaagcttagaaaagatacaagaatacactattttacatatacctgttttgatagtattgccaggtaacaggttggaatacagacaaatacagggatagctatgcggagaaaacgagtcagttgttcaaccatctcgtgacaaagacaaattctcataaatggagcttccaaatgacggtttccttaccttaaaagagtgggtatgtggatccaagcaaaatgacctcaaaagacagatttgcatgctggcaaccatagcaccagatgcaacaacccattggtgatcttggagagtgacaggatacacagcttctttttgtaactgtactgaaattcgtatggagacaaaggtgatgctgtactttaagctaaggaaaccataaatatcattggatacttggttagtgcttgatgatcctttaagcccagaatggccattgccatgattgactagtttgaatgaatactcctcatcccttccagttggatgaagggaactcttaagaattacccttgcaggagattttcacagtttctcctgcatccaatattgtcgcatattttcagaagcactatatttgagccacatgccgataaattagactgacaacattacacatgtattactgtcattgcagtcacctcagactagataccagtcgtttcgaccagaagagccaccctcttgctctcatcctggcaccataccatgatgcaggatgttgctccagatactggtcctgaaaagtttcagcttccaagacatctagattgaccaatttcttaggattctttgttggtcttcattcaactttgttcatgagtagcatggcagccatcaaggaagatccatgcttttccttgaacaaaattgattgtagcaatacatgactttcagcatcagaacttcagtgcagagttaactcaaagtacaagtcagcatgctcatcttctgaatctgaatttgccatatcgtctagtaactgatctaatacccaaagcattcatctcctcaaataacgtgggatgctcccctggtagaaagcatgagctcttcccttcacatcgatccgactgcacccaggcgtcttcaccatgccgagttctctcatccttgatctcaaccctgcaacaccatcagattgaccaactgcgtcataaattccacagagggtaacataattgctagcactgccttcttctaactcaaatagcctaaaagctgcaatctctccaacatcgacgttattatgcatagcacatgcagagagcaaagctccccacacgctagcacaaggttccatgggcatcttccttataagcccaacagcttcttcaatggctccagcacgccctaagaggtcaaccatacatgcatagtgctcagcagcagggtggacaccatgaaccttagtcatcgactcgaagatcttccgaccctcggttacaagcccggagtggctgcaacttgacagaactgatgtgaatgtgatccaatttggtttcactccctcagacaacatttccatgtaaaccttcaatgcctgttcccccttgccatgaatgctgtagctatgaatcattgtagaccagctcaccacatccctctgctgcatgccagaaaacactgcttgtgatacattgacccggccgcactttgcatacatgttgatcaaagcgttccccactgcgatatccgaatcaaatgcaaggcacctcaccatcctaccatggatttccctacccttcatcagctccccttccttcgcgcagatattcaacacgctgggcacagcctgcagaccattcaccatgttcaccgcctcaacctgcgctctgctgaaaatctcaaaggtttctactgccctcccagccctcgcataccctgcaaccatgcagttccagacgacagcatccctctccgtcatctcgtcgaacaccctcaccgcatcatccaggaaaccagccttggcatacatatccagaagcgcagcggccacaacaacgttccccatcaagccgagccggacggcgaagccgtggatcaccccgccaagcaccgcgtcggggagctcagcgcaggcacgtaccacggcggggacagagtaaccgtcagggcggagccccgacgcgaggaggcgggagaacacctccatcgcgtcgcggggaggcgacgccgcgaggagcacgttgtacgcgtgcatggacggcgcacgcattccgtcgaacaccctgcgtgcgcgccgacgctcgccgcacttgcagtacatcagcacgaggtcggtctccagggtggcgtcggggagccacccgcccaccaccgccctcgcgtgcgcctgctctcccggccggaccgccccggccgccgcgcatcgccggaggagcccggagaggcggccggccacgggcgccgccattcccaaccaagcagttcgctcaactgcgtcatcgtgtcacatgttttaccatccgtaaagcccaactcggcccggcccaactaaacctttgggctgagagctaggcccaaataagcgtcttactaactatcagcgctagtgcgtgctagtctgctgcgtgaggggggttttagtcccacctcggcggcgcaggcggatggcgagagggagagaggctataaaagggcgggtgggtgggacgaggagggcatgatccttcaggcagttaaagggagatgatgagtggtaacatctcgctaattaatgttgcgagaggggtgtctgccccaaccaagcctgttacgacaacagggcactccaatattttaccatctgatcccgaatctaagtttttaaatcttataatatttttttgttaattctgtaagggtttttttctttatttcgaattgaatttcgtttttgtctaaagtattttaaattttttttgtcttttggacatgtttttgttgtgtcttttgaatttcatttcatttgatgttttatttttatttctatgtatctaattgagggctcaggtttgatttttttgaaaaaaaatgatgatccttaatcctcaaataagaaattttacccaaagatgagacgtttgggagcataagcatattttaacacaatataccacctgaacaacttgaaaatgaggaattttacccaaagatgagaaattttgcactggttttaccgaaagatgagaaattttgcactggccgtacctgttgctgctgatcgacctcatcaggctgccattttatcaagctcgtcatcaataagctgaagctgcaaccctgtgcatatggactattgatggataaggccctcatcaacaagctgctcctccactgtttggtactactcctgaatgttcctgaagctgtggtactctctgctctctactactattgctgctctctgctgctgtgtgctagtgccaagttcagaacttcagataacatcgtacaaccatctacttcctgtacttcttgtgctgatcttgatgtacttcttgcgctgatcttgatgagaacaactgatcctttcctgggaggtggggctttgctttgtacagacattaagttaaatggtcaaaattatcgaactatcagcacttatgcttttgcggtcaattggtcaagcatcacacctcacagatgatcctcctgatgagaaaacagatgcaacaaaggtaaaggcttggaaaattgctgatgatcgtgtgatgggattcatatttatgagcgttgatgtggctattcggataggttttaaggctcacacaagtgctaaggagatgtggaactatctcaaacagagatacactcaagaaagtggagccttacgcttctccttgttgcaaaatctgaacaacttacagcagcaacaaaatcagtccattgaagagttttacaatgtttttactcggttaaccggacaatttgaggtacagattcaaaaagttgtttaaggatgtgcacaatgcaaggcgagagagaagcatgatcaggaaaatttagtactttctccatcctaaaatataagtatttttggaatagtgcaagttaaactttttaaattttaactattaatagccaaaaaaagatcaatcatataaatttgatgtcactagatttatcattaaacaaactatcatactggagcaatatacaactctttttatttaaaacatattacttttataaatattgttggtcaaagatgcatctcgaagactatatcaaagtcaaaaatgcttatattttgggacgaagggagtatatcagtttgccatgcgacttctccctaaatttgaacctaaacgggttcaattgcttgcgcgtagtacacttccaactatgacagaggctcttgcagatctgattgctgaggagacgcgtcttagcaccctagaaattacttccactcattcggttgctcataatgtcctggcagcaactcatcgtgttggagttcctatggggagtgtccctagattcggttacaattatttgctcttattgcaagaaggtcggtcatactttccatgattgctttcatcttcacccaaagaagttggttgattatcaagcgaggcgtgcaatcacttcacgtcctcatgtggctgctagtgttcctggtttctctgactccatagctgctagatctagtatgagtgttgttggtactatctccggtgcagccttatgtgctcctcagctcgcaatagtaggaccatcttatttgagcagtgactggtcatggccttcaccgtattgtttcagatccgccttccatctttaagtaatttgacggtcactatttccccttttgttgccatctgctatttgtctattgcaatgccttttgctagcatagtatcatctacaaatcaatttcctatgttctttatcgagtccactaaagtccatcacatcctttcaattcgtcgaagtaatgtcagtatactagtatctcactagctccatatcggagcaggccatcgtcaccaatcaagggccgaagaacaatttgtaaaggcccttcaacatcatcaccaacatctccgaatcggtgaagagccgcagaacgggttgtgaaggcttcaagattccgagggccgaagaacagtttgtgaaggctccgaggtccacttcattgcggaggggatgctatcttttcttcttcatcatcatccaagatttgcacgctttgacaacatcttcaagcattgactttggttttagtgtaggttaagctatacctttcaaatgcaatgttattgcatacacattgcatttgagcggggatgttaaagggtatatgtgtcttttcatatctcttgtaaacattatatgtggttcttaccgtaagtcaattgtacacagtaaaatccccaaattccacaattatcaactctcactcccgaagtttgtgatatatggaattgctggtgggaatagtgcatgcatcaaaaccatacaattttgctatatatttgtcgacaaattttctcctaaaaatttgatagatgtaattacaatacaattgaagtgttagtacactgtaacttgtatgtaactacaatatcacttgtatgtaactttcacataattttaaaccgttagatttgtttcaagatttgtacaaagtgaggaagggaaaaattcacaccgcacacacatgtgagaggattcgtcaccgaaatagaatgttacagtgtaattacatcacaattgtactataattacatctgtcgacaaatgtattagtgatcccaaaccatatagtattacacaagatccaatccctataaattattacaaaattttaatgtgttcatataaatacaaagaataacattcattgcatgatactatctttgtttattcgttccacccaacccaattttagtgtggttccctggtagcaaaatcactgtttgttgcttcgtagtagtacctattaatctgtggtagcctctctaccaatactggcccaggttatggcgacaaacacatatactttgtcgtgtatcctatcaaagaggcgaaacaaggcaattctccaagttttcttgaacaatacaacacagaaaacaacccagagaccaactgtaaacccggacccaagtccaaagtagaacattagctcatcagaaacatttttgctcatgatttggctgctattctttggtagttcactgcccaagcaattcctttggaggggaggaccatagagaccgttgtttccatcatatatgtgagggttctcggcatagagggtatcgagttggcttcctcgtggaattcttcctgtaagattattgtatgacaagtccaagtagcttagatatgccagattggccaaacttggaggaatttcaccagaaaatttgttccgcgagaggtcaagtgattccaatgaattcatcgccccaatcttctctacgatttctccgctcaattgattccatgataaatttaaactgagcaatcttttaagagaagtgatctcatccggtattccaccagttaaactattgagtgacaagtcgatgcccaccacatcgagaatgctatcaccatattgttgttcttggtgcttcatcacaacagagaaaattcttccaagagacccatccacaacgtcaaaatacgcatgaaaccaatcgatctctattattgtcgattgttttcctatcatcattgttaactttgacaaacaccgtggtattgcaccagatatattgtttgctgctaaactgaagtagtggagatttttaagatttgtgattttgattggaatatgaccgtaaaacatgttgtggctaaggtgtagaaaatgcaagttcaccatatgtccaatccattgtggcaatgttccactgaatttgttccatgatagatccacatagcttaacaaatttgagttgcggagaaatgatgggagtttagcagagaagctattgtgacttaagaggaggaaaatcaacctttgcatctgaaaacacttgggaaaggctccctcaagaaaattgttggacaaatccacgataatcatggactgtgattcacaaactgattctggaattcgaccgataagataattagaggacagaattagtgctagaaggtttggagacccaatatctatgggcaaaggccctgacaacaagtttatggagatatccatgacttcaatttttctatctaatttcggtatttgacccgttagttggttggaacggaggatgagctcacttaagctagagttctctattatgggtataggtccagtcagattattcctagaaaggtcaaggtgacataagctagggatggtatatgcaatatctgatggtataatcccagcaagatggttgtcagaaagatcaagataagacaaacttgtaaaattcccttcttgtgctggtttatctctagtaataccatgtggcaacctgtctaccaaatcctctatgttcccatgagatagactaccacctagacccaagcttttcatagaacagagacttctcatgtccgctagcaacgttgctgcattaccgttatcactaaacccaagccactggagtgccgtgaaacttcctagcgcggtaggaaacggaccatgaagaaatgtttcagagagctcgagggattcgatactcgtcaggttccaaaaccaacatgattggattggatggcccaatctgttcgacgagagatcgagctgcacgagtttcgtgaggtttagttgcgcgagtgcttggggtgtactaggaagtgtgaatttcacaaggttgagaacctccaaagatggaattgtgttcagcagattcaccaagctcatgtcaagatactccaaggatcgcagatgagtaatccatgagatatctgccgagtacatatgttgcatgttaccaaggtccagatgtttcaaccttgtcaggttaccgagctcaggtggaaccctacctgacaaggttgagaaagagagatcaaggtactccaatttggaaaggttgccgagccaaggagacacactaccagagagaaaacacccagagagatcaagatatctcaggttcgtcatagaacccaagaactttgggctactgctgttgatgcccggaaggacgagagcactgaggtcgaggtactcaagatgctcgagagaagccaaggaaggactcatccggccttgcaaaacttggccacccaaagaagcctcagagagttcaagccggatgacattgccggccattcggattcggttgctgctgcaggtgacgccaatccaccggcagcaatctttctcccattgccacgaggcgagggtgttgtcggcgtcgttgatgccacgcatgaaatccagcagcgcgtccctctccttgcacacgcagccatcgccggcatccggtgctcgggttcaccggatgccgtgcgtgggcgatgggagagaagcagaagtagatggtgatgagccgggagaagaagaagaagaagaagaagcaggcagctgagctaaccatggtggtgaacgtactggtaaattgttcatgggttgtgtaatgcctttatataggccagagccagcgtgtgcgcaaggtttgggtcatttggtgctccatttatcttccgcatgagtggtgcaaattaaaggcaaattctcatacacggtgctccaaaactaatgacggtttcgtttccttcgacactaaacaaacagatttgcttgatagcaatcacagcaacaaattaacccatttgtgaccttggagagtgacactcactatgcacagcttcctttggttgctgtgttgaactcgttatggagagacaaaccagcaaaggtatgctgtactccaagaagggaaccatgcataaatattaggagtatatgtccaatttttttttagaatgtttcgtggcatttgctaattagtgtgtatggagtgtgcacgggaaatttatatgcataggatatgttcccgtcataaccatgattgactagtttgaatgaattcaccccatcccttccagttggctgaaaggaactcttaaaaagttatccttggagaagattttcacaatttcccttatgcaatgttcagaagcactatatttgagccatatgctgatctatctttctatatatttctatatagttggtacccactaacaattattagaaggtaaagctcaacatgtaagcataccatatcatcacccactagcaattactattctagcccattttaaatcccatgtaagcatgccacatcttcactcactagcaattactattctaacctattttaaattccatgcaaacatggcacatcatctacaatattatattatagagattaataagtatgtgtcaaatcatcttcctcatattattttctcaacatttcaactttcatcatttcaacaatatttaatatatacttatttatgaattccgcagcaaagcgcggggtattacctagttaatcctatgagtgttaccactatggcagtcagaatagataccaaccgtttcagctaaaagagctacccgcttgcagggttttcaatttcgattttggctaaaatttcagccctttcagtagaatcgaaatgtccgaaattttggtaatttttggagcgaaattttctgaaattttgacacaatttaactgaatttgactaaattcacaaaaaattgagaaaacccgaaaatttgatattgttatggcggggggaggtttgaaattaccgaaatttcaatccctgccctcttgctctccttgccccacagcatgatgcatatatgatgcatgggaagagaatcctctgacatactatgcccaagtgatcactatcatgtgggacccatcaacatcgggctcacatatcagtaaccatgctcctttgagtgtttgactttatattagaggatcgtgttacatgatgcaggatgttgctctagatattggtcctggaatgtttcagctttcaaggtctctagatcgaccagcttctataatcttcattttaatttgttcacgaggagcatgccagcaatcaagaatgatctatgcttttcctagaaccagattcatggtaacaatacacgactttagcatcagaacatcagtgcagagttagctcacagtacacaggtcgccatgctcatcttcagaatctttcgaattgaagattgtgattacattgatgacatgtagtcattttcttttatcttgctcatttgctcattgcgccacgcgatccatttaattaatatgtgaccaggtgtcacacaaatcttcaaggatctaaaacgaattgattcatcatctgaaacaaaatcctctagtgagatgttgtgaactttaaacacaaaagacttggcagaagagcagttttaacaaaagaacacgatattaaacaacttggcactttggcagaagagcaatataacaaaagaatacggcagggcacaggcgtacagccaagtaggaaatactccctctggtttttagatattcctatatgacacaattgaccattttctcatttttattgaccggcatcatttattcaattactccctccgggtcaaaaataattgtcatcttgaaattgtctaaaaataacttcgaccactattttttttacaatatatagaaatatcaacatatgcatgattttattggagtactttttaagattaatgtatatgctctccatgtttgctacacaaatattttagaaatatttatagttaaagttttaaattttgatatcagtcttgttcaaaatgataattatttttaaaccggattaggtgaagtgaaaagaggtaccactatatctatcatctaaagtatgtttaagtgcgccttgtattgtttatctattttcataaatatttctaaaaaacatgaatacgcgaacggatttaaaaagtcatcaatctcgtatatgcttagccctatcttttcatttatgtttatgcttattgaaactgcttatcagcaaccaacaaataatttatgaatgaaacttttatatacatatccttaatgatttaaaagcaaataatataaaataaactacaataaaaaactacaaattaggttttaaaatttaaattttggtttatatgtataagcataagccaaacaatgaggctcatcatctatttgctcatgaaacaaatgaattaaatttcatatgctatgatgtaatttaaaaaaaacaatgaatattatcaaaatatccactgtaaaatgtaaactttcatgttattaaacataggaagtactcaaagttaatttttttcagtgggaggtacatattcatacatattcatcgacaacgagtcgcttgtggcgaattcattaatctcaagacatagtctttgaaaggtgctcatatagataaaatatgcgtgtgtgtattcataaaagtgagtgtgcgcgggcatctgtgtttttactgtgttaataaaaagaacattgtaaatactcactgtaacgtaccaattgatgatagatatactaaaacatcgtagaagtttggcaacccaagtacccaactgtatatgcagcccagaactctcgctgatccagtaatttaggcctttcagctgatcttcccttatcttgacacctgcaggcccgtgtgctatgtctagctggcccatgaaagcacacaaatattaaagcgtatagaacagtaagaatttgactgatataccattggaaaaacatgtcgacaacaagaacgatcttttgttctaaaaaaacaaaaacgatcttttggattaaaaacaaaatgcagttcatcggtagtaatactactgtacgttttcctttttgttatttctgctaatgaggtttcgaatacatattttttcttttattttcctattctttttttaagactatttttcctatgctcatgcagtcatgctttactcattgcgctacacgattcgttcgtgcaaggatccataatccaactgatctgtgatcaggcgaggcgtcgcgcaaatccttgcgagattggttcgtcatgtgaaacaagatcatcatattgggaagctctcggaaatttaaattttaaatttgaataaaaaagatatttaagttcaaataaacatagtcgccgaccgtggggatcgaacccacgaccacgtggttaaaagccacgcgctctaccactgagctaggtcggctcacgctgttccatattgataaactcttataaattcaaacaattgtccagccatttccggtcaggttctcacgattgcatatcgatagcccttgcccccaatttacgcgttgattttctcgcttgtccctaccgtttgacttccggaaagcaaaactgaacttcgtacgcaaaccagccgagagcagtttacagttgactgaacagaagtagtgaaggaccaattactacggcattattgtatattctgacctaccgagtactcctatcccagtttgattatgacataaggttttgaggtcttcccaaagcaattgtcgtctaacaaatgtctatttatttatctgtgtaaagagtaaatgagcattattgaatgtccaataattgggacaattttgtttctgatactttgatgtccaatattgattttacccctattttttagggtttttatttttaccactattttttttaccaaaagagacgtttacccctggtttagactgaagtgagtgggacggggtttatggtagtaaagaaccgggtttatgatagtaaagaaatagataaataaaggaaataaaggttttttgaatttgtataccttttcattacgagaaaaagggtctaagagtgtctatctaagactatccaggtggctgtaacagccctccctccagaaccatgtagccagcccattcgacggacgggtccacttacacataccactccacttacattttcgtcctcgcttcgtgtaaaatagttaacccgagagtggcatggttggagagacaaggccttataagtcggttccacacttgctaaactagcaatgtggtactaaacatgcgcacaagctcacaagggcctcatcctaattgggtcaggatgtcacagccgcacaggcggcggcgagcgggcggtggccaggcgcagctcctcccaccggtgagcagggagcgctctacgcaggctaggcagcggggagagggtaggccgcagcgcgcgggcatcggcttggtggtggcggcgagcaggtggcagccaggtgcagcttctcccgccggggagcagggagcgctgtatgcgggctaggcggcggggagaggggtaggcgacagcacgtgggcatcggctaggcggcagcggcgagcaggtggcggccaggcgcagctcctcccatcggcgagcagagcgcgctctgcgcgggctaggtggcgaggagagggataggcggcggtgagcgggagtcggcaagcgggtgccgaccagtggcaaccccttccgtcggcgagcaagccgcgaccaggtgcagcccctcccgccggcgagcaggaggcgtgcgctaggcggcggcgaggagaggggtaggcgacggcgttgaggggtctaggcggcgactggcagggggcttggaggaggtggccgagattgtgtaaaatgttcttgaaattttttcaaagtttgttcaatttctatcaaaatgctgctgaaattttgtcaaaattccatcaaatttagaatctgtccaaattgttatgttagtcaatataggtcatttaattttaaacatattcacaaaaataaattttcaaagccatgcataaaatagagaaaaacacaattcatgaatagagataggagagggtataaatatctttttgccatgtagttaataccgtgaacttctctattcaaaacaaaacaggggtaaaaatattgttcggttcaaaaaagtatgggcaaaaacgaaaaccctaaaaagtaagagtaaaatcaatattggacattaaagtggggtagaaaaaaaattgccctaatttaattcgtattagtacaactacctaatatatttaaaatttgatgcaacccatgaaatacgaagcaacgtgttactttaaccgatgagaattaattacggaatgatgaatttttagttgtccttggtccctgcgctctttgtctaggtgatgacaaaaatagaatgaagatagtacatatgtacgatgctcaaatacaaaagtgatcaaatattacaagtatttttttttctgagaatcatatttacaagctggaagtcaactgtgatgcttccaactaagttagacccatccaattaatacagtgtgcatgcttgctcgccatgctatatgttaggtcagccgtcttcttggaccgtccagtggagaattgtgattttctatacacatgctagaattgtcggtggcaccaaataatggatccttagagggtcaagagtgcatgcggcgtgtataatcctaaacaatatataggcttatctagatctaaaaaaatttggccaaaaacatcacattaaatgtttggatgcatgcatggggtattaaatgtgggaaaaaaaccaattgcacagtttgtacgtaaattgcgagacgaatattttgagcctaattacgccatgatttaacaatatgatgctacattaaacatttgttaataacggattaattaggtttaatacttacagtttacaggtgtaatctgtaatttattttattattaatttatgtttaatatttcaaatgtgcatacgtatacttttcagtttcaacaactagtaccttagttcaaggatatgagctgttttacccgtatgctatatcgacttgctttctataacatagggacgtacattggaaaaaaaaaaggtgtatagatacaaccataaactttcaataataataaatttatcgtctaaaagttattaataaccaaagttgaaacattgatggttaaaaatttatggttaaaagtgataataaataaattaaagagaactggggagtatatgttttttcttaaaattggtggatatatatcaggataaatctaggatttcaaccgtaatgaacatggttaacatatataaatgcacctagccatctggtcacacatgcctactgtatccccttcggcacttcggattttcttgatcagtactactattccgtagcaagcaggcccttagtaagcaaaacggtatatttacaaatgaaaaataatttacgaataaaacttttatatacatgttcttagtgatataaaaataaaggttaaaaaataaacttcaatgaaaaccctccaaaatcaacttcaaatttaaggtttaaaatttaaattttggctaataagtataagtgaaaagatgagactcttagatagactgtcatgcatatttagacaagctaactgcactgtatacgcgtgccataaatgtgtcaacttgatcacaaggtactttcagtcagtcatgcctggtttagttttccaaatttttttttctaaaaacatcgtatcgaatctttgaacatatgtatgaagtatttaatatagctaaaaacaaaaactaattgcacattttagatggaaatcgcgaggagaatcttctgggctgagcctaattagttcatgattagccataaatgctaccataacccatatgtactaatgatggcttaattaggctcaaaagattcgtctagcggttttcagtgatttataaaattagtttttttatttttgtctaaaacccctttcaacatctgatcaaacatccgatgttcgatatgacacctaaaaatttttcttttcgcgaattgaacccaccctcagtcaagcaatcctgcagcaaatctgcgttacagctggctcctcctcgtcgtctacggcgccggcctgagtgcggtttatataatcatctcatcctcctctcgtctcctgcgatagattgagcctgatctctcctcctctctagcctctcgagaagctaggcgatcgtcaaatatatctccaggtggaccaggttagtgctaattaatcatcaattgattagttactgcttccagtgaaaggcatgcaatttgttcaattgctcctagcttgggtttttttatctagatttaggagcctaattaagttaagtcgtatgcttcacgatcgatgaacttggccattaattatcatggttactgatggtattctcaattgatggatagacaagcttgatctattggtcttttctttttctttttgagtctttatatacggtgctctctactatagtagtagaaacgatctacaccgtcaatttgtgagggtatgatagtacttcccatatcatcgttcattagttatttttctcctttctaaaacagagtccatcacaaccgaatcgatctcacatttgcaagcctcgtatgatacgtccatcattgctccattggcacattcacatacaacccttccgttggcccatagagagcactgtagagactgttttttttccctttcattttgccttttaatacaaagcctaagattttctccactagtatactcactcgaattttcacacacggccttggctatgagttcagatgaaagttgttggggtaacaaaactaggtaaaaactcattcaatttttctccaaatgatgcacatctgagggcttgttttgaactttctctctgtattaatttcattcacatttagtctataccctaatccaggatttgagaaatttcagttaagatttaaagtgctactattaactccagtctttcttatagaacgagtaaattattagggaaattttatagcacttgacaaactatctgtaagtaccaaagttttgttattttgagatacctcataggtgtaggtatcaagttttatactataaaatgtggcacctcctgataccttctcaaggatgctaaacttgtctaattattagtctttattctaaaaaacttattactatttattctcatcatacagaagagagattggtaacacggacaagttacaaattcacctatgaatccaactaatgtaccataccaattgttaaaagaaattacagatggattctctgaggagcgaaagcttggtaaaggtggatatggaacagtttataaggtaagttaaagtcaactttggtatgtaaaccaacttattgtaataatgggcgaaaccaatgtagtgggttctaatttctaaataagaataagcctgcactgcatgttttgcacaaataacactgaggtgagcaatcaaccatgcaccactttttattgttgcaaataaaacttacttctagtaaa

SEQ ID NO: 19533 - DNA, 18477 bp, Oryza sativa
ccgcttggatgcattcccttgactcctccctgttttcctgagaccaagtttcaagttcgaaatccaaattcaatttccaaatctcgtttcctccccggcgccgaatcccgccgcccccactttgaccgtgccggcccgcgctccgcgttcaaattcgaccgcttgatccaccgacctcgccgcccaacgcatcctcgccgttgccgttttcgggtcgcccacgaaaccatcgccccaccgccagccgagcgccagctcgtctgtgatctcccccttgcctataaatcctacccaccgagccccaaatcctccctcaacctcggtcgccgtcgcgcggccaaccccggagcaccgccgcctccttcgtcgccacggccaagaacgccgcgccgtcaccaaaccgtcccaccccgcgtcccttccttccctggtgcgcccgcttcggcgtcacgttcgtccccgtgcgccgccaacggccttcctccccttcccatcctcaaatcgccgccgacgccattcctcgccgattggtgagctcctcgtccccttccccttaaaggacgccgaaccagctcgctgtcgccctcccggaactcctcgcgccccctctctgtttccccggccgtgcccctctcggtgcaatgaccgccccgccgtgctctgttcccgccgccgccgcgctcggctgagcgccgccgttggcctccttttcgggactccccgcgccaccacccgccttgagctcccttgacccaccccaaacagtcgctctgcccgattcgccgccgccacgcatgaccgcgcgccgccgtgggcttcgcggccaacgccaacgggctttcttccattcccatcctcaaatgcccgccgacaccattccttaccgaatgggagccccccgtcccctttcccttaccgaacgccgaaccaactcgctgtccccctgccggacactcgcgggccccctttttggtttcccgggcatgccactcttgatgctatgaaccaccccgccatcccctcgccgtatcctctcgtctccaccctcctggagccccctcgactctccccgaaccgccgccctagccgccggccttctttcttgttcccacgtcgtgccgcccgattcaccaccgcgggacacgggcgcgctctgccgtcgggtcccccctttttttcgaacccgcttggcaacacctttcttgggccccttttgacctccccttggtggcccgtggccaccggcctcccttccagctctcgcgccgcgccgcccttttggttgccgcgccgcgccgccgaacgagcaacaccggcgaccataagcctccgcgcccaacgcgtgtgcgtggcaacaccacaccgattcgatcgaaccatagcccgagcccctttttccctcccatcgcgtatccacgtcggcaatccggcgagcttcgccaccgtcgccggccgccgtcgcgccccttctctccggtccgatccgtggaaccgattccccgcttcctcctctcgcttccagtgcctgccgcccactccgattcgccgccgttcgctggagcgcaccgagcgccgttggccatccgatgagccgcccggcctcctctcccttccctgtccgacgtggcgtccacctggacgccacctcagccgctgaccccaccagaccaagtcaacccctgcctagtcagccacccccccccccttctctctccccgctcgtgggcctggcccatcgaccagctcccccttctcggcccattgaaacaaaggaagtccatttttactccctccgccaaacacaatgaccaaaagtctatatctgctccctcccaattcacctctctctcaccatatgttggccccacatgtcaatgagtgataaaaggatattcttgagaatattcatttccataaatgcaataaatcatatctcctgctccataaaacatttcctatattccaaattccataaaatccttcctcttaatctggggattccaataattcaacccattggtcctgcatgtcagtgactgtcaataatattcttgagaatattatttctataaattctataagccatttctcgtactccaaaaaatccaatagatcatttccttgtccagaaatccaattaagcttccaaaatccatatctcctcaaccgctcgaccgattgactccgttctacttccagtagttccgtaaaattgatatcaatttaatggcactattaattagtctaaataggatctttctttcagtcttttggttaggtttttgattgtttgcgtatagttgcggttaccggattttcgtcaagcggatttcttgaagattcgtgaagatcaagaccctgagcaaggcaagccacctttgaacatattgagcctatatttgaacttaattaatttgcttgaaaaatattatgcattgataggattgcacttaatctatttgccccgtctgcaaggcagaccggtgggcctacccaacttgttgcatctgatccttccattgttaattgttatatcatgttcccttgtaactatctagttgcgcctcgatattcgtgcactctgtgcgagtatcgacggtctccttcaaacttaaaatctgtgtaacttcttgggtaaaacttggtttacaaaagctttggaaaacccgacgcctgggtcggtgccttgtgaaagaaaatgagttttaaaaataaaatttgcgacacaaggccattcctgggcggaatacttgtgcggtcgcatctaaggaccgattcctttggaattacatccgagcatacaatagtgcgaccacacgggtggaatgggacgcccctggctgagtaaatagctaatcaagggagccttgatgccaagagacatgtggattcaacggggtggtgtcggggagaacccccgggcttcctggcacagtatggtctgggacctaacctgttgttggtctgggactcctctcattggcatatggtaaccctgtgtcggctttcgaaataccttgtcgtgaaagccccaaagtcaccagacgtggctgttctgcacgggctgggtgaccaaggctagtaacgtcgtgtgggtatagtgtaccccctctacagaggttattaaactgttcgaacagccgtgcccacggtcatgggcgaatgtgaggtgattccttagcgtagtttttgttttaccctgttttatgaaaaggtgttaaggtttgggaaacctaatgcttgggaagcaattagctgtccgggggacagtgggaccggaagtccctggaagtgattggtcgtttggggaccactattattgggaagtttggaaaaatggtttggtttgggaaaaccagctttgaggccaactctgggagttgtgaaaatcttgataaataaatttgttacttctcaccccgactgagctgagacttgtctcgctctggttgtggaaagcacacacttagattgttgaaaaccttgaaaacaaaactgattgaaaaataacaacctattctttgaaacttgcattaaccacctaagttcccctggcttgctgagtacgtaagtactcacccttgctctctatataaatatagttctgccagctctgaagatgaagttgaagtgaagtgaagattagggtttcgtcctagaccccagccgtcgcctgtggtgttgggggttagtccgttgtttccgttgctgctgccgctgttggtgttgcctcgtccgtgtcgtcggttgtaatctcgggctgtcctgagttgcaacctaagttaaggtaaataagtcctctatttattctaaggattgcaatgattcatatttgtcaccgtgggtaccagcgctatgtcctgggactagtactgagatcgcggtttcgtaggaagcggttcgcgccgtttttcctacgacacgctcctatcaggtgccgttgtacggcgatgccggattggggtgtgacacatagcaactcctatgccccgcagccgttgccgccgcccccgctcccacccccggggttcgtcctcgctgttgctgatgccctccctacctcccatcagcattgccatccctaccgccaaccgccggatgcaccatcgctgcccacccaaccaccggatccattgccgccaagctctccaccgtcctccccaccaccggatccgccgctccctgctcctgtatgccgccggatccctctggtgctggccactcccgctcgtccgcccacttgccaccatcgttgtcgtcgtagccatcgccactatcatcgtggccgcggtggaggaagggggaggggggaggggatggccgcttgaggagggggcgagaagatatgaggagaagataagggagtggagtggagtgtggagaagttaggaaatgagatattttaagaggagagaataaagagagggaggggacgggtaaacggcttggtgccaggcgggcctattaagaagcctgcctacgaaaattgttttttcgcatgtggtctttgaaccacgctctcggggcagcgatttttgcaggcgggagcagtttaatttgccagcaacctcaaggggtctcatccgaaaaaatcgtttctatagtagcggtaattaatttagaaatatcttaatgtaaaatgtagtttgtgcgctgctgcctttaattgtccatgagaagacgcgttccaggcacgaacgtgaccggaacacacgacgctcacgctgcaaacatgcagacgtgctcatgcaaaaaatcgaaaatagacgagctacagtacagtacaatacatcacaggacgctggttacaactttaagcaagaacacatgaaatgaaaaggcataggcatgcaggagaggcgcgcgcgttctagctgtacgtagtgtgtcaggctgctagctagtgctgcaggtagacgtggatctcgacgacgccgccggcggcgaggctgtagtcgtagctgctgctggccatgtacccgcgcgcgagccggaaccggccggtgccgccgacgaccaccgactcgcgcacgccgacgccgacgtcgatccggcccttgatcgccaccgagctgccgcggtgctcgccggcctccatcaccaggtgcatgctcaggtccgtcaccaacccgccctccgacacccgcaccccgaacccctgcgccgtgcccacgcgcgcgctgccggcgtccggcccctccgtcagcgcgttgttcagcaccacgatgtccccgaactgccgcggcggcgacgagccgtcgacgatgtcggtggtggactgcagcaaggagcggccggagacgacgcgcatggcggtgggagccgggccggtgtaggcgtcgtgcatgtagaagtggaggtgggtggtggtggtggtggtggcggcggcgctgtcatggcggcgaaggaggacggcggccgcgatgaggaaggagcagccgaggaggagggaaggagacagggaggatgacgccgccatgatcgacgttatcgagcttgctttgtgtgtggttgctactggcaggcagccctcatatatacacacactatgtacgtactggtttatgatttgttagaatctagttttaaacttaaccaaattgatatttttttctccttgttttaaacgtgggtttatttattaagatactgactagaccacctttcttttgtttcgctttgttccagttgctttcgatccagtactacctccgtttcatttcaggttataaaactttctagcattgcccatatttatatagatgttaatgaatctagacacatatatatgtatgtgtagattcattaacacacacacacacacacatatatatatatatatatatatatatatatatatatatatatatatatatatatatatatatatggataatagtagaatatcttataatattaaacagaggaagtattagctaagtgcaaggaaatatagggtctgtttggggagcttaagattctgcgaagtagctggtcggtagccagcttatgagaatctggaaaagctgggtttcccagcttatagcttctaggctgtgtttagttcacactaaaattgaaagtttggatgaaattgtaacaatgtgatggaaaagttggaagtttgtgtgtgtaagaaagttttgatgtgatggaaaagttgaaagtttgaagaaaaactttggaactaaacatggccctagtttattttctggtttatacaattacagcttctcaaaatctagaccaaaagctgaactgtttgggggagcttctgattctggaagaaactgcagcagctagaagctctctcaaacagggtcaatccttgcatataatttttttactcctttcttgtcattttcgaaaagaaaaacttcgctttagttagtactactctattggttcttttgacgccgtcaatttttatatgcgttttaaccatttatcgtatttaaaaatcttatacaattatgcaaaaatagaagtcttaaatgataaaattaatcacaataaaacaaataataaaataaatgatattatagcatttttaataaaataaatgttttacatatgttaagtcaatgatgctaaagagatactatacacaagcatgatgtgtgggagtggtaataatatttaacaatgaaacatagagaggcgtttttaagggtggcatttctggttgtgtgcgagtccctcccgtaggggtgaaaatggagcggattcggacggatagtggtcataccatatcctaaatcattgaagttaaactttatccaccttacattacccagtgcaacacacaggcattgtgcttgtttaaagaaaaaaggaattagcaacatctatattagataagtttcattaaatttaacattgaatatattttgatgcaatatttgttttatattgaaatgttaccatattttgctataaatttggtcaaaattttaaaagtttgactaaaaaaagtcaaacgacttctaatataaaacggagggagtatgatttttcacatgcaggtctatttttaagatgtggtgcttttaacataaccgcctacgaaaatcgcaacaaaatataaaataatgggccgggtgatgggagtggcaaaactctcgcttaattatcctctcccccgtcccctcttaccctccatctccagtacagcgtggtagcgtgggaagcgggcttcggatccagtggagctcgatgaggagtacctctgtgatggcctccatcgcttctctccccctcccttgtgttgggattgctcactcacagctacaagtgttaatcacaaacacttttgtctctctggtgggaaatcacttcctctctctctctctctctaccgtatttttgccacaaaggcttctcaggtagacacacacaagcagcacaagatgcaagtttctgttgattcaaccacccacggcctcatcatttttctcattatatatagactcaaattacatgcaaaggataacaaccagccaattctcttgaccgggactcacgccatgcactaacaaactaaccctctatgcaaggctgcatgtacacctacatgcaagctaacaaccagaacgtgcatctatccactattgcgtgcatgctgcgtttccacgccaacgaatgacacagccatctcggccacttcgcgatgtcatggcgcacgacgttctcctgcagcatctcacgtacccgccgtctcgcacggcttctcggccgcgtacgcatctcgcatacaaccataagcttcttcgggtaccatatcctgctacctatacatttattttctacatgcgaccaaagtaaacatgctaatgctaatgacaagattatttgtaacaccttgctcctggcagctacaacgatgggcatcaagcaacatcacagtggtggtgccggatccagcaaagctcgatttggaggacctcctgcgatggcctacatatcgcctctcctccttcctcacttcagatgattgtgatggcaggctctggacggtggcagcgacgcaatactagaaaaagcatttttcccaatataggggtcttttttttcgcaggcagacatgagtctgggaatcaaatgactgcctacaagaatataaatcagggtgaagttcgctgtctgtctgcgaaagtctattttcacaggcggattacttaagcggcgcctatgaaaatcattttcacaattttcacaggcggaccacctaagccgcgcctacgaaaatagattttcgcaggcgcactttatgtggtccgcctacaaaaatcgtacataccaagaaaacttcaatccttatctactactccaacccttccctatcactcatttctatcttctcaactctctccctccaccaccggcttctcagctccgccatcccctcccctcccatcccatctctccctccctccaccggcggcggcggcgcgcggacgcggcggcggctccccggcttcccctcctagatccagccggagggaggccggggaagggcagcggcggcggcgacgacgtggttccccggcctcccctcccagatccggccggagggaggccgggagagggcagcagcggcgtgcgcgacgcggcggcgacccggtgcggcggccgcagctccccggcctcccctcccagatccggccggagggaggtcggggggagggcgacggcggcggcggcggcgaggcgattttttttgtttttttattggattttcgcaggcgggccatttgcccgcttgcgaaaatagatgattttcaccatcgtccgtctgcaggcggtcctccccttcgcctgcaaaaattgcttttggccgcttgcaaaaatgctttttctagtagcgacgggctttgatcgtgtttgatctgatgaaggtggactttaggtgcactggatctggcggagcttgacgtggaacgcctctagtagagataatacggtgagatctggtggacttaagatgcaatagagcaatgtcttccggcagcgacgatgtgtcaggcgtcgaggaggtttgtggtcggatctagagtttctagaatactttttttatttttgtcccacaattgattttgtcatgaatgttaagaaaatagaagcacaacggagacacaaattttacataaaaaacccttgagggaaaaactacgggcaccgaccggcaattatcagtataaaggagttggatacaaatgcagaggatacattgggttgtctaccatttgttagaaaatagatgcacaacaaagacacgaattttacgtagaaaactcttgcaggaaaagaccacggacgccgaccggcaataatcactatatagtagttggatacaaacatagggttgtcacaccctccctgtgcggcttacaacagatatatatagctaggagtcctcatgggcaaagagtcgaagtcttaatgggaaactaatcctattaagaaactaatccgaatatattgtgtgcctaaaattcggatcacatatttaacaattgtgtcgtccaccgggattttcacagacacatctagatccctatggttgctctagctgcctgtgaaaagtcatattagcaatttaattagaaaaagcttcgtgtgtttatttattacgagaatgcttaattacgggcgaccggcgctggggagccggatcgggcgctccccccgcgcgcccctacccggcccacccacccacttctctctccccttttttttcataaaagatgtttcacctagtgtacttacaatgtttcactattatagatctaatgttgcagtgaattaaaatactcttttgcaaaaaaaaaacccacatattttggaacctttattaagggaatttggtttattttttgttccaccaaaaatattttacctattgtacttataatgtttcactatgtatagatctaatgttgcagtgaacgaaacattctattgcaacaaaaaaacccacatattttagaaaccccatattaagggaatttggtttattttttgttccgccaaaaaatgtttcacctaatgtactcacaatgtttcactatgtatagatctaatgttacagtaaactgaaacattctttcgctatttgctgaaacattatttttatataaggtgaaacaacacccgatttaaatgagtgaaacattttcgatctacttagtgaaacaattccgatatacctggtggaacatcgtgtaacatttaaagataattcaataataagctaaatttttttcgtcggaatatatctatgtgtggtcttgttttgaatatttaattgcaacgaatttaatggtgcaatcggatcatgatttggataagtaatttaagagaaaaatcagtttaaagtagttttgcacataaatcagacgctgacgtcatgctgatgtcagcgcccgattttaacctcctcccatcgggcgcccgagcgggagtcacgtcctatttattacggtgtgtatatatagtatagactagactaccatttgtttgttttgctttcaactagtggctaatatctaaggccctgtttagttcacaccaaacttctcccaactcccaactttccatcacttcacattctccccactcccaactttccatcacatcacatcacatccaaaactttcttacatacataaattctcaattttttttccaaactaccaactttccccaaacttctccccaatttcaaaaactaaacatgacgaaatataagccataccggaccaatccttatatacaactgggaggccaactggtcatttgctttcagctagtggctaatagctaagtacgacgaaatataagccataccggaccaatccttacatacaactggaggccaactggccaagtggttaatatcaattattccatcctggtcctttcttgaatggtcattcttgaaaaaaaatatctttactctaattataatattacactattatgcttgtttgcgagccagagaggccttttgtggcttaatttgtcgtcctccaaagtcccttatctcctgagttatgggtctatatatttctgtctgaacagtcctaaattttcttttagaaaaattcttcctccgccatattctagtaactacatcagttattcatcaaactttcatcactatgtctatgcataagtatttagaaacatgctatattacaagagttgctacattattaatataaccatttaacctctctgtttttattacaacctaatcatttatatatcggaaatgctataggacggtattccatttgaacgggatgatatctctgagatatcatgtcgtgatatctaatcggtatcaagatacctaaccggtaccatactattcaaaccagatatcgttgtagcaacccctttataaaatcagcacttatcaaagttttgtaccatatggccagcgatgaaaagtaaacagaaatggcgactcttatgacatggaatttttaaggggattggatcataaaaagaagggaaaattagaaccatgccattataattttacaaaatttgagatatatcatcctgacccacatgtcattgactcatacgggtcctaaatgtcattgagatatcgatagcatatctcaaactttacaaaattataatggcatgcttctaaattaccaaaaaaaaatggtgcatctacggtgcaaacaggctcgatttatggtagccttgtcctggatagctgacacatatggaaaccacacatttgatacagctccaagtgaacgggatgaggacccacgtggcttgactcgacttttttaacccgcttttcaacatatgtgttttcaagggaaaaagaaaagcatgtgtgcatgtttcttttgaagaacaatcaatccctcccctggctagtggataggaaattcgtctaaactatagctatttgcctatttatttagacatttttttccaagcaaagctagagttttgcatttaatgaaattacccgataattaataccccttttttaaaaaaataaactctctccatcttataaaaaaaacaacttctatggatgggaatatggataaaagcttgttcatatccatcctcataagttgatttaattttagatagagtacgtggctgtcaccgattcctaaagtggataaatccgagcacatgtttaaacatatgtttgaatattctgataggcatataagcctaccacctgtactgccgtagtacacgacaaggacattgcctcttgtgattgaggtgagttagtatgacaaaaatataatatttatgatatttattaataaatagctagctcgtgcagctcatggatataactctcctaatgatgtcagccttaggaaataccgatagaagggaaatggcaaatgtaaaataaatatggttagagcatctctagcagtgtcgctaaacacaaccctcaaaactattcaagggtgaacataaaaaaaatacggaagaaatttctgcgcttcccaattttttctcagctcgtgttgttctctcggtctcgagccgtcttcctctgcccggcgctcctccctcaggatgggaatggttaggttctggattgaacctaaaccatttcatgtgacaacgctaatccatggtttaataggggcaacccttaatgattctattaaatgaataggttatccaatagagcaaaaggttaaccgattgaacctagcacacaaccacacatatacaaggcaatacatcacaggattacatatctgcaaagcataacagggttacatatatgcaaagcagtacatcacaaggctaattacacagccaattcaccgtaaaagagcagagctgcagtaagttcacaataaaaaataattggaaatgcgtactccagtactccaccattaaccacaagaacatgatagcgtatcatttattacaatgtgcctaagtcaaaagaagatgcacagctaacatcatttcatacaaaagtatcatattgcattgatctggcattcaccaataggacattctctccaaaaacagcccccaccatcttcaacacacctttcatgtcctagcttccctaaagaaatgtaatataggtattattattcacagttatatcatgtcctagcttccctaaagaaatgtaatataggtattattattcacagttatatcatgtcctagcttccctaaagaaatgtaatataggtattattattcacagctatatatctctaataatagctactccctcagtttcatattgtaagaccttccagtattgctcatatttatatagatgttagtctacattaatataaatgttaataaatctagaagaagtacatatatttgaactgaacattttttttctcctcgagaggatgtcccccgcaatgaggtgctagttatcattttaaaaaacggtaagatgctaattgctttccatgaaccaacatatccaaactcctcataagtaccaacatcagttaggcatcacaaaagcggcactaataacatattgttagtgccagtacgttctacaactggcatatttagtccctcgtatatgttggttcttgtttagacccggcatgaggctcaccagggacgagttagcatgttcccatccggccaggctgtgttcgctagagcaagttcccatccgaaataatgcgcacagaaaatggaacggtctattaatggattagcgcgtgattaattaagtattagctgaatatttttcaaaaatggatcgatatgattttttaagcaactttcgtatagaaacatttttgaaaaaaacacaccgtttagcagtttgaaaagcatgcgcgcggaaaacgaggggatgaattgggaaacttgggttaaaaacaacaatcagcatatatgagtccattatttgtgctgattgtatgtaacaaccggcacatatgaggctcaccttacattccaattcttatattacgccaacatttgctgactatatataagtaaagtaagagagttaattagtaattaattctcatgctaaatattttatattgcaattaaccgttatacatatatagggccatataggccataaataaataaatagtattccctccattttatattataagttatttcagtttttgttattcaaattgttttagatttgaccaagttacggaaaaaaaaactagcaacatttataacatcaaatttatttcatttaatttagtattgaacatattttgataatatgtttgttttgttttaaaaatgttagtgtatttttatattaatttggtcaaacataagaaagtttaactatgaaaaaagtcaaatgacttataatatgaaatggagggagtagttagttaatcttgcataatctcctctcgatgcattactaacttctcgaacacttgaaaattgaaatgatgcataaaacacgtatactcaaataactactccaatagctaggcatgcgcagttgatcgatcgatgcagccgtccatgctagtgctagctgcaggtagacgtggatctcgacgccgccgccggtggcgaggctgtagtcgtagctcactagtacaaaaaaacatcaaaggtgccggttcccagctggctatagaaaactggcacctattaatcggtaccaatacaagcaaccggcccctataaaaaatataaacggcacctataactttgcacgatccaaaaaaaaaaagagccggctcgaatcgagctgaattcacaagccttcactgcgccatgcccccacgtcttgtttgaaatccccaaatcccccacatcacagatcacagatcatccataaatcatccacaaatcatagatcgaaacatattcaataagaaaatcatccacaaatcacaaaaacatcttaaaagaatctacaaaatcattcaaaaaaatttgcgcgcggccgcctgccaccgccgcctgccacctcccctcccaccggatccgacagaggggagtgcgcggccaccgccgccgccgccgcctccgccggaccgccgccagccgttgttgccgcctccaccgggccaccgccgaggtcggccgcctcccctccggctggattcggcggaggggagggcgcggccgccacaagccgctgccgcctccaccgggccaccaccgaggtccgccgcctcccctccagccggatctggcggaggggagggcatgtccgtcgccagccgctgccgccacaaccgggtgaccgccactgctgcctccgccgagccgccgtcgccaccgccaccgccgctcccacttccgccgggccaccgtcgagctgccgtcgagacgagagagagcgatagagggaggcgaaagagagagaacgatagagggagagcaagagagagacagagagagcgagaacgatagataaggacgggcggaccgagagatgggtggaccgagatatggataaggccggctcggtggctcggctcggctaaggataggtgccggttttttaagaaaaccgtctcggctcattataggtgccagttttttaataaaaccgacacctattaacctataataggtgtcggttttatttaaaaaactgacaccaatagtataggtgtcggtttctctttaaaaccgacacctataatggtttaaaggtgtcggttttatgtgtttttagcctgcgggagagggtaaaacactatacgtaccggttttaattgttccagcacctataatgccgatctctatgagcttttttgtagtagtggttcttcgtgaccatgtacccacgcgcgaaccggaaccgccccgtgccaccgatcaccaccgactcgcgctcaccggcgtccatgtcgatgcgccccttcgccgtcaccgagctgccgcggtgctcgccggcctccagcaccacgtgcaggctcacgtccgtcaccatgccgccctctgacacccgcaccgcgaacccctacgccgtgcccatgcgcgcactgttggcggatggcccctccgtcagcgcgctgtttagcaccacgatgtcgccgaactgccgccgcggcggcgaggacgacgacggcggcgatgtggcatcattgttgttgccgtcgccgtcgtcgagcaaggaacggccggagacgacgcgcatggtggtgggagccgggccggtgtacgtgtcgtgcatgtagaagtggaggtgggtagtggtggtggtggtggtggaggcgccgatgtggtggcggaggaagacggcgaccgcgaggatgagggaggagctgaggaggagggagcatagggaagccatggcctggtcgagcctgctgtgggctatgacagctgcttgctttgtttgtgttgttgcagctggcatgtatttatggatgtgacgagactgtgagcgctagtatgttataaaagttagttgatattgcggaacgactaaccttctcgatcgcttcgatcatttatcacccaaaacatatcagataatgatacaggaatatacgatatttgttaacgaagtttagctaaagtcctatatcttcggggctttgattatgggcgctcctttccaaccaatatagctcctagctactaagtacgatttccgacaaactcacctttcactccgtttattcgccacagttatataacttttttatcaaacatgtaggacaattgcgtatcattgcattacagaagaaccggtgattatatgtgcatccttgataaaaaaaaaacaaaacacggccacgaccttacctaaccatcttctagtgcaacaacgatgaggtaagaaatgccttaagcctttggccatgcccaacaaagcaactcctcactagtatacgataaagctccagcaaggttaattaggataagcatcttcaaatacacatcgattatgatgcttccaaattaaccaaggtcctagaatgatcagagagttaaggcctttttttcgaacttaaccatcaaccaaaccatccatcgtagctcaccaatccctcaaaagaggcttcattacatgaattgtgtaaatggttgatcgatcgtctccctagtctgatcacaatgagtgcattggacaaggtgtgtgacttcaacttgcaagaaagtcagctgtccagaacctattgtgttttgtatacaaccaaccacatgaaaaaacttcatttgcagggcctagcgcatgtattccaaaatacgttcccattgcagcctaaaaaaattagatccaaagaaaaggccctcacactactggaaaaatcatctttggtcggtcgaccaaattccacaatagtcccggatgtaataaaaaccgggactaaagaacatctttagttccggttcaaaaggttagagctactttttgatttttagtcccggttggtaacaccaaccgaaccgggactaaagatcatttttagtcccggttcaaaaaaacggcaggtggtgtcagacccctcctttatctttaatccttggtgttaccaaccgggactaaagatctatttatagtcccggttggtaacaccaaccgggataaaagaacaatatgatccggttggtgttccaaccgggagaaaagagcgacatgcacggagaggcatggtgtcaaaccccctcttttatatttagtcccgtgtcaccaaccgggactaaagataaatttctagtcctggttggtattaccaaccgggaaaaaagatcgacaggatcagttaataagttcaaacctttatctcatcctctcctcactcagatccatctcttcctcttccttctcccatctcttcctctacctcctctatatccgccccatcccctcccctcccctccccacttctcaggcggcggccggacgggaggcgcctcctcctcccatctcttcctctacctcctctcctctgtatccgccccatcccctcccctccccacttcttaggcggcggcttccggatgagagacgccctcacacggctgccgggaggcggcggagccggcctcgcacaccggtggtgaggcaatgcgcgaggcacgaggcggggccgcggacgaggtggcaggcgctacctgtggcaagcagcggcgggcggcaccgcgccggatctcctctccttttttttataatttgtgattgagagatgtttaatttcttttttaaaattgtgattcattgcatagatctgagatgtataatcgatctgtgatgcatttgatttgtgtgtaattttttttaagatttgtgatgtatttgatttgtgtgtaagtaacttaggatttgtatttgtgatgttaatgatttgggatgttaatttaatttggggatttgggtatatgtatgacactcgatttgagggtttggtgtttgatctggtatatacatcttactcgatttgggagaaaataaaaagaaaatggaccaactgggactgcccctatcctctctttagtcccggt

SEQ ID NO: 19534 - DNA, 8385 bp, Oryza sativa
ccaaccaggactacgaatcctggaccaaagatcgccatcagtcgtctcgggccacataaccgggactaaagatcaatctttactcccggttattttacccgagactaatgatagcgatctttagtcctggattcgtagtcctggttggaaaaccgggactacagagggttataaactgggagtaaagacggattctccaccagtgtcataaacactttttgctgaatattgtctagaggttgagaggggtcaaatatgagaatcctccacaaccggctgaagaatcacatgtgcaataatgtcccataattcaaggtactcagcaaagacacccaccgtgagaacatacaaaatggtcctttgttggctcttgttttgggtaccatggcaaacaattagggtgcaagatcagcaatgtgctgtctatgaagccatttatcagtccaaaacaaggtgctaccatcatcacccaccttagagaaaaccgcgatagtgaaaaaaaaataacgagcacaccggttgacctgaatagggaaagctttttttttttgcatccattaattccaccgcatccaaagctccaaggttttgaagttctgagaaccagcccggcaaaaactttagtccaagccacaagacaatgaccgcttttcgcgtccttccatcctctccaaaggaaacttcatcatatctcatcgattgccttaatggcccatgatggaatgtccatagccatacaaagataaaccacacaaagatgtgagcacaaattgaaccaaaattctccgattggcccgtgctagaagatccacttttcatcctagatgttgatccactaatttgtcaataataggctgaactttgttgacaaccgaatttggtaaattgtgaaccaggttagacattgggatcaaggcggattcgagaaagagatcgattcaaagaacagagtgtgcttcggctgagatggatcggacagaggacagccgatacagcgaatggacgtgatgcagccgattccgatgacgatggtatcaaaggtgtttctagagtcgtttgaagtgcttcataaggattgctacaatggagataaagctctcggatatgcagttgtatctattaattaggatatttcatgtaattttcttagagatatgtttgggcaaaagtctgccgcaaagacttatagtatcttagagtttgttagaggtaagtattgtgtccggcaaggacatattttgtaatctcgggtataaatagaacccgaacccatgtaatcaaacaacaatcgttcaatacaatctcggcgcatcgccaccttttttactttcatttatttcgacgaatgtgctttcgggttgagctgcatcgattccgatcttcaactagaggtaaaacttgttatggcggcttgtgttctcggggttaatgcttccatctttatgacactttaaccctgtttatgtaattcgtcgagttatcatatacacgacacaatctatgttagttgcactttataacttgtcatcggctagttcttattgttagaaagcaatcggtagagttatgttttgttattaatctagattgtatcttgtatctactatctcttgcaggttttcatcatctcgcctagatctcatacttgtatttatgcttaatgctgtatcggttaggttcgatctattaagtaatatctataattatggatatctagcttgttttatgatcattgagagaggtagcatcggggtttcagccgatcttacctgatttagcattatgtcttatatgcttaattgatatgctaaatctgccatttatattaagatcttgttacaataaagtatattatgcttatgtttgatatattctatctattttaatatcttaatatagagtggtatcggagtattagccggtacatgctagatctatctgatcagctatgctataagtgtttataatatttatgttaatgtatatttcaatctaagtgatttatactgtctcggcatggcgactgatctatcccaatcacttggtttaaatatacatcgacataaggattatatagcgttaatatctacagccgatcgaatagatttagtcttatcttgtttatttataactgccgatcgatttacatatgacatcggctcaagaataaatgatatgtcatcagcgactggccgatcggctatcgtttatggatttaaccgtggtttcttttgtctttccttcttgttgattgcaggatcaaatcaactggcacactcacgaatctaaaagcaagattttcgacctgcactgaagttaagcagatcttccaggccaatgtgtatttttcgtatcaacaaatttgtgcatttatcaatttcctcaaagagaggggcacaccgaggtatttacaggggagatcaagcagctcatgtgagagaaggtcctgagtaaccgtgatgtccatctcactgcactaaatagggaacacactgctcttctgtacattagttttgagccatggtgctttgccaaagagattgagtatgtccagcgttgtgccaatgtcacttgtggagggtcaaaggaaagagccacattatccgcatagagagatatccaatgttgcaaggctcacaaagatagaggctgcagcaaacccccgtcctcgtcctttgacaccatatagtttaggacacccatgacaagaataacaagcatcatggatcaaggatcaccttggtgcaacacatgccggtgtgaaaatacctcaccggggtaccattcaagagaacttgaatcgacaaagatgccaagagcctgctgagaatatcacaacaaataggcctaaaacccaacttgtgcaagaactcaaaatggaaacacatcttaccaagtttattaccatgaaacccgagaatgagagagcaatgatcagaatcgactgggatacactttgcaatatactattggggaagggttgctcctagttatatacatgatgctacgttaaaagtcagtacaactcccaacacgatgcaaaacaccatgcacgagagcctcaagcctaaatctgttctttttctctaaatatccgcattagatagagggggcaccccttgttgtgtaagtgtgttgcatggactatggtcatgtggatcattaattgcataaacatatcactactattacaaggtcacgtgaaaagctagcaccagcaggcatgctgttctcacgtgtgcttggtggcgccctagaggaggttgtgcagtggagttgcaggctacatcaagcagggcatggagatcaaaacaagtaaacagacttgatcaggagaattgatggatccatgcggtagaagagatggcaggagccatcttggttgcgtacggcatggacagatcaaatttacaaagagttttggacttggtgattggtgcaaggctgtgattcgacggagcggttcatggccacaagacaacaagcatggtgtagatatgtggtggtgatcaaggtgatgcagtgataggggtgaaagcagtcggaaacgatcaggaaaaaccctaaaccattaccacaaccatattatttttctgaaacagaatcgataacggtaagatggtaacggaaacaatatcggaaatatcagtaaatcgaaaacggaattattcaatcgaaaacatgtcggtatcgttcggaagtcgataattactgtcggaaacatcgaacaataacatcgcacatttagctagcaatctagaatgattataaatatttgacgataattataaatatatttgtattcgacgataattattccccaatttcataaagataaagcaacacaggcacatagcaagttctcttatacataacaagtccactagaaccataaccacatagccacagtaacactgttggaccggatggaactcatcatggtcatcattttcttcaacaactgtatcatcaccagctacaacatttgctgagccggccggcaagctcccgaacggcgtgctagaggcattactgccgtgaggtggtgggggcggccccaataggaggcgacgtcgtgaggaagcttcgccggctagcgccatcatcgctagggggcgggagggtggggaacggatgggagctgccactgtgttggcgccgtcgcgccgctgcgttggagctgccacactgctgcgccgctgcgttggtgcctccgcgccgccgcgccgatgcgtatgagtacgacggcgctggttggacttgggacaggtcgactgggggattgggcagccaggagcagccaagcagctctaggttagggatttagggtttttgttgggctgagaaaatgggccaaagaaaaataacttgggccagccggccagtgatgtttgtaaaaatggtaattaccgggataataccgtaaccacacaaaacagtcggtaaattaccaaaccttttccgatatcatttccgtattttttttaccgtttccgtttccgacatttaccgtttccgaagcatccgataggtcaaattcggtagcggtagcccggtcagccggtaattactgctaccgttttcaaccctagcagtgagtatacggctcgagacaaggtgtgtgaggtgcgcgtgtatgatggttttgcactataccggtagggtagttagaccgatggattggttaaactgcagagcttggacggttataccgagtacaatggacggtggtttgttgctgaaacttatgaacagatccataagaaggccaagaaggctctatggtttggatagttttcaagtgagaagggcgagtagactgacggcggcaggtaggtatagcaatttcccccacggggccgggtcccctgcgtggacgggggtaggttagattttcaacccgcaggtccattgggtcggggccccggtcatcccacgggtttgccttcgggggcccggtaaaggtgtccattagttattttccatacaatttatgtagaaagcccattaacattggcccaattattactgctatagtataaaaggaaaggtcaaaactctaaatcaactcctcccagtcgccgccaggcaccaacctctcactcaagcgcgagaagcgagagggtagcgacagcgcaacacgcctgccccgcccgagccgcacgccgtcggcctttcccgccgtccccacactgtgcgtcgtcggcctctcccgctgccctcacgctatcgccctatgtcgccgcccctgggcctcgtgtcatcatcctctgtcgctgtctgtacgccgcgcgctgtcgccctctaccaccgcccctgtgttgtcgtcttcttgtcgatcggtcaccaacgctcctctccgttgcgcgggccccggctaggtggcgggttccctgcggggttgggggcgggtcctgtgttgcacctgcatccttcttcagggccggggacgagtgaggaaatcggggctcggggtcggggccgttcttgtccaacccggacctgctccgctccgttgccaaacctagcggcaggtcggtcaggtcacatatggaattatctggcggagacatgatatatctgagactcgacaatgagttgagatatatggagttagaccaaaactgaagaaaagtcccgggcaacatcgggttgaatacattggtggtgtcaacgagactgtttggtagtacaagatatatccaggatctgcgtggtttacatgatggggatatgtggaatatgtgtcgctgaaaaggaagagcaatcactatggtggtaatttcttcaattgattcaaagcaacaatgaattttctcaaattatcaacgactcaaactactacagatgcaggaaagcatggatggatttgttagctcggtccataagattacaaggaagaaagggttattcatcagtctggtgagtttaatttatctattcggtaatgacatgggttatctagccatggattaaataaaatcaaatttacgatagaagatgaaggtgaacatggtcttcgaggagtctatgatgtgacatctaagaaggaattcaattttacttgtcaagacgattgtgatgatgggatagaagatggagcattgttgtagatggagtccagagaaataagttataggaatagcagagtttcttgaagggagtaggtctggtgcaggctcatcgggcagctcatcatgaagttgcggagggaagacaaccgaagtctggagggcaggtggatcggcacgatgactctaactacttctgggtgtcgtatattcgtcaaggtggagtttgttagaataggtatcgaataattgatgttagttaggcttcatcctaattggttcacaatttcatttagcttttgttgtgaaaaaagttttttcttgcacatctctgtggttaatttattgctcgaaatatgcattcatcttaggaaagaaagatacataacttcaagcaattagttagcgacaaattctccaaagcacaatgccatagggctcacaaattgtttgctggctatgtgaaatgggataattgtatgctgattgctacgtgacatactctccctgtttttctttttcagtttggttaattcaaaaataaactaacctacgtaatgtaaaataatatgaagggagtatataacaaacttgataataatttactagtgaaattgtatcagagataactagttataccttcgtcccaaaatatatcaattttttttagaaacacagtacaaacacaggcgctcacaacatgcgcacactcactcctatgaacacactatgagcacctccggaagactgagccggcatatcttgagattgacgaagtcaccaccctatgagcacctccgaaagactgagccggcatatcttgagaaccccctatgagcacctccggaagactgagccagcatatattgagcatatcttgagattgacgaagtcaccaccctatgaacacctccggaagactgagtcggcatatcttgagcaccccctatgagcacctccggaagactgagccggcatatattgagcatatcttgagattgacgaagtagactgagccagcatatattgagcatatcttgagattgacgaagtcaccaccctatgaacacctccggaagactgagtcggcatatcttgagcaccccctatgagcacctccgaaagactgagccggcatatattgagcatatcttgagattgacgaagtcaccaccctatgaacacctctggaagactgagccggcatatcttgagattgacgaagtcaccaccctatgaacacctccggaagagccggcatatcttgagcatatctagagattgacgaagtcaccaccctatgagcacctccggaagactgggccggcatatcttgagattgacgaagtcaccaccctatgaacacctccggaagactgagccggcatatcttgagcatatctagagattgacgaagtcaccaccctatgagcacctccggaagactgggccggcatatcttgagattgacgaagtcaccacagcgcctcgctgtcgacgggtacgtcgcctaccactgaaagaataattagccgtaaatgcgatcacccgtgtcaaatctaggatttgaacccgggtgggctggttccaccacaaggaacctaaccagttgagctatgctcacttcgccaaaatatatcaatttttgactatatatgtgaaacaatttagatgcatagctaaaaattattatattttaggatggaggtagtacaacaatactaaaattttcttaaattttcttgttgggttgacacctgtgcccaaatgaacaatttcaggccaaattccggcgagcgagattggtgaaacttcctacattcgtgggaaccagaaagagggtcaaagtcgaccccaattttatcccaaccatccaaatattcatagattttttattcagaagttttatactacaagtgcacagagactttatcactgatatatgagcctaacaaatcgtgatcacacggtgagttcgaaggtagaggatatcaatcccagtgtacagctgtaggggcaggaggacaacaactggacaagccattcggccgttgggggggatccccctgttgggcccgtgaaggcccagatccaacggccacgagcagccgacaaggggaaccccctcgcttaatccgggccctccacgtgtcacccgccccagtggaaacgctccttcttccccaaagaggaaagaaaaacacacacacacaccgcgaggaggtgaaaaagaacgaacaaaggcgagtagtgtgaaaccgtccccgaattcgagctcccgcttcctcccccactttttatccccacccccgga

SEQ ID NO: 19535 - DNA, 13314 bp, Oryza sativa
gagcgggaagagaatgagcaattcattaacaaaatctgtcttgagtttcctgaggtatggtgtttaacatctcaaagtgcaccgtttcagtttctgcatcatgttcatcttatctgaatttcttatcatgttacttaaataacttttcaggtgccacagcagaatggggatgaatgtggtatatatgttctttactttatctactgttttcttcagaacaaagcactgggagaagatttcagccagctggtgtgtcagacatttccacccttaccctgttttccttttgcaccttacaaaagctatgctaatatgttttctctatgaattagtttgatgatccagaagaatgggagaacttccgcaagggtgttcattcattccgagagtatgttctttttctgtgtatatcctgtatgctattattaaattgtggtcttattgttttttcctttttgcttctacaggaacagagaaaatgaaattgcagaataggtgagcatggtggatggcaatatttcaccagctatatgtagttatcaggtatgtaatggctgttatgaaatcattgcctcttctattttgcttttgcctcttgtctttcttatcaagtttttctcttgtatatgtaacagaatacaacagcaaattacctgttcatcttcctggtggcacaacctgaagaagtttgaagactgtcaagaatttgtttgtcatacagttcatgccgtcaagaggaagatggctatttctcagatacaaagcagcatcagtgtcaacctagcgctgtcgagatctttcgttgatccaggctattgataagctgaaagccccttttttggatagggttccatcaacattcagcacctgttagccgtatagagtcacagatgattcattccttaaaaaaaaaagaatatttaaacgatttgatactatacttatgcattgtctagaaatgctgggtgggatttccaccacctttcagaatatttagctgggggttatatgatgtacatcaatatgtttgtatcagatcttaaagatggtgtattcccccttccagataatatattacagtttcgtatttgatgcattgaaatgctgtcagcgtcagtaatctgaaagttcaaagtagcaatatgttgtgatccatcttgacagtaaagcagaactcaaccaaggaggatcgtgtctgatgttgctgccttctcagagtaagcagaacttcagatgtgacacctttgttgctaacatgccacaccccttccgatttttatatctttgattttgtttttcttttccttttgtgctaaaacgatatggaaattgcttgttttgggtgatgtttattctttttgaaaacaaaattgcatgaaacgctcatcatgatacttgggagggaaaggcactcaagatactgagcgaattagggtgtgtttgaggagatggggattagggagatggggaagatacgcaaaacgaggtgagccattagcacatgattaattgagtattaattattttaaactttaaaaatggattaatatgattttttaaagcaactttcttataaaatttttttgcaaaaaacacaccgtttagtagttcgggaagcgtgcgcgcggaaaatgaaacaatctttctccctttctcctgcgcttgaacgcagccttagtggtgatagtaggcaaaaccattaaccctgcaaatactattatgctccctccagttccataatccgatgtgtcgacgtttgatgtcgagattccggtatttgtatagtatggggatcgttggtactaggatatatacgagactgaggtaaaagagacggagacagagatttttatacaggttcgggcccctgaattgtcaggtaataaccctacatcctgttggccgaagccggtcattgctcttattcattataatcacaccagtacaatatttggggtagcctatctaactgttgtcgacatggcggtctgaacgtctaactcgtagtcgacaacagggtagtcttctcctcgagttcgtgcccggcgagatcagaaacaacgctagatccctacggccggcctatgtaggtaccggatagggccgatccaggcatatctctgaagtcgatatccggcggcttgtcttggcgtatgtcggcttgtatgttgtagcttctgtggttccgtgtatgttgattgtggtaggtgtccattgaggtggtcgtctcccctctcctcttaggggggccttgtatttatacccataggtatccccttatccaagtagaactagggaaaccaatatggatacaatccgagtagtccttgtcatttccatatagaactctggttgtctttccttatccggaactcctcatatatccgcaggttgtttccgtataggacatggtatgtggtgggtcctgccgagatttagtcaactactattaagtatgtggtattcataaccctgacacgatgttttggatttttttaatctcttaaactatggctttctattataatatatagaataaataaaaaatatttacttatattataatatttttaaagactatatatatatatatatatatatatatatatcttgttgtattgtttttgaactaaatattttgttcttgttcaagcggaaaaaagcgggaattttttttagtccgtttgggaaaataaagtctatgttaggaaagatttttcattttttagtgaaatatctaggaagtggaagaagcactttagtggcttctgtggatgctttacttctgggatcgaagcgcgcttagctggcatgccaaaccatttagggtgtgtttagttcatgttaaaattaaaagtttaattaaaattgaaaaggtgtgacggaaaagttgaaagtttgtgtgtgtagaaaatttttaatgtgataaaaaaagttagaagtttgaagaaaaagttgataactaaaccaggccttaggttggaactttatgcatatgacattacattagtctcttaatatcggttatgtcagggttatgggtgcttccaaaagaaaaaaaaaatgcatgattaattacttggtgaactactactccatcgcaggaagacaacatgatttggtcggcaaatccactctaaccacacagagtgcagcgagacacgttgttaccgtcgaaatgtagagatccgtatcctattttcctacgcgtttatgaaaagatttgccacatgccacgacacgcgacacgcgcgcttgttacacaggctttctcaactgctacacgcgttacggaccttccgttatactccttcggtttccgtttccgtttccgtttcatatcataaattgttttaatttttcttaaattcaattaaatcttaagaaaaatatagcaaccaaaacaggacaatggcatgtttaagagagttgattttgagaagaagccgtttactctcttcgtcatatttgaattatttttatgattaatatttttattatattagatgataaaatataaatagtactttgtgtgggacttttttttagaaaaaatataaattttttaaataaaataaatggtcaaacgttaaacacgaatatctacgactgagacacatcctattccaataaatctagacaagagactatccaaattcagattatatttcgtttagatttttatactttatgacagaggtggaactattttttaactcccatctggttggtgagtccgcagcttctaagagtcagcagcttctagtagaggagtattttctaatccggacgaaaagctgatcgttttgggagcaaccatacgagaagacaccgcgaaattggttactacgagcgggagacgagcaataaaattgcgttgggggggtgggcaggggcacaaatcaagcactgcagtggcagtgcagctagcctaaagtttgccgattccccatggagtgaacgcaactagaccttgggagtgagggggaggcggccatggcggtggcggaagtcgggggaatgcttgcatctgccgtcctcaaggtggcgacccagaagctgggcgccgccatagcgggccgggtcatgctccagtggaacttcgacaaggatctggaggggatgaaggccacgctggagtctgtggacgcggtgctcagggacgccgagaggcggtcgatccgcgacgcggcggtgcggctgtggctgaggaggctcaaggacgccgcctacgacatctccgacatgctcgacgacctggagaacatcacttccaaatcggatgcggggaaggtgcgcaatctccactgcagcgattctcgcctctttttgttattccttattattattattattattattattattattacggttttgcctattattactccctatgacacctacgtttgaccattcgttttatttaaaaatttttaaataaaacgaatggtcaaacgttggactaaaagtcaacggcgtcatacattaaaatacggagatagtattatttattgccgttgcgtgccgtcagttttgggctgttcagattaataccattttcaaccataccattgccaaaaaaaaaatgttcgcgtttattttgttgccaaatttagtaaatacataagaaatcctgctaaaatttgataagttttattttggctacaatctgaacaggccctttggttatggatttactagtggatgtttccgattttccccatctgaaatacagtaaattttattgacgagtattcctctattactaactcaaatcagtaaattctctgcagttgggatgtgtgatgatccccaatctgactattgctcacaagattaccctagctaataagatgaagacgataagtgatgaactgaaggagatcactaatcaacatcttagcttcagattcacggaagatagcagctataaggagcacagagttactgataaacgggaaacatcgtccaaggtggaagaagcactagttgttgggaggactgcagagaagcggataattatatcttctctgtccaagagaatgactgaagagaccgtaatccttcctatatatggcattggaggcataggcaagacaaccttggcgaaactggttttcaacgcttccaatttcagagactactctaaggtctggatatatgtgtctcagacatttgacttgaacaaaattagcaactctataatttcacaagtatcggaaagtgagagccagttgactgaaagggagatgataaataggcgtcttgatgagctactttccggtaggaagattctaattgttttagatgacctatgggagagggatcaatttcagttagatgatttgaagactatgttaaaggttggcaggggcagcagggtgattgccatcgtaaccacccgagataaggacattgcagagaagatttgcaccactgaaccgtacaaactagaacccctgacagatgacatgtgctggaaaataataaaagaaaagagtgtctttgaagcaagagatgacaaagaacaattggagaatataggaagggaaatagcatctaagtgtggaggtgtggctttagcagccaaatcacttggatatactctgcaacccatgaagtttgatgaatgggtatcagtgagaaacaacgatatctggaaggcatctactttcgaatgtacatctttgccatatcataatgtgcttgcatccttgtgattgagctgcagcaatatgcctccaaacctgaggttatgctttgcatattgtgcaatctttccaaaaggtcacatcatagtaaaagaccaaataattcaccaatggaatgctcttggtttcatagagcaatctgacatattctctactaggcagcttggtgaggcatatgttagacagcttttggggttgtgcttccttcaacaaacaaaggctccttcagtgagtttctacttaccacatgcatctatagctgaacagctttatcatttctttattagcctatagtacacacataaatacatatctgagatttttttatatattttgaacctttctttaatataattttaaaataaatcctgctaaacttatctccagatttgcatcttttggccacacaatgccatcctcattggtgtggcaggacaacactgttgcacctgttaaagcctgtggcatcacaaaacatatgatgtcacaccatgagcaatggcactatagtaactcgctaaaccattgctcaagaagtggcaacatttggttgctaggtgtccaaaaccttttcttttttaatgaaatttagctattggtagttttcaaatttaaataagtaaatgttctaaaaataaaaagaatttggcaagatacaaaagttacatccatttgcagttacagcaagggaatttgtgcagatggtcctttttagagttggccctactataagctgtggaaaagcacgtaaactaaatttaattgctgtggaccttcagcttcaatattatttatttctttagtgaaatcttagatgctaatatgctatcatgctagcccttctcattgaggcatatctgacacatacccctattatgagctacatgccattgggtggattaaactatttcatagaagtatcaatatactaaagtctttaatggagtactagtgtggtgtaatatatgcaacaggtattgctacaatacgtcctcccctcagctcattctactgccatcttcatgggttcatggacactaccactgtgatgctagtggcacctcccacttccgttggctttactatgcccacctcctaggtacccagacaatcttctgagttggctacccaatctactgttaatagcttgcaattttcttgctcactaattataccaaattcatgggagaaggcctctggcaagtacctaagctaaccggttgcctagcctagcctgccttggaacattcaggctgcctattaaaggcctcaccacaactcgtgtctctggccaccctcaatgcctgaacgtcattggtttcctgtatgtgaggaagaagacaagctcttctctctccatttctttctctgtgattcctagatcccacttcaaagttctatgtggagcttcttgtgccagaactttcttgaacttttaatctgtaatcattgcaatatcattggtcttgttgttgctatggtggtaaacttccatgggggtttgtttgctccttgttggtaggttttaatagagtaccgagttttatatgttccaatgatcttggcctagtaaacgaaaatcagctttaaggagtaaaccacaccagtattccagaaaagaagtccacaaggcctcatacaatgatttggtgcccactgcccaatccataccacttaagcctgcaagatgggtaactgcatgaataccatttacccccttttattttttgaaacttaagatggtaggagatctaccggatatattagaagaagagaattgaccctttttataaggaaaacagggcccgaaaaccgtacagttgcacagtttgctaaagggaaactggcaaaaccttacacagaagacacaaaaaaaacatgtgacaaaacgactagacccacagaagtgatcgagagaagagcaaggcctccaaggaggtgaacaacgacagaagccgctgccgacgcccgcccaaaactggactgggttttcacccgaagtggagagagttcacaaggcaacacctccaaggaggaaacgacacccacaggcgtcgatgtcactgatcctggaagaccaggcagggctttcgcctaagactccctcaagaagtgcaggacctctaagaagctagagcaagagtgttgagtgttatcgttgcccagctcatcggctgaacccgatgcagcagctctgactccactttaacacaaaaaacttacaccgaagggggtaaggacatcgctctgcactcggcacaactacaggtttacacagccacatggcacgtgaagcaccagcgaggcccaagcgccctgactgcagacagactggaccaccaacacggacgaacaaaaaactccaccaccaaaagactccacggccggcctgggagcagacgaccaagagaagggaggaggcctggccggcctgaaggggaactgagagctgtcggcagggggagcaaagacatcggtgttatccatgtttctagcgaggatctccgggcttcgcgggacaatccaaacaactgcggcaaccacctccaacttcaccacaccaccagtgcagagagaggagcactggggcgaacagcagagcaactgaaaggaagaaaatatggggagaggggggatgacggtcaccggtcacccctactgcttatgccgagacgacagagagaggaagaaagagtagggaaggaaagagaaaatggtggttgccggcgactggagcggccggagcctccgacgcgaccccccggcaggactcaaatcccgccgaccgacggagacagctggcgccgatgaaggcaggccgacgcgccgccccggacgccgacccgctgcagcggtggagccccgctagcgccggccaccccgcgggccgccaccaccaaaccagcctaaccgcccccgcttcatgcctctcgacgctgccatcgtagatccggcggcggcggggccggatctgccgccgcccagcctgggagaccccgccgccgcggacgaacgccgcccccccccccccaacccgcgcgcgggcacagaggagagacgtcgccgcgagaaggccccgccgccgccatcctagctcgccagccggctttgccggcggcgagctccggcggcggcgaggtgaggagggggagaggaaggcggcggtggcgctagggtttcgccccccgtgtcgcctgcgcgggggcgacgcggggggaaggcttctctgatcgaatccaagcgtatatagaccaacaactggtttacccccttttagaatatcacttgtcagtggtgtaggatataagctttgtcctactaagtactaaccatggaccttaataccttatcacttcgttgataatcaaagagttgtggaaacggctgaactcgttgataatcctcttggcatgggagatttagaagcactgcagtgaccgtgtgtttaatggtgctagccctaatgtcatggtggtttcacaggcaatagtgaatgagggtagcttatggtgtttagccggagcccatgctctacataagtttcttgtgaggtcgcttgccccaggtgattagttggtcttttcttggggctttggtcgtgcgtcctttgtatgcgacggggagggtccttttggtccctcctatttaagtttgtttttttcctttcttaatgaaatgaacgcagttgtcctgtgttttttagggaaaaaaacttatcatcaaggtccgaacattttcttagaagttgcaaaggatggcgagaatttcacaaacgtgtttctaccatcaatataacattaaaaatccatactcattatgtactaaatctttacctattataaaaattcaagatgtttttgtgtggaattttcgtctgtcaccctgagtctcggacggttgcgtttcactccctccgcgttgcgtcagaatcggtgtcacggaggcaatagattaattttcggtaatttctcaagagcgtgcggatggcctggttagaatcgaacgacgaggcacggaattatccagattggttctggcaggttcccgcacaaactatggtaagtaaacctaaatcagtcccatgcatcttaatattaactgtccacttaatatatgtagagtaacgatactaagatgccatttgttccatgaatccattgtgacatggattgtccttccaacgccatatctctactgttataaaaaataaagatttttttgccggtattttcttacgtcatctgtatttgagtgggtttataaattcgcttttggaaatacagattcgtgtataaatttgaatttaagtttatttacttttggaaatacaaaacaagttgtataagagatttctttaaaaaaacttacatgctaatttgagatgaaagtcagactcctaattgcagctcatgattttctaaaaaaaaatatccaagcgaattcccatagtgaatttcatcctagctaaaccatataacaataataagattaaaatagcattcacccgttgcaacgcacaagcattttttctaatctctactattataaaaattgaagatgtttttgctggtactttggtacgttatccgtatttgagtcggtttttaagttcgttcgcttttgtaaataaagatatgtgtttgagtcagcttttaagcttgtttacttttggagatacaaaggagtcgtataagaaatctcttttaaaaaaactccacattgctaacttgagatgaaagttaaactcctacttggagctcaagattttttaaaaaaatatatattctagtgaattctcacactgaattttaccctagataaacaatataacaataataaaattaaaatagtattcacccgttgcaacgcacgggtattttttctagtgaatcaaaatgctgaattagttgagtatataaatctaaggaaaaaaggataggagaggaaaaactgctcattacaaatacccgtggcaacctctcataggtaatggaagttgtgtaactccttgcctgtgtgtcaactaggaattcacacaggcattacaatgccaaaattgataatgcaaaagaaaagaaaaaaaaagcaaaagaacatgaccagcaaagccttcatgttgaagccaatatctaggtcaactcctggaacagtatgaccaacgaaagtatagcaatgttttcttaattttgtggcatataaggtgatatatttatatgttcttttgttgcagactactagggtccataacgaagattctacgttcttaaccatgcacgacctggtgcatgattttgcaagatcaatcttatttgatgcagttctggattctggaaaaaaaatcaatattggggtaagcagttgtcgctatggaatgctcagagattgcagcaaaccactagagttggttacaccttcacctgcaaagataagagcactgcattttctgggttgtggcaaaattgagcttcatggtgttgcattctcatccgcttcatgcttgcgagttttagatttaagtggctgttccatcctgaggttacctgcttctatcggtcaattaaagcaattgaggtaccttaatgctccgggtatgaaaaatcgaatgattcccaagtgtatcaccaagctctcaaaattaaatttcctcagcctttgtaggtctcgtgctatctcagcactaccagagtcaattggtgaaattgaaggtctcatgcatcttgatttatcaggttgttcacgattaaaagagctcccaaagtcatttgggaagctcagaaggttggtgcacctaaatttgtcgaattgctctcgtgttaaagatgtatcagaatacatttgtggccttaccaaccttgaatatttgaacctatcagtgtgccgtaaaattggatttctaccgagaacattgggcagcctcacagaacttaagtatttgaacctatcaggttgttttgggataaaagaattaccgaaatcatttcagcagctaaaaaatttggtgcatctggatctgtcatgctgtaattgtgttaaagatttgtcagaagctttagatggccttgcaaaactgcagtacttgaacttatcatattgtcaccattatggaaaccagtttcgtctgagagggctgccagaagtcattggcaatctcaccagtctccggcatttgcatttatcggggttcctagacaatatatttggcaaccaatctggagtcatggacaagctcctggaaatagggtatttaaatttatcaacattccagggtaatatttttcagcaactaccaccaggtcaaagtcacagtttcattgagtgcatcggtgccctttcaaatctggagcatctaaatttgtctaataatgtcagcctttatagtgtacctgaaagtctgggtaaccttaggaagctacacacattagacctcacaggttgcattggactattgtggctaccagaaagtataagtaaaattcaaagcttgaaatatgtacttatgaaggatttgttgagacttaagtccacactatcttgtttcaacaatggcccaatcttgttgccaaactttgtggtccaagctgttgacaagaaatccagcaatcttggtcagcttcttgatgcaaaccctgctgagttggacataagtagtcttgaaaatgtgaagtccacaaaagaagcaaagggaataaaattgtcaggaaagagaaatattgtcaaactgaaatttgattggaccataggaaccaagcgatacgtggaggacatggaagtgttgagagaactagtgccgccaagcactgtgaagtactttgaactgcgaggttatcacagtacaagctttcctacctggttaatgggcattgcacactgtctccctaatcttgtcaaaattaagatagtggatttgtcgaaatgcagcatactaccacttggtcagttaccaaaccttaaacaactggttctcggtagaatgaagagcataacaaagatcgatgcggacttctgtggtggtgcgagagcatttcctcagctgaagacatttgacatatacagcatggaaaggttgcaagagtggaatacaacatactcttgtggtgaggatggtgtgactgagttcatgttccccaaccttcagtggttaagcataagtgactgccccaatttggttgtgaaaccactcccgcctagagttacgtggtggaaaatagagggcggtgaaagtgtcatatcatcatggggagggagtgtgcacactggtacatcttcatcctcttgttcagtaactaatctggtcgtcaaattctgtacgttgccgttgagtcagtggagtctgcttcaccaccttcctgccctccgtcacttaaccatccactggtgcgctgatctgactagctcaccagagatcattcaagacctccactcactcaaatcactatccctagatggaaacgaacaggcagagcttccagattggctgggtgacctcccttctcttcaagaactaaagataaccatgtatccagcgctgactgagctgcaagagaaaattaggcagctcatgtcactacagtcattgacattgtcttcttgtcagatgctg

SEQ ID NO: 19536 - DNA, 1611 bp, Oryza sativa
catttttttccccattgccatcccaattacaggacttggctatttatgtctcctctccacactgttcaattggtcttctgaaagatatattccctaaagttaagtttagtgtcaatgtgccatattatctgcatccaatccagcttgccttggcaccaacagtttgaacatccttacctgttgctgggaccaggttgttcattacgaatttcagtaattactagtccagcctgatgacctatcacaaccctgcatcagtagattgtttgcattacgcaggtttcgcaatggagagaaagaacgtctggaatatcaacaaagaatgaagaccacattctgagatgtcaacatattactaaaattcatgtttgcagtcaagcttatctttctttctttttttttgcagggaaaacttcttttaatttagacttgcagaagatgcagcgaagcagtaacatgctcaacctcaagatgaatagcagggtcctttttatcactcaccgttttgaacccttcaaacaaactatagcgccgacttttccaagttcaaagtccagtacaccctcaagcctagaaaattatgaaaaacaatatcatttctgaaacttctcacacaggaaaagtttttgaaccggcacatcctcctcgacgagccggcgcttttgcacatgaaaatttggcaagatcacatcacaagcctagaagttatggatgggcgcagttaatgtagcagcttaggaacttacttgaaggtaattgagttccacagacgaactgtctcatcattagaacctgtaagtaggattggcaggtctggatgggaacaaacacaggtaacacaatccatatgccctatgagtatttgaacacaagtcctgctcttgcagtcccagatctgactcaacaagatgaaataattacaacggcatttccacaaaaaatgatcaagaggtatgacaatactcttgcaattaaaatgtcttaccctagccgttttgtccaaagaaccagttattatgtattgctgatttccacgagtgaagtaatcgaaacagctcactgcagatccatgcccaaacaatgtgaattcacgacgggaagaacggaaattccaaacctgcatttgccatattatagactttaattcaaaaattctgtctatcaaaatgataggaggtaaaacctcaggccttcactgcacctgtacattcatcatggaagcagccgcaaatttgtatgaatcgtgcgggttaaatttgattccatgtgctaggacaccttgcatgtcaaacatcctaatgcactcccagcccttgttccagtcccacatcttaattgggtcaagcaagccgaccgacagcacataaggctcagttggatgaacgtccaaacaggtgatgttccatgaatgagctttgaatctcttcacttgctgtacaggggattcgtatgtgtacactcttatgaaaccatcatgatatccaaccacaagccattgcttccgcgcaatcaacttggctgcgctagctgcagttttggagtgattgatatgttagcatttgctgttacaccaggggtaaagtctatggctagcagtgagttaagtcaggt

SEQ ID NO: 19537 - DNA, 7670 bp, Oryza sativa
aaatgtgtttagtgttaatttgtatctttggaacttcctaatgtacaggtaccaaaaattaacactaaaaatagtatatacagcccactgggagtggtcacttacttgtgtatcacagttcaggatgtcgactgagccaaaaatattgcctgtcaaaatcctgcacacaagaaatttattatggtaaaagctggtaacagctgttttgcatatgctatgaaaggaaaagaaatgtattaggtgttcatcacatacatattctgaagtatctaaccttgattttgtgggctgtaacgactatgattatagtataacctaaccactagatgaagtaaagaattttcagcaggaaagagacaagcataaaacacaatgatcgttaaatcagaatgtactgaagaactaggactccctttttttcatgtaaaaagtctagaaaaaactcataatacctaatcttcactaaaaggagcttgaaagcaagtggacaatttattttagaaaaatgtagattttttacaaagtttattattgtaaagctggccaccaggtcatgactaatgaggcttttgaagggggctattttcttttcacgctttaaaataaaatgggatcatagcaagtaaagtaaaggatgataaatttatcgcttttagaaatgcaagaaaatcttggtttcaattatcaccatgagaacatgtagtttgtctcctcaaacaaaaagagatgacaatttcacgtaccatggctcagtgggatgcgcatctatgggaatgtcaggattttccattggaatgatctgatcaaatgaaacagcaaccaaagtagacaaaattataagatatttgtgaaagggtttaccgatgtaacaaaagtaagcaattggcatgattccaacagaatatagagataaaatttcacctgatgcacctctcggtcctcttctttctctttgaaagaagaaccgttatggtgataagcttcttggtttacttgggtgtcacttaagttcaaatggctggccaacctgctctcaagggtgataaactcgtcgctgtatgaggtttgcttctcgcggtggtcgttgacgaaccggacctctgagccatggcttatcggcaactaaatgatatagccaatgtagtcaattaaagaagatttacatgcagctaaaaagtctttcaaatataaatacatgttcctttttgagtaagtggaaatacatgtattgtaatgtgcagctatgaaactatatacccaacactgcaggtacataaaagagcaataattaatagggttcgaccattataaaacatattaaattattgaatagcctacttcacatgattaaaaacagggttgatgtagaaaacttcaattaattttacttcttttttgtgaaactgcaattaattttacatttttgatcccctaaaaggataattgtcaacaaaatgcaatcccaaaatacagcggaagtgttgtgagacagaaggatgttgattcctagaaatccctaacatacaaggagaacattctgaaaatgacgatcaccctagacacttagatcatctttgtggtattgcttttggtcgcggacgttttttcagtttcttaaatttgttatgtttgtatttggctcctgacgagggggttttctcctccgttactttcttctcttcttagtggaatgacgcgcaattcttttgcttgttcgagaattaaaatagtcattctttaatatataaggaattttacagaataaataaagaacatgtcgccgcttcatttaccaaagtaaaatcattccactttatgcctttatgaagagcttcgcactaggtttattttttaaaaaaaaaacatgccagtaacaatattgattaccttgccaatcatagtttctgtctcattaatcttattgacgatatccaaaatattgggtcttttgtgtctatcaatctccacacatttcagagctatttcagtgcacgtcttcacctgttggcgatatgcttccaatgaggaaccattccatgttgcttgtaacctgactgtccaatttcctagtacctgcgaaattagaatgtaaagctaaactattaatattcaatacaaaaggagtagtttttcagagatgatcactgatcctgataaagacaaacaacatttcttactagatcagtaaattcttgggaagacatttcagcacttctagagcgccctctaggtcctgcaattacgtttagcattacaacacccaagctgaatatgtctagcttgtttgagagtacattcttctctatgtattctggcggcaggtatccgctgcatatggacacatatgtaagcgcatccttattagaaaaggattcaatcaaataagtaattgagcttacactgtcccaattggagtttgtgtgacccttgttttctcttcggtgaagagcttggacaatccaaaatccgcaagttttggcaccatgttcttgtccagcaatatattgcccggtttaagatccaaatggtaaataggtggcttcagtccctcgtggagatattttaaaccctcacatgtccctttaataattttgaaccgtgtaggccagtcaagaccatgaaattcgtctgcaaagatacagaaaagaggtatcaacataataataaacataatctaaatacccaggattatttttttcttagcgtgctaaggaatatactagaactggagaaacatcgtacctgaaagatgattctcaaggcttccaccggttaaatactcgaagcagagcgctctatgtattattgcagcaaaaactattcttcctttgtactctgcgtatttatgttgtgtttcatagcagtaggcaactagccgtacaatatttggatgctcgagcctcataaggttctgaaattcattctcgaattgcttatcgtcaaatcctagagtatcattatgaagcatcttcactgcaatctcttttccatttctaaactctccctgttaaggatctattgtcagtacttaatacagcttgatttagcattactggtgaaaacatttgacaaggatgaaattgtaaagcatgtctttatttgctttgtagtcacagtatactacaattaagtatcatggacaataaaaggcggggcatggttaattgctcatcatagtaatataagtatgtgcaaacatgtagcgcatgcttattctttacaacccatacagtgctttgtcaagttattcgcaataaacaaatgatgccctcaacttaccttataaactgttccatatgcaccttgaccaatttttcgctcctcggagaatccatctgtaatttcttctaacaatcggaatgttatatccgttgggtccatagttgaatctggagcttgatgtcggtgtcctggtttatgctagtaaagaaggccttctgcatgaggacaatacaaagtaagttacgctgttaaagagcaagaagttgctactagctctagcactcaactcaacatcatctggctcttttttcttgccctttcattgttttgccttttgggttcctgatatcatccagattcaatcttgcattttgaagttgcgaagatggacaagtgatgagagagcagaaatttcacctgatttttgtagagaaaaaaattctgattcaccatctaaacaaatcattatcaattcaattttacccccaccgtcgctcaacaagtaaaaactctcagaataattgaaatcgaagggttggtccatcatggcaatggggtcaccactcaccacccataagctcctctcctcatcatcttcttcgctcatctttttctctttctttcttctcaccttccccggctatgtctcctcaagacgcgcctccacatcgggcgacggggctgcgccgccgccccgcgtagcggcgtcgccgcatcgggagcagcgaatcccgcaccaaccaacgaaccgtccgcgccgccaagtgggccaccgccatcctctccccctcgccttctgccgcggcttcgccacctcccggcctcaccgggaagtccggcgatgccatggtgcgcgcgcagcgcactcagcatccgcgaccgcgaggccgagccctagccgtctgcaggcgcgagcgccatggaagaggaaaacgacgttcgggtgtgtttggcgctacgagttgccagctccgactcttcattttccacccgcacacttcctaaactatcagattattaaatagtggtatactttttgtaaaaaaatataaaaattacttttaaaaatcatattaatctatatttttatttttttaatgtgtaaatcacagttttttacgtgcctagagaaaaagtattagcatccactccccaacgacctccaagagggagaaaatggacatttggcctcgttcaacacgtggtttcgctggaatgccatcccgaaacgtgtttcgttaaaatatcaatatagagcgcgtgctcatcgttagtttgccattttggccagtatattttcgaaatcatttttgctcctccaccgggtgatgagacaaaattaaccatcatgtcctccgcgccgtcgttgagaaagaggagctcgtcctcaccggccatctccatgtcctccacaagcagctcaccgtcttcctcctcgtcctcctccatggatggcgtccggagcagtgctgtctgggaaaggccagacgacgagatggccggcgggtcctccaacatcttcccctccctcaacctcgccacctccgtcgatggtgacggcgacgaccgagggaatccccagcctcctccaacaacggctgatgaccgtggaggaggaatccttcaaccgatgacggcgatgaccgtggaggaggaatccccagcctcatccgtcggtggcatcctcgatactgccaccgacgccgctgctccccaagcactagccgccgccccccgtccccgcagcagcagtcgcagccgcctgctccagtggcaacctactgatgacgacgacgggcttcgcctcctcttccggagcaggcctcctcacctcctcatccacctgccattcctcacggcggcgacctcgacagcagctgcggtcgcggctgccttgacgacgaacaccatatgtggctgcgtaggtcgaagtggaggaggaggcggtggcgacggtgctgcgcggcgaggtggtcgaggaagtcgtggtgatggcgcgggtgaagggggaggaggggggaaccatcttccatggctgcaaccgcgaggcccgctcgtcgctcaccgtcggcgagacgctgtccgcgcgcctccctggcgaccgactcacactcctctgtcgcttctctcgtggctccccgacggcctggacacaacggcacactgcctctcccagtagtcgtccacgccgccacctctcctcactgtgtcaaacggtggcggccgagatgcggtggcgaagcaagggcatttccgtcttatcatcgggtggatgagctaaaatcattttggaaatgaataaaatggcaaaaatggcaatattgcggtaagcatgtgcttcatataggcattttatcgaatcacgttttgagaatggcattctagcaaaaccgtgttttgaacgtggctaaatgttcattttctccccaagataggaggattagaagaggaaattccagggtatagcgaggagtggttgtttcaattattctttcaggatttgccctcacctttactgaattttagaatttcaccattgttttcgttaaaataattagattttttaaattttaagattcaggcccttgttttcactaaaacaattaggattttcagatctagagtagtgttataattgtttttaaatagggataagttttttaagaccttgatgagccttattaatattttcttacatgaagagccttattaatattgcataacagttatatcatcaaataatcttatacccttttaaagggcctgatgtcattttcaactataccttttttggtaaaattatcaaaaaaatatctacgtttaatttgttgctaaatttagtcaatacataagaaatcctgccaaaattttggcaatattgtcatcttaccaaaattttggcattaccaaaacttggtaagatttattttggcgacaatctgaccaggccaaaaatattttaatggtggtggtgagtagtgaatctatggcccaccaccaccttctacctaagagcaggtacaatagcaggcttagccagctataaaaatattttaaagagataaaggaaaagagagaagagcagcgggctacatatctgtagctagctgcagcactgactacaagacgtaatgtgtatatgacaggtgggactagatattgatagtatagtaagcaactattgtatgaattggctattacattggctataaataatttggagctagtagtgggctatactattaaacttgctctaataggggagtccttgttagggtgtagcatatgggtctgttcggaacccagggttcccaacccctctccattgtattctgcacgcacccttttcagactgctaaatggtgcgttttttgcaaaaagtttctatacgaaagttgcttaaaaaaatcatatttatccatttttgaaaaaaaagctagtacttaattaatcacgtgctaatggaccactctgttttctgcgcacactccggatggaaccaggtgatgcgaacacacgtctttcaaattgccatataaaaagttatctcagaagtagctaatttgtttggggcttttaaatggaagaataaccaatatggtccctaaagttttactcctgggttattttgggttattttagtccttaatcttttatattgtccaaacaagtcctttaaatttatcacataggctgatatagttcttggtcccaccaaattcaccacatggacatgccatgtcaccctcctatgcaaaatctatatgatttcttcaatttacccttacatatatcataggaaaataaaaaacaaaagaaaaaatttttaaaaaatatggtacatgtaagagcaaaaatatacgtcaaaaaggtgaaaaaaaaggaaaagtattttttcctgtggttatgtctagttcacccttacatttatttttctatgatatacgtaaaggtaaactggacaattcattatagattttgtatgaatgatgacatggtatatccatatgacggttttggtggaccaaggattattctaggccttttgataatgtttaaggatttctttggactatttaaaagattagagactaaactaatcatacaaagaaaactttagggactacaatagctattctccccttttaaaaggtgtataattaatgacttaattaatgagtcccttctcacttcaaattccgttacgatgcacgaagcatttagctagtttgttgacaaggaagctaggggttgttaacccactcacaaaacaaaaatttatcaaaacatcctcctacctacactggtggagaaaccatctttactcggtcgcccaaaatccataatagtcccggttcgaataggaaccgggactaaagatcatttttagtcccggttcaaaaaaagttattggaccgagttagaccccaattcttttttagtcccgg

SEQ ID NO: 19538 - DNA, 16526 bp, Oryza sativa
  unsure (1)..(16526): unsure at all n locations
accacgtgaggccgggtggcgcacggcggtagggagggcgcggaacggcgggcggccgggcaggcggccgaggcggtggaccgtgaggtaggcaaggcgggcagccggcaaggccggcggcgggcagccgagcaggcggccagcgaggcggcggcgctccccgggcgggcggcggagcccgaggcggcagcgggcgggcaccggccgttgaggcagcgggcagcgggcggcgacgctccccaggcggcggcggagcccaaggcggccgggcgggaggccagcgaggcggcggacggccggcacccgatctctgcgatgtggttttttcctgatctgtgcgatgtgtgcggccgatctgtgcgatgtggatttctttttctgatctgtgcagccgatctgtgcgatgtgatttctttttctgatctgtgtgatgtgtaatgtgtgaatgaatttgtggagatgattttgtgattttgtgaatgatttatgatgtatttggagatagaaaatgcagcttgatgtatttggggattttgtgaatgatctgtggtgttcgaatgatttgtggataatatgaatgatttgtggggctcgaaatcatggaagcagcaaggaaaaaaattaaaaaaaagaacattagccccggttgttaactctaaccgggactagatctcccggttagtaactccaaccgggagtaaagatccttctttagtcccagttattttaaccgggactaaaaatgggtatttttagtcccggattcgtagttccggttgcataaccgggactatagggggttgtgaaccgggactaaaaagggtttgtccaccagtgctagctagctaggttatgtgctactgcaccttatgtgccttttttttttttgacaaagcgagaatgcaacattcccaatattccaatattccgagcaaaaaggccgccgcaatatcaaacagtactatctctgtagagtatgtatccactacttccgtacaatccgtctcgataagattaatttgtggttaacgaggaagaattggattgagacgatacagtcagaggcaaaaattatctcctttaatttccctttgcattccttaccatttaaccatagttggtgtcatggggtgtgtgattttcttttttatattacatggtagctagatgcacataccactacacacgcaacaccatactcacacaccttgtgaatgtgtcccctaacatatactttaagagacggaaaccagcgacatatcactgatctcactaaagtcttattgaaagtccatatgcatgtgtgtaatattcttagacattaagattttaaactctgatagatagattcgtacacctacgactctaccaccatactattggtgattcccatggttgtatgattttgggcctttgaggtgtggagaaaaacataaggtagctcctaaatcaaacttaaagttaaaaggaccaaatactgccccagttgacacgtaattagcactaacctggagattaactgaagacccttctcgagaagccggagagaggacatcaaccagaggatggatggagctcaatcactggagattataaacgggatttacgacgatggcgccatggatagacgaggcagctgtaaagaaggcaggattgcttgcgatgatgatgaagacagtgttgacaaaaccgagcaagttgtaattgtgcagacatgccgtgcatgcgttaatcgcgtatacagtacagtttgtttgtccaaagcttggcagagctcctcaagtacaatttctaaggattaatataagagcacggttacacgtactaaactattagacttctactccctccgtttgtaatacatgacaccgttgatcttttgagatacatttgaccatccgtcttattaaaaaaaattatgtaatcatttattttgcttgacttgatttattatcaaatgttctttaagcatgatataattatttttatatttacataaaaattttgaataagataaataatcaaacgttggtcaacaagtcaacagcgcatacattagaaaacaggaggagtattaacattattgatctcaatcaattgatttaactagataggagctatagaaaatttatatgtacttctacagcatggcacatcagtgtttgttagtataggagtttactaaaaaaacaattagatttccgtgtgatatatggctctaaaatatgtcaacatacagctaggtagtcccttttccttaatataaaaaagttgctttaaagtaaacctatttgttgtttggaggaattaaattaaactaataaaaatcatatgagtaaattttctactatttaaaatagaggctactacttgataataacaaatgttatgcaagtaaaggacttcacagcattttcaagaataataacggcttgtgaggattatgcatgccagcctaattttttgctgctactaacaagaacggcgctagaataacggttacggtttgcacaagtttttcaatgctaactcaagtaggaaatgggtgattcatcatcggaaccgtcgaaattcagcaaatgtcgtggacggccagcttctaacattgacgaaaccagtggcggccagctgcatatatgcccactgaattgggcattttgatgcgtcatttacacataagttggaaatttgaagcatatatttccatcagttgacttcctccaggattaatttaactgcatctttaaaatatggtttctgaaaatctcttgcattagaacatcatacatctgcagacaattcactgtttgctggtttgcaggtgatatgatttgagcaagttgcggcgccattgttgactgatcacgttttagcttgtaaaacaaattatgagatggcgtgcgccatagtgtgaggatactgtacaacattatactcatgtagaacagaaactatgtaaaatgacacatgtaatgacttcgtgaatcctaagatatactgatatagtttttaaaggtactcataagaatgagatgtgcatgcatgtttgtatttatagaagtatgtacatctttacctgagcgccagtctttaatttatttccaaaaaaactacgtaaaacataccgagcttatatatgtgcatcaacgtcaatagtcacttacttcctccgttccaaaataaacgaatttaggataagatgtgatattttctaatacaatgaatatggtagaaacatatccagatttattatactagaaaacgtacatcacatcatagtttatgttagtttttttacttcctccatttcacaatgtatgacattctaatattttctacatttatattgatgttaatgaatctagatagatacattgtgaaacggagggagtataatacaggggaagtacttacaacgggagggaacaagaacagtgcaccaaattaggtgaacaaaggtacaaaacgcagtatgagtaaatgctacagtgttgattgcatcagccggtccaaattagattgacaagttcgaaaggaaaaaggatgaaaaatacgagtacgtcaaacatagtggtaagggtgtgtatgatgatagtacatagatatcgatccactacatcaaattacatatttttttccccatggccggcctccgaatttcaggtgttgattgccaaaagtctcctctccacattgctcaattggtcttctcaattaggcagtccaaactgttctgtgactagagtttgaatatcctcatgtgttgcttagaccgatagaagcgaccactcgtctggacctctcgtctcccaacccctcgtcttcgatggccttgccgccgcccgagcaggccaccagcgtgccaagcggctgtgaggaatgcggcagtggggcttcctcagcagggatctggctccgtatcgaaggggcgtcgggggcggtgcaggaagcggcaagaaggtgggcggcggaggcgttgcggtggcggccggaggtggtcgggcctacgtatggccgtgcgagctggtgtcagcggtggaggtggttggcaggtgtcaacgacagcatctcttcgggcggcggaggacgacggcagcctaagcatcgccggcgtatccttagcagggaaacggcaggtttgggtagaggtggactcgttcgcagcggcgtgggagtccgggtggaagacttctccggcggcgacggctaaggccctaggggcagcgctggtccgagacagcggcggcctgagtgccggtgcaaggttcacagtgaggaggaggcggatcccggtggcagcggccgccctaggggcggcagatgcctgtttatcgggtggaagaggttttcctcgatggaggttgcaaaggtctccggtagagccaacggccctaggggcggcgatgagctgggaatccaggaggggaggaggttcacgaagatggcggtggccctaggggcagtagaggcgtaggaatctagcgaagcggaggtgtatcataagtggatcttgttggctcgcgtttggttggctagttttagctggacggcgacggatgaaggtgggctaaactagtgacgtgtggcgtcaactcacctgaagcggaggaagatggcatcagcggagattcgcaacgacgacgcactaggtgtggcggcgactagacgactcacactcgctgaattttttggttctatgttcttctctttcttgagaggatatgtgagtctaaatgctcttgtatttttttggctgtgtatattatttgtggatatagaggccggattaatgaaaatccattatttaaaaaaatgtgttgctaggaccaggcttttcgtgacgaatttcagtaatcatcaggtaatacaatccttatgcccagtgagtgtttaaacacaactcttgctctggcagtcccaaatctgactcaacaagatgaattgttttataacaatatttctgtcacaatgatcaactgctaggacaatattcttctttttagtgaaatgatgccttaccttggccttttgtcccgagaaccagttatcatatatagctaattgccacaagtgaagttttttttttctttttgaaacaccatcctcctgctggatatgggccagttcggctgccattcctgcggcagcagcgcttgtgttgtgcggttgcaaaacaaataccagccgaacatgccctatattaagaagaatgggcctagtctacgagggagaccaaacccaaaaaccatacaaccaaacaataaattaagaaaaccatcaaaacctacacaaagggcaaaagagaaacaacctgtggcgataggactactaaggcacgactgaagacatcgagcaactccgacttcctaagacaagccagaacataccaacaaacccaccaaggagcgggaattactaggcgaagcctccgacaaggaaacaatatcaagaatgttgtcaatgtccgtccatagcaatatactaggttttcatctaaagaagaagatgaaaattgaagccaatgcaaattgccacgagctagtaaagtataaaatgatgacacgaagaacggacatcagaacccctgtattttccattaacaaaaagtatatctgtgcgttaatatggaccataattctaaaattatgtttaccaaaataacaggtggtattattatatataggaaacctccttaactgtacatgtgcatccatcaagctaacaagacaaaatttagttactgctggtgcatcatgcactgtttggacttcttccgtttgatcattaattactgtaacacattactgtgaaatcatgtcagaaaaaacaagagaaaaaaccaacaattaaaaacaagataattacgcttatgtcaaacaacaccaaacatttgctaatcagaagcatatattcatgaaaagtaaacttaattaacgatgcaagttgaaagcatctaccatgactaaaaaagtgagcaatatacagattgcatgcaagtaggactgagcagtaagctctggtttcccaaagaccccaaattatcaggattccataacttgtattcttcccatttcaaaagcactgcggtatgcaagacttcctaatttgaaaacattctcatctgccttcgttagctcagatgtctgcagagacttcccttccaggagcttgtccctcataattgtcaaggcttcaacaaacaaataatacatgccagtgatgacttgtgcacaagaaacatctatactactttaaaaattttaaaagtaggtaatggtgatggcagtaaatctgccaccccgcaaaccccattgcaatttttttgtagattaccccttaaacttttttataataaaaacaatcaaatctataatggtgttggcaatgattctgccaccccaccaatcccattgtaaatttttgtacgttgcctcttaaactttttgataatataaacaatcaaatctatcaccccaccaaccccattctaaatttttgtatattaccccttacacttttcataagtaaaaaaaattcaaatataaatagattgccacatataaaaatcaaataaggtgaatgttcactataaaaataggtaatatatttcaagatatatatttttatttgttttagacaatattatatttaatattttttatctgttacagactgcggacatttagctagtaaaagattaaatcaagaactaaatgttttggtcttctttcacacttcaaccttcggtctgatcctccgacttcctcttctcctccctcttcagcctcttcttctccctcttcagcctcctcttctccgccctcttcaacctcttcttccgcgccttcttcagcttcttcatgttcgaattccacttcacgttactgtccttaagatcgcgttcattcttgcccatcgaatcgggttattcacaattcagatctccaacagtactgaccctaccgatagtatagaaaaaccaaatgtcactcatctgatgcaacattattaatattcggaacaagaaaaacaaaatatcatttcattattcagaccataccctataggcttctctgatttgtcactagcagtaatgccattttcagcagcatgaccagctgtattgcaagaaaattctttctcaagcttggttaaaacttctgctgcatatgcccggatatactcacacatatcatacttcaggcacatgtcagggtcatcttcactcaacaagtaagatagtttcctagcctcctttgcgatccccttcagaacatagttttgaaattagcagcacaaggtttgtcagcaaaaaaaagaataagtaccaaaaaataatacactgagtggcagcttgttcaggtaggggaagtcacatacaaccaaagcagcagcggcaatggcagcatccgattcattcactttacagagcataagatttaaggcagactgccggagacctcattgctgaagctgatcgtctcggtgggatccaactcatgttccaatgaaatgcatatcaactcagcctccatcgtgatacacttgaaaccaccatttgcaataattgatgccagaaaaaaaaggttagtaaacatcataaaatgataattactgtttattagcacttgaattaggtagttaggcatgcatgcgtaccaccaagcctgcagctgcagcagaagattcgccctctgactgaatcatatggcttgcacactccttgatcttggagctcaggatgatctcttcaaccgtgagtgcactatgacagctcctaagcaacttgttctcaatcttgatacactagaaacgtttggttgttttgcaatggtgcaatgaagtttattaattaggaactgaatcaatgaaacaagtaaggtcgccacagtaagtatgcgtttgcagaggcaggaagacattaccaggttggctgcatcatggaggacaccacatccagcaggaggaatgccttgtccctggacagacctgagctgggagcagagagtggcaacttggccagcattgtggctggaatactcctcgaggtatttcttgaattgtggccactcaacagaactagaatggtacggaaacaacctttcccatccccatcctctctcgaaaagatcttgagtagagattaaaaaaattactcagtaatactgtactctccaaattactctgtccatcctaaaatatactccatctgtcccacttgttaaggcgcgatcaaacgtcgtacagtcttcaaaataatatttgactttaaaattataataacaatgtttgtagcaacaaaatcataatcatatgaaaataaatttaaataacaatcgaatgatattatttttatcaaatgaaattaaatntatattaaaatatttattggtcaaatatttacatagttgaattttaaaatatgtgtatgtcttagtgagtgggacggagggagtaggacacaactatttttttatttttttaatgtttcataatacaatgtatgcatgtatataattaactaacgcctcccctctcccctaaattcattttttttatcatttactctcaacatctctaatcccgttaagtgcatacaatgtacttgatatgattcaaacgagaaagataatagtaattattttttgtttcttatgttagtgatggttgtaacttatatcttgggaggaaaagagtaaagtacacggtactctccaaattatagacccaaaaatacatcatatctctgtcaagaagaaaaaaattccaaaaaaataaaataaaaatctcttctctagatggattgaatcaggatccagcaaaaaggcaaaacattgaaccaagcatacatataacatatatccccaaccgtagagaggaaattcgtactacctggatagtcgatcaagaacaccggcggtgcgtcgagcagatcggcggtagtctcctcatcctccttgtcggcgacccactccaacgccatggcttcgcacaggtattccacatcacgggggatgtaggtggcagtgatgggcacctctgatgacttggtctctccattgctactcgcatctaccaccatggatctcctcttccattatagagtttcgtggatggattgtggggggcgaaacgcggggaggttttttttctttttgaaatctttgatgcggggagagtgggagacgcaagagaaattggacattaggccactaccaatagtgggtttcatcacaatgctattccgcggaatggcgttgttaaaatgccactcacaacagatgccaaacatttgtttttgccatttaagccaattctctccatgtccacctaattttccacccgggctgactaaaatacccctccggctgtcacaagcgagttgttcgtgccgccggcgcccgcaccgcccaagctcaccgccgatgacgtcccgcccccatggctgaagcccgctgcccacacatcggagaaagagaaggaaaccctaagccggccactgcgtcgcgtgccacaatctcctccgtcgtcgcgcccgccggccaccgcgccgctcctctcccgctaaccaccgtgcgccgctcgccaccatctcctctgccgtcatctccaccacatgccgcaggctgcacgccaccatggcccaagaaggctagctccaggaggagctcgtggtaggacaggacctgcgttgccgtcttgggctcagtcggcacggtgactgtggtggggatggagatcaacgagccggtgaccaaggcggcgggaggtgagccgaagccctcacgctcatcctcgctagctctccggattgtgtgtggtttgagctcaaagattgtgttcttgaatttgtagagcaagaggaggagccgagctccgccgagcctgaggttggcgccacccctgccgtcgtggtcttctcctcatcccacatgttcgccggagaagagaaagaaactgtaggagagaggggtattttggtcagttgaagtgcaaggaatggtgaatatggcaaagcaacggcttggtatcggttgaaagtggtattttaacgacgccattccacggaatggcattgcggtgaaacccactcttgaaagtggcataatgtctaatttctcgagacgcggagcaaaagcagaggacgctctctctgggccgggcagcccactggcatggtgagacacacaagacccagtaagcgccatgtctctctctccctgctttgagaggagatgtcagatgaaaagagaagatcgagaaatacaaaatagtgcatgaataattgaatattaactattttaaattttaaaaatagattaatataacatttttaaaaacaactttcctatagaaatgtttttttaaaaaaatacatgcggagaacaaaacaaatctcctctcaatcttagctgccgaacgcagtagtcagctatacaagtactattttcttttgaccggcgcaatcaaaagcaccgttttcctttgttcgagagctgaagaaaatagaagattgagagagatgaaaatcgagctgagttattagtatatgattagtttagttgtatattaattaatctaaacttgaaaatgtattaatacgattttttaaaacaatttttctattaatatgattagtttgaaaaatacgcgtgcgaagaacaaagtatttctcctctgtatccactgcaaaacaatacagccttagtatgacaaattatccgtcatcccccatccgatggaaaaacatctctatctccaccatctctactactttaatttaaatgtgtaatcctttacccgaaattgctaattggctcatacgcgctagataaataactaacgcgcgtttcagttttggcatatcattagcaaggccaaaggcccaagcacacttttaactttatgttttttcgtctgacggcgccagcatatgcacgtgctagtatagataggaattaacacaaaggggcagttgggcaagtgaggcaaatcaatgtacaacgtgattaccgctataattcttcattattagttttaatttttaattaggtgacgtgattaatatgagcactcatacctgaaaattttcaacctgtttttaaaactttcaacttaaatataaaaatttcaactcaaaattttgaaactttcaacataaattttgaaactttcaacccaaatttttgaaaactttcaactgaaaattcaaaattttcaactgaatttttaaaactttcaaatccatattttaaaactttcaagtcaaaattaaaatctttcaacgcaaattttgaactcgaatttgaaaatttcaactcaattatttataactttcaatttatattttcaaaaactttcaactgaaaattaaaaattttcatccaaaatttcaaaactttcaaatccaaattttaaaactttcaaatcaaaattgaaaactgtcaactccagaattcaaaaaaaaatcaattccaattctagaactttcaagtctaaaattcaaatcttttagttcttaatttcaaaagtttcaactccgaatctaaaatttaaatcttcatgttagatagtactccctccatctatttttgatagtcatatttctaaatctgaaaaatttatttttgatagccatatttcaatccaacaccctatcattttaatgactttctcggattcaatgcatgactctccattcttccacacataattggttacatgggcattgagaaatgtaaatattaatggatcgcttgtttacgaggaatgactagtagcatgtttaaatggatgataagtagaattacttatgtttggtctgtgtgccaagatgaaatattactatcaaaagtagatggagggagtatttattagcgttaatcatgtcattaacgctaatcacattattagcattagtagagaggggcagcttacgcgggttgatcggaggatttttatttttgtcgctaacaagaacgggaaaatcgccaaaagggtaacgacaaatcaccgattcctctgctccacgcgctcgcgacttgatcttccggcacgtgcgcattaggagcccccatcctttaccatcattgtagttctcccacacaaagaaacgtctcgaaaaaaaccatctcatccaaaaaaaaaacaacaatatttccacgcaataatcaaccagaaaaggatagaaaaaattaaaccttataattcatatctctcttctggcccttatgccactgtcgcatccatcctctccttctcatactgcaggcgcaaccaatgcacgaatagaacacatgcattgtattttgaattgatattttatttggtatatatccagaattaattttcaattggtgccggatttgagttttccaattggtagtgttgttgcaagaactcaacaagtgtatcaatttcccttccctctattctctgccctctatgggtgatatttacacatttatatacatggatatacaagaggaaaatgcctcggtgtccctatgccttacgatatgcctatgcgactggccggtgggccagccttggtcctagtggtaacttggtggaggacaggagagctgccccggtatgggggcaccactgttctcgaggggccttgctattacctaggtaaaggcatcctccgggtaatagcgtgctccgcctggcagccatcaacagtgtcagagttagttggggcgcgtagtgcgcatttattcgtgcccgctagcgcttgattcttgacttggcatgcgagggcatatcgaggcatgattcactccggccggcacactgagctcttcagacccctcggaggcccgtagcccttaggttccctccggagctccccttccgggctccgggttcccctctgggcttcggagctcggtcatttggagtggcaccggagcccgtggcgctgtgacctcccggagctcctccggagccgatcagccaccatccggagcctgcttaggtctcattcctctcgcccccaatgagatccgattctcctggatctccggaggcctccggagcgagggggccatccgcgaaccgacatggccctgattcatggtcatctcccggggaggaaggttctccggagcgctgcagcccttcggaggctagcgtctcctgatccggagatacttccccaacaggtagcaagatttaatttgataaaattttcaattactatcaagaatttgaagttgtgcgtgtcggtttcaaattggtatatcatatacacacagcagaccccacaaatgcaaaagatagggggagctctcacatttcttacaaatatgtacatattagtttcacctcacatgttagtatgcacacatttaagggagctcaaactcaccctttggaaagtaagttattatcaatctattcataagccttaatcgtttcatcatcaatcaatgatgcaaaaaggtgaagatttaaaatgcatctaggccctccagtggattttggctaattgataaaaacattccatcaagattctacttatgccgataatctagattcttccatagatatatctcctttaaccgagagaatggtgtatttgaataccaacaaacaactatgtagcgtgtgcctagctttaccaacacgatacccataaattatacggaattaggataacaagaatgaacacaagcccaaatttgctctatcatggctggtactccctcctttccaaaatataaaacataatcacccttaacctaaaaactaagaaacaattattatcatctctttgtttgaatcaccccaattaataccatacatacacccaatagaattaaagatcttatgagtataggatttaaaaaaataataatttaggtcagaggagatgctaattaattgcatacatacatgtatgacttatattataaaccaactttaaaaaatagttgtaccctatattttgaaatggagtaagtaattaaggtcgtgttggcccgttggccttgcaggcccacaccaaattgaagttacacacgactaacctcaatgattcgtcaatacgagataccaaaggcattaaagatgtggcgtggcccactctgatattctcaattcaaattaatacatgtcttgacgattctaagatatagtagatccaataatacataaaaggaccataagaccaatacacagaaaggaccatagagaaccaatatgtagaagggcattggcccgatctgaaggaaatttacggttaactttaaaagtgagcggcttgtggggtccaattgcaagatttcaatatccggccagttttaccaccaaattaattccgtataagaattagaatttacataatcatgaattggctaaggatctgattatataagttttggaactataaactctattttactttttctggacagaaatattttcagaatacactgggactgttaattcataacaaaaacactggactgcaaaagggatgagaaaaaaaaacaaactttgtatgcttaatgtaggtaatatccactacatcagattacaaatttttttttcccatgttacctccgaatttcagatcttggttatctaagtgtcaaaacattgttcaaccggtgttctgaatgagctaattaagcgcactaccattatctgtctccactccagtttgcctacttgacaccaacagtttgaatatccttatctgttgctgggagcaggctttccatgacgaatttcagtaatcactaatccagcatcatgtccaatcgcaactctgcaacagtaaggtcgtttcaaaaagaactctgaattaataaagaatgcagagcacatccgtaatgcatacaacgtaccgatagagttcacatgccacatagaagaagatgaaaaacatgccagttacaaatgttaaaaggagttcataaggaaaggtgtgatgacagtttttacacaaatagacaattgcagaaaagacagatcatctacttcataactcaaaaaatgagctgttctgatataaagtaagatctttgaggaatggataaattttaatttcaacaaatttaccgaaattcatgttctcagtcaagtttattttaattttacacttgcagaagttgcagggaagcagtaacattgtcaacaacataacatcaagataaatagtagaatccttttaatcactcaccgttttgaaccctttaagcaaactatagcagtaactttgccgagctcaaagtccagtacaccttccagcctagaagattatggaaaacagtgtcatttctgaaactttttggacatgaaaacatggcaagatcacatctcaaccttatgaagttgtgttaatatgtaccgcaaattaggaacttacttgaaggtagtggcattccacagacgaactgtctcatcatttgaacctgtgagtaggattggcagatctggatgggaacaaacacaggtgatacaatccgtatgtccttcaagtgtttgaacacaagtccttctctgacagtcccagatctgatcagcaacatgaaatgcattagaatgttacttccgcaaaaaacgatcaagagataccacaatattgttcttcaatgaacctgtcttaccttggccgttttgtcccatgaaccagttatcatgtacagctgattgcctcgagtaaagaaatcaaaacaatccactatagatacatgcccagacagtgtgaattcatgacgcgaagaacgtatattccaaacctgtattttttttccattgacaaaagcatacatatatttgtgttaatgacctaaattctcaagctgtatttaccaaattgacaggagggtacctgagcatccatcaagcttgcaacagcaaatttatgtgtatcttttgggttaaatttgatttgatatgctacgccatgggggtcaaatgtcctgatacactcccagtccttgttccagtcccacagcttgatctggtcttgtgagcctactgacagtaggtaaggctcagttggatggacatccaaagttgtgatggtccaactccaagcatgagctttgaatctcttcacttgctttactggggactcatatgtgtaaactcttatgaaaccatcgtgatgtccaaccacgaaccattgctttcgcgcgatgaacttggctgcagtaactgtagtgttggagtgagtaaatcagttagcattgctgtggcacatgtacaagtctatgcatggttagtagtgagtcagaagcatgcctattggtccatatgagccttgaatcaggttccttgtttcctgtggacaaatatatgggcaaatattagtccttgaacatccaaaagcatatttcaacatgctaaaattgtaggcatggagataactttcaatgaatttcactcacataggcaaactttacaacttataacttttttgttgtcattggcagttttctaaatttatagcgggtagtatatatgcttttagacaacagaatatgtttcttttttttttacatcactgg

SEQ ID NO: 19539 - DNA, 11416 bp, Oryza sativa
agccattttgttttaacatgtactacttggtattttcctagtatagcggtagcacaaattaacactaaagtagcatatgcagcttaccgagactaaacttatacctgcgtattacagttcaagatgtcaactgagccaaacatattgctcgtcaagatcctgtgtacataagaagaactttacttatagcagatgttttacagctgcttcaagaaggaaatatagtagtgttcaaagatagtaaaagaaaaaacaggctaacctgatttggggtaccctactactattgaacctaagcccctaaacccaataaaagaacttttattaggaaaaataatgaggaacataaccattggttaagtcatttggcctctacttcactttttcaaataaaaaaaaacataacaattgttaaatgaaaatttacacatcagtatatttccccataatttttatttttgtttttagctctaaaataatatggggtcatgccaattgtcaagtgtatttaccatcaaagtagtgaactaatacacaaacattttttccttttcttttggatatacacacaaatcttggtttcgtttgttattatggaaaaaaactagaacatatgcagtttatctcttctcagacccaaaaaagaaagactattcacataccatggttctgatggatgcacatctcttggaaaatcagaatgttccattgggatgatctgatcaaatgacacatcgactgaagttaacgaaataataaaatgaatgggttttcaaatgttataaaagtatgcaacatgcatggttttggtgatacaaaaacaactaaaacttatttcacctgatcttcctctcggtcctcctctttctctttggaacaagaactgttatggtgatcggcttcatgattttctttggtctcatttaagttcaaatggcttggcaatttgctctcaaggttgacagactcgttgttgtgtgagggtagcttctccaaggcatggtctatcggcagctaaatgaggtccaaattaatgaagttaatagaaattctatcattggtgaataaatatgactttcaaatatatatgcatgttttcctctctgagaaaaaaaatgtaaataattattttgtagtatatagttataaaattgtacactcagcatcgcaggcatgaaaaatgagcaatagttaacaaggttggacctcgataacgcatattaaattattaaatagagcttacttcacatgatttagagcaggttagatggtacaaaactggaattggtcattccgtcattacacttttgattccctaaaaggattactctcatcaaaatgcagttccaagatgtaggggaaatagtgaaacagaggttgttgattcatggaaatcactaatgaaacaaggaatatattgtgaaaatgaatgtaaactcatcccttgatacattatagtttttcttatcaaatagatgacaaatacgataatgccacatcggcataagcaaaatgattcctctgcattatattcctccaggaagaacattgcgctgtagccttttataaacaaaacacacgatagtaataattaattacctcaccaatgatagcttctttctcgttaatttgattgatgatttccactatattaggcctattttccctatcagtctccatgcatttcagcgctatctcggtgcatgtcttcacttgctggcaatatgcttccagtagggaaccattccttcctgtctctaacctagttttccaattccctagtacctgtgcaatcagaataaaagatgaagtactattcaaacgaaataaaatatttcctcagttctaaaatgtttgatgttggttagttcatttttaactaacaaacgccataaaaaaataaacagattgagaagtttagttagaaataaatagggagtagtttagttagaaataaacgttggttctgaactcctgattacttgatcggtaaattcttgagaaggaatttcggtgcttctgaagtgtcctgtaggtccaggtccagcaattatctctagcattacaacgcccaagctgaatatgtctaacttgtttgatatttctttcctctctatgtattctcgtggcaggtatgggctgcacggggacaaataatatgatggatttcatataaatcacatttcttattattagaaaaggatacattcaaatgagttatatattcagcttacattgtcccaacaagagtttttgtagtcatggttttgtctttagtgatgaacctggacaaaccaaaatctgcaattttcggcaccatgttgttgtctagcaaaatattggcaggctttaggtccaaatggtaaataggtggcttcatttccacatgaagatgttttaaaccctcacatgtccctttaataattttgtaccgtataggccaatcaagaccatcaactttatctgcaaaggtaaacaaaagatatatcaatagaatgcaaatacacatgactaattttcttccgagctgaatatgtactccaaccagtttcataatacttgccgagttgtcattttggacaaggatgtggtctaaaataaaatttctaagtcaaacttattaagtttgaccaagaaatatagcaatatttccaacacaaaacatactatcaaaatatattcaatgttagatttaataaaactaatttgatgttgtaaatgttgttatatttttctgtaaacttgatcaacctcagaaaagttcgacttatgaaaaagtcaaagtggcttataatatagaacggatggattataataaatatataattttattaaagtatctttcaagattaagctatacatatattttccatgcttcttaagtaaatattttaaaatttattcatagtcaaagttcaaaacattttaacctcggccttatccaaaacgatagatattatgaaattaggggagtagtgggactttgagcaatatcataccagaaagatagttttcaaggctcccccgaggcatatactcgaagcagagtgctctatgtattgttgcaaccaaaactggtcttcctttgacttgtccatgtgtatgttttatttcatagcagtatccaactaactgtacaatgtttggatggttgaccatcataaggttcccaaactcattttgtaatttcttgtcgtcaaaatcttgcgtatcatgaagaatctttactgcaattttatctccatttttatgctttccctattaaagatctagggtcagtactcaaaacatgataagtttgtgataacatttcacaagccgaaaatgaaagcatcaggctctgtttgttttgtcatcacacttttactagaactaagtttcatgcaacaataaaatgtggtgcagggttgattgctcacctcagtgttatatgtgcatgtattgcaggcttattattatttagaaattagaacccactacaatggtttcaccaattattcacagtaaattggtgtttacataccaaacttgcctttaacttaccttgtaaactgttccatatccaccttcaccaagctttcgctcctcagagaatccatctgtaatttcttctaacaattggtatgctacattagttggattcatagctgaatttgtaacttgtccgttttaccaatatctcctctctgtgtgatgagaataaagagtaataagtttctgagaataaagagtaataatttgggtaattttactatgcttgataaggtactgggagatgttatattttctagtgtcaaacttgatacctccagctaccatatatctcaaaataataaaattttgatacttacaaatactttcttaaataccgtaaaattttcctaataatttactcgttttatgagaagagaaagactggagttaacagtagcactctaaatcttgaactgaaatttctcaaagcctggtttatggcattgactaaatgtgaatgaagggattaaagaaagttcaaaatgagccccgagatatgcatcatttggagaaaaatcaagtgaatttcgactagttttcttactcccaacaactcacttcggaactcatagccacggcaatgtgtaagaatttgagtgagtactagtggagaaaatcctagccttgtattaaaagggaaaaaaaaggaaagaaaaagaaagaccagcaggccaagcttgcttatccatcaacagagacacaccatcagtaaccaacattccatcagaccaatgtgaatcatgaatcaaatgtaaaagcccaagctaattaaggagcaattgaacaaacagtactgcctgcacaggaattggaagcagtaattaattaattaattagcactaacctggagagagataactgaagatcgacctagctttcgagaggctggagaggagaaagtagagacgggatcaggctcaactcaatctatcgcaggagatgagatgaggagatgattataaactgcagtttacgccggcgccgtagacgacgagccagctgtaacgccggattgcttgactgattgattgtaccttctgatgatcagttcatggaccacgatcgagcaagttgaaattaaggacatctagggcacgcgtatacagtacagttatcttgtccaaacctgcatgcttattctagcttgctattccctcaagtcccattttaagtatagttgtgggtttctatgtccaatgtttaatcatttgtcttatttaaatttttttttaaaaaaaataagttaagcataaagtattattcatgttttatcatctaataataatatagatactaatcataaaaaaatttaaataagatgaacggttaaacgttggacaataaacccacaattgtatttaaaatgagacggatggagtacggattagtagtggtcattggccaagaaaatccgtagtgccaaaggatgagatggctaggtggggataattctgttctctatggaatcctagatttgtcaccaggtgtacctttttgttttaggaataaaaaccactcctgacaagtttgccgaaaacagaccgacgtctgatggaagcagtaaaaaccgatgacttttgatcaaaataattacccacagcccaacattgcatggctcgtgagttgtgatatatacagggcccagggacagggacagagctagaacgaaatggtgaaggatggcacttactttactctactttagactaattttagactgatatgaacacttgagtttggattgaggtggtgcatatatgatgaaaatagacgaattatagctaaaaatattttcttgatcagatttctaggcaccccctcttctacctagcttcacccctgaaaatatggcaagcctaatttactctgctgaaaaaggacggtactactatcagggacgggagatcatgattttagaaatacctcatggtttaagccttaaattgaaaaaatatatcttatttaatttttcatcgataagatattagtgtaatgtttgaataccactatcaaaaattatgtgcccgctctgatactactaagaaataggaaaatgcatatcacattcacatatggttgcatcggtgctgctactagtagctagtggaagttgaccgtcgacgttgagcaaagcgtgtgggctgcaggacttggattggacggtccaagaagacgaccggcctaacataacagcgactgcagcagcagccaacaagcagctgctctctgcagcagtgtgtacatacattcaaaataaaacaactgctgtaggattttgggctgcagccgatcggctgggctggacagctgcagcccaaaatgccgcaggcagctgaaccgatcagcccttgtattaattggatgggttgggcctattacttactccctccatcttaaaagacagtcatgagttttttgtctaattttgatggttcgttttatttaaaaaaaatagtatttttgttgttattagatgataaaacataaatagtattttatttgtgacttatgttttttaaattttttcaaaaaaagttaaataaaacgaataattaaaattgaatacggaaacttatagctacgcttaaaatgagacgaagggagtagttggaagtatctgttgacttcctatttacctcacgggataacttctttcactgattgaagggcttgtaatggcttactacaagagacacaaaggtaacctcaagaagaccgtcactagctgcaactaatagtatggctacttgtcgaataaaaaaactaaagaaactggaatgtccgaataccattcgtaacccaaatcaaagaactcgaccccaggttcattttcccttgccttttccttaaatactagtatgattttgaggaagaaattttgttgtaatctgtgatcacttttgtatttgagtatcatacagatgtctatcagaatctctgctaccacaaaaaaaaactttagtggtggtggtgagtcgtgaacaatccaacggttgaatattttcctaggatccttgtcatcaccgcaccagtcaacgcccctcccagagccatgggcggtggaaatcctagctcccaaagttggcgtcattgtcgcaggcgccaccgctgtcaccgcagctccccgcaccggatctatcatcgtcaaggtcatccacatcgctgaggtcccagtgcctaatccgccgccgttgagctccccatcgaattcagcgggtcccttaaggaggcgcttgcgaaaatcagattcttacatatggcttcttatgaggcccacttgcgaaaataactttatttttatgtatggtctcataagatgaccacattttagcaagcgtgacttgacccaccccgggtaactgattgttgcatgtggacgaccattacagctcgcctagaacctgtagtgggcctcgtccgcaaaaatcaattctgttgatagatatagaaacaatgctctactgaagtacaacttttacatacacatatgagctaactaacaggagggccaatgggtgcgttgttgataaaacattttttttcggtgcaaaacagcccaaaatacaccatatctttggaaaaagaagttctaaaacaaataaataaaaccgtagagaggaacccgatgatatataaaatcaaggaaacttgtcctacttgatactagatgaagaacaccgacagtgcgtcgagcagatcgtcggtgatctcctcatcctcctccttgtccacgacccagtccaacgccatggctttgtgcaagtcttccagatcacgggggatgtaggtggcagtgagcacctcctctgacttggtctctctatcgctactcgcatctgcgccaccgatctcctcttccattctagggtttcgtggatggggtcgaagcacggcggggggttagggaaagcaagttttcgaaatcttgacacgaggaaagtgggtgggagacgtagaagaaaagcaagggactctctctctctgggccggaccggtatggcccactagagtagcgagacacaaggcccaataagcgccaagttttttctttctctctcttcctctcttgatcgactatggaaatcaaagcgccgtttgttccatttttacatgcgcaatcacaacaatgtttattttgctttagggtaagtacaaatgatatggacttttagttaatactcatgtagaggatatcattctacaataattgagacaacaaaaccttttataaccattaatgcaccaatataatcttttattactcttctttccttttcacaaccccaaatgtttcctttaatatatgctaagagtcgattgtaagccatgattatacatagcaatgatatttctcttcgttttcttctctcttctatgttaccaaatttatttgcgtggcaatggagagagaccgtcaataaacatcattgtacataccattaagatgatggaaattatccttcatcaccaatctgatggaaaatatatctctctatatctctacttaaaaatggagtcatcatccttcagtcatatccttccaccgtgtgcatgcacgcgtgtgtatatacatagccattagatctaatgttttattcacaaccacacttatatggacctggcccgttacaacgcaggggcatgttgatagtatactaagtggagtcgtcttttccccaacatcgtactttcgcaaataaaagacttgctaaaaaccatctcatcttaaaaaaaacaatagtgttttctctactccttttaaaacagagttgttttcctccttcccaaccatcttagtttcccaaataaaaaaccgtctcaaaaaaccacctcatccaaaaaatacaacttcaaaaatggagttgtcttcttccttccccacaatcctactctcctgaattaaaaaaaccatctcaaagaaaccaccttataaagaaaatgacaatgttttctatactactaaaaagtggagtcgttttcatccttcccaatcatcgtagttccccaaataaaaaaaaccacctcatccaaaaaagaaaccatatttgcacgcgaaaatcaaccaaaaaactagattaaaaaaacaaaaccctataattccaatctttttttcatcccttctcccaccgcacgcgtagcacatccatcctctccttctcgtattgtgtgcacaaccaatgcatgaatagaccacgtgccatgtcttttgattttatattttcatttggtatcaataatttggttttctgaattggtatcggatttgagttttttaactggtatcaagatttaatttgatattttttttcattagcataaataatataaagttgtgtgtgttggtttccaattggtatatcatgttacacacaacacacctcatgaatgcaaagagataggaggagctctggcatttctcataaatacgtgcatatgagtttcacttcacatgtccataataacatttaggaggtgctcaaactaaccttttcggattcaaagtcaaatattatcaatttgtttgtaaactttaatcgtgttgtcatcaacaaacaccgtaaaatagatggaaattgcaagtgcatctaggccccatattggattatggctaattgatgacaacattccatcaagattctacttatgctggtaatctgaattcacccatagacatatccctttaactgagagaacaacatatttgaataccagatgactccgtggtgtctgcccaactttatccgcacaatacccacaatttatatggagtagggataacaagaatgaacacaagcccaaacctttcgctgtcatggctggcaagaaattaaagtcgtgttggtccttggcttttatgggcccatgctgaattgaagttgtaccgactaatctcgaggaccactcgtcaatacgagataccaagggcattaaagatgggtctttggctccattggtggtgtggcccactctaatactctcaactgaaattaatgcatgcttcgacgcaatccacaagatacagtaggtccaatacacataaaggaccatagagaacaaatatgccttggtacaatctgaaggaaatttacagttaactgcaagagcgagcgggttgtgtggtccaattgcgagatttcaatatccggttagttttaccacaaaattccgcataagaattagaatttacgtgatcatgtattggctagatctgattatataagttttgaaactataaactctgttttatttttgctcgacagaaatattttcagaatatgctgggactgttaattcattcaaaaaagaaaaaaaagcactgggatgcaaaaggaatgagaaaaaacaaagtttgtttttttaatacaggtaatatccactacgtcagattacaaaactttggttatccaagtcttctctccacgttgctcatttagtgttttgaatgagttaattaagcgcagtaccattatctgtttccaatccagtctgcctagcttgacaccaaccctccaacagtttgaatatccttatctgttgctgggaccaggcttttcatggcgaatttcagtaatcactaatccagcatcatgtccaatcacaactctgcaacagtaagatcatttcaaaaagaactctgaattaaataaagaatgcagagcacatccttaatgcatagtgcatcatacatctttgtagtcacagaagaagaaaaaaacatgccagctacaaatgttaaaaagagttcatatgtcaaggtgtgatgacaagctttacacaaaatagacaattgcagcaaaggcagatcttatactttaaaactcaagaactgagtttacaaaatttgaggaaaagataaattttaatttcaacaaatttatcaaaattgatgttttcagtcaagattattttgatttacacaattgcacttgcagaagttttatcagggaagcagtaatattcccaacaatctaacatcaagatgaataccgttttaattactcaccgttttgagcccttcaaacaaattatagcagtaacttgtccgagctcaaagtccagtacaccctcaagcctagaagattatgaaaaacaatgtcatctctgaaactttcggacagaaaaaacatggcaagatcacatctaaatcctagaagttatgtgttgggcgcagttagatgtacttacttgaaggttatggagttccacagacgaactgtctcatcatttgaacctgtaagtagtattggaagatctggatgggaacaaacacaggtaatgcaatccgtatgtccttcaagtgtttgaacacaagtccttctctggcaatcccagatctgacataacaagatgaattgcattgcaataatatttccaaaaaaatgatctcaactcctatgaaaatattcttctttagtgaagatgccttaccttggctgttttgtcccaggaaccagttatcatgtacagttgattgcctcgagtaaagtaatccaagcaactcactatatatccgtgcccagacaatgtgaattcatgacgggaagaacggatattccaaacctgtatttttttttcattaacaaaagtatacatatgttcgtgttaataacctacactctaaaattgtgcttaccaattgactggagctaaacgaaaataagaaataaaaattcattgtacctgtgcatccttcaagctcgcaacagcaaatttatgtgtatcttttgggttaaattttatttgatatgctaggccatggaggtcaaatgtcttaatgcactcccagcccttgttccagtcccacagcttgatctggtcttgtgagcctattgacagtaggtaaggctcagttggatggacatccaaagttgtgatgttccat

SEQ ID NO: 19540 - DNA, 445 bp, Oryza sativa
ttcagccgtttccacaactctttgattatcaacgaagtgataaggtattaaggtccatggttagtacttagtaggacaaagcttatatcctacaccactgacaagtgatattctaaaagggggtaaaccagttgttggtctatatacgcttggattcgatcagagaagccttccccccgcgtcgcccccgcgcaggcgacacggggggcgaaaccctagcgccaccgccgccttcctctccccctcctcacctcgccgccgccggagctcgccgccggcaaagccggctggcgagctaggatggcggcggcggggccttctcgcggcgacgtctctcctctgtgcccgcgcgcgggttgggggggggggggcggcgttcgtcggcggcggcggggtctcccaggctgggcggcggcagatccggccccgccgccgccggatctac

SEQ ID NO: 19541 - DNA, 679 bp, Oryza sativa
tatagggtcccacaaaacgcggtgccaattttcctttggtacgaaaacgatgaactcctcgaaaaggcgtgacacgaagatacacataatctccttcttcaaaactcaaatccctacggcgattgtcggcataactcttatgacgagattgagccactcgcaatctttcctgaatgattttcaccttttcttctgcttcccttaggatatccgtcccgaaaacctgacgttctcccgtttgatcccacaaaagcggagtgcgacacttccgaccatacagtgcttcgtaaggagccatctgtagactagcttgataactgttgttgtacgaaaattctgcatagggtagattcttatcccaacttccaccgaagtctaaagcacaagctctcaacatgtcttccaaaatctgatttaccctttcggtttgtccgtctgtctgcggatgataagcagtactaaaattcagcttagaacccatctcttcctgaagtttcttccaaaaatttgaagtaaactgactgcctcgatcagacactatcttcttagggacgccatgcaaacacacaatccttgccatatacaattctgctaagcgactttcagaataaagtgtctttaccggaatgaaatgagccactttggtaagtctgtcgactatcacccaaatagagtcatg

SEQ ID NO: 19542 - DNA, 663 bp, Oryza sativa
  unsure (1)..(663): unsure at all n locations
nnnnnnnnnnnnnnnnnnnnnnnnnnnnnnnnnnnnnnnnnnnnnnnnnnnnnnnaaatcggtgccgccggccgccacagccggaagcaccgccggctgccgtcgcgacacctgaccatggccgccgcctaccgaagcccgcaccacggtattccaaaccgtagaggggagggggttggaatagccttgccatcgttatcgtggttgccgtcctcggcgcggtagacatcgttgtcattgtggcagccgccgccggatccacctccttcacggttgtgaaggacagcccgagcaacgccgccaccggatccgcacccaccctcctgtcaccgtcgctgccctccccgccggcctcccccattgtcgcggcggctgattcggcgtccacggtcactgcggcggctgatccggtctccccgtcgccgcggtggtggatctggccacccccatcgtcacggcggtggatccagcctcccccgttgtcgtggcggccagcagcgaaggaaggccggtgggagaccggggggggggggggagggagaggaggcgtgggccatcgcagtttgccggccgcctgtcaccgcgccgctgctgagccaccnnnnnnnnnnnnnnnnnnnnnnnnnnnnnnnnnnnnnnnnnnnnnnnnnnnnnnnnnnnnnn

SEQ ID NO: 19543 - DNA, 4394 bp, Oryza sativa
ccatttccacccaactccggccggccactctagtggccgtggtcatcctccccttcccctaacccggtcatcgcctttcccaggttgtgctcgaccccgtccgccgttgtcggaagcgccggccgccgctcgtctcttcccacgccggtcgccgccatcgcctcggtgaggaatcccctttcctccttcctttcctctcccccgtgagcgccgccgccctccgcgcgtgcgccgtcgtcttcggctaccgccgccgccttcgcgccggccgccgccgtctccccgcgccgccggtcaccgccggcggtcgtgcgccgtcgtcgcctcgccatggccggccggcttgagccgtgccaagccaacagccacgcccctctcccgccctgtgccgctgcccggtggggcccaccagccggtggaccacccctcccttttagccgccaccagtggggcccacatgccgacgccccctccctctccccttgtgccgctgccagtggggcccgcttgccagccgccccctctccctcccttagtgccgctgaccagtggggcccgcctgtcggcgccaccccctcccctcgctgacgtcagccctgggctttattgcgcaataaattgattaaggacttttctttattagtaaaaacacagtttatcttctaaaattcataagtaattcatccgagctctgtttaagtccattcaagtctcagtaaatcaagaaaaatgcaaagaatccattaaaaatagttttgtttcctgtttcagtagtcttatagcatgttttgcttgtgtgctttgtttgtcgcgtaggtttcggccgtttcgtcgatccacggtttctcgaagacgttgctgaggtctcgtcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacacatggggatcacattattacatagactttgactatgagcatagctttggattggtgccaccgcaatggtgttagttaattaaaatacattgaatggtgggttgtgggtgcatggttttgctggtcgcacccatggcaattaaggaccggttcacgggaaaccctgggagacttaccgtgcttaccacaagcgggagtgggtaactgcttgatctgaaatatagctcgaccctttcctaggcaccggtggcgagggtgggcgtgatgaagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaaactgccatgtggcttcctcaaaacgctctcaacatgccacatggcacaacgtgaacccgtgcctagaagttgaggacccacacgtgcgcttttgccatgatcataacatggagcgtatttatctcaagattagtttcctactttgaatcaatgaagctggcaagattagctatcctacgtcaacctaatatcacattatctctacatatacatatatacaccggtcagtagattagcaaattttaaatcgatcaagcaggcaagattattacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatgatttttagtcccggttcgaatgctgtcaggtcatgtcaggcccccccggaatcattaccaaccgggactaaagtcgtaactttataccaaccgggactaaagatcccggtgatctttagccccggttggtgctaccacccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggggaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgccggagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttg

SEQ ID NO: 19544 - DNA, 2185 bp, Oryza sativa
tattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacaattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacaaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaatgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcaatcaaccaacaacttgccttcctggcgaggggactgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaattaaataaacggcgcagacggttccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaagataacaaaggatggcataatagggttgcatttgcaaaagcagcatttagcaaacatttgagaatttgataaaacaggtaagtaattaaacaatattaatccaacgctattcaacataccctgttgtataggcccaaccattctgaacaaccatcccgggtgcacagttctatctccaaaccaggaatgtaccattccaaaccaggagttgaccatattattaccagattaagcatcttttattatgatg

SEQ ID NO: 19545 - DNA, 1082 bp, Oryza sativa
actttgtaaccataatatactaggagtatttctgcgccattgctgggaattatatttctagtaatgtcgttaagaaataccaacagacacatgaacgagataagagcctggaaccctagaagggcggcgacttggatctcaaaggaacataaatgcaaatttcctgaatggttgaaggaaaaaaacttgccgttcggtgaatcgcttgcactggctggcaactggcccaagtagcctcatgaactcatggcaattgtacgacatcggcggatttatgttttacacataggcaaggacaagaaaagcgcaggttagaatagtggagttcgtgtggaggcgttggacgcaataggggagaataagtcatactacggataatacaagacatttgggagcttgactatggcattaacatccaggtcccggagctatgatgccagtgggtcaaagacacaacaggcctatccatcgattactacggctttacggttctggaacgtagtaaactaagccacaaggatgatccatgtgttctcgctaatcgtgttgcacaggttttctatgtgaaggacccatctgacgagcggatggacattactgtaccgggaaagcaacacatctttggcatttgataacactaaagacgcgtcagtttacaaccaatacgacgacgtcccattattcacagatctacctaaccagatcaagcgaattgagacaccccttgacgaaaagaagttttcgtccgtgtgaaagaatggtgttccgaaaattgtaaaccattagtatatatatatatatgtatatatatatatatgtatatgtatatatatatatatatgtatatgtatatatatatatatatatgtatatatatatatatatgtatatatatatgttgttgtgtacaacttgtttttgtaaacgattaatgtacccaacttatggctcccttcaaacgattaatgtatcaaacttatggttccatgtttatccatactatatgtgtcgttctcaatttatatggttgaataatttatttctggtaatcatatggttgaataattaagatgaggtttgat

SEQ ID NO: 19546 - DNA, 1098 bp, Oryza sativa
acgtgtaaccacgtgccacataccaccacggtatacggacggaaaacgtgacatagtttccaacccatcctagccatagacaagagtaccgacccaatcctgcctacggccggaacccccgggacaggcaggcaggactgagccccaagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccaatttggggattttgaatagaaggagcggtgtgaagccaattccacaataaccaaaccattccatagtgtccaggtgatatgaaaattcccaaagtctaaagttataaaattacctaatgttgcctaattaaattgcgaagcatctacctaaaattaaactagtggtgccatgagtagagtgtccactagttggggttttgtttactctagggtgaacaaggaaataataacaatagcaataataataaggtcataacaaaggtaaataggcatggctaaataaaacagtgataacgcgggaatttaaataaagcgataatgcattaatttaaattaaaaataattttgtaaactgggattcaatatgctcaaggatgatgtgacttgccttgctcgctttcccaaatgccggcttcaacttccacgaagagcggatcttccgaagctgcagcgtctacacgaccgacggaaaagaaaaggcttttacgctaataaactccacataacagcagaaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaattaaaaa

SEQ ID NO: 19547 - DNA, 1945 bp, Oryza sativa
  unsure (1)..(1945): unsure at all n locations
cgagccactggccgctgtgctatgccgtgcccttgctgctgtaccgtgtcgcagccgtgcgtcgcttaaacctagccgccgctatcccgtgttgtcgttgttgtggtttgttcgctgtcgttgcccggtagccgagttgcaaagcctaaggtgcatcccttaattcctaccggcctatcgtttgtcgtaccgggactttatcgtgaaccgtgtctagctcaccggtttagtcgcagccgttattgagtcgttcgctcgttcgttcaaacgaggtgttccccttgcttcgttcgttcgtccgtgttgagtcgtcctttagtttagagccgttcagagctgccggttccgttcgccggtttcggttgatcatttgggtgatcccgtgtcacgtagaattgactcgttaagtcggtatctcgtgaggctcgcttgccagatcaatctaatccgttgaatcttggtcaactctatgtcaagattaatcttagccatccaaaatcaatataaatccgttctctcttttcaatggcatattagttcttttttatcatatggcatctaccaaatataatctaatctttttccggaggttgttttaatcttttatctcagttataaattatttgtaaattgtttaattaatttggaatagtcttttctttaataggtttaattggaattaatcttgtaaaattcataactaattcatatgaagtcggaatgaggccgttcaagtctcataattcatctaaaatcatgatctacatgtttgtttactttatgtgtactatttatttggtttttattagtctttttcctcgttttgcgtgttagcttgtcgtttccgtcgtttcgaaggatcgcgtgtgcgtcggaagtgttcaagaagattaattgaagacccactattgcaaggcaagtcacacagatcccaaacacaattcttttgagcatgttgatcctttatttaaattctctatttttttcaactgtgcatttattttcgaatgtcatcgggtggtgtgaaactgtttctttgttatggccaatttgcattgattatcctatttcttgattacctcggattataatttgactagttggatttatatcttggttcaactagatatattagatataattgcttagtcatgcttagaaatattagcacactattgggataactaatgtttcactattacttaatgatgtacatggtaaaggtagctcacgatggtcaatcgtgattagttaattaattaatgtgccaactaaaacctggtaatggttggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcaatggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcataataaaagatgcttaatctggtaataatttgtttagctcctggtttggaatggtacattcctggtttggagatagaactgtgcagccgggatggttgttcagaatggttgggcctatacaacagggtatgttgtatagcgttggannnnnnnnnnnnnnnnnnnnnnnnnnnnnnnnnnnnnnnnnnnnnnnnnnnnnnnnn

SEQ ID NO: 19548 - DNA, 339 bp, Oryza sativa
attgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacacaggacacaaaaactcaatttttttatttacattttagtgatacatgtttggctataaattagccaaccacccatcacctaatgttgcgagaatctaagatattgagctcactcctaagctcgcaaaatcttttctcatctaaaggcttggtgaatatgtcgtctaa

SEQ ID NO: 19549 - DNA, 1108 bp, Oryza sativa
gaatcatttttgaaaaatgattttctccccaggacagagagggctacccggaggttctggccgaaacttccgggcgccgtttaattgcaaaaattttcctaagtgctgcccggaagttcctggcacttttgcccggaacctcatggcaggtttccagttcaaacatgtgagtaacggctagatgacgtcacctagcggttatatatatggatttcatccccaggtcaccctttttccattccacttcagttctttcatgttctagggttttctagctactcccaagcttcctttgcttcctccactcaaatctagagcctatcttgtgagattgggaaattagatgagagtgtaggagtgttttggagatggcttgaagattaagtttgattgagcactttggtgtcacgttctgataaattcatcccaaaattaaaattcattctctaaaaggaataatagaattaattaaaattcgaaaagaaattggcaaacactaaaatacgtacaagaaaaattcaaatgtggcccggagaatttttgttaaattcttccttggtctaaaaggagccctcaaattttagtggaattttcagagcacaaataataattattaagaaataaacaaagttgaaaaggttttataaaaagaaaaatccctaaaagaagtccttttccccccctcccttcttgggccggctcggcccagtccctccctctctctctcttcccccgcggcccatcggcctcccgcgcgcgcgcgccgctgacaggcgggcccgcccgccgccctcgctgacgggtgggtcccacctgtcgtcttcctcctcgcgccgcgccgccgctcgcccgtgccctagcgccgccgccgccgcggatttcgccgcatcccgccgtccccgcgcgcattaaagagggggaaaatcacccccgtgattccctctcccgtttccccctcttttccctctctctccctcggattcgttcgaatcgcgcccgcaatcctcgccggcgcaatcaatggcggccgagatctccgcgcccgtttactcccttttcggccgcgctctccccctttcggcgctatataatcgttccccgagctccg

SEQ ID NO: 19550 - DNA, 490 bp, Oryza sativa
  unsure (1)..(490): unsure at all n locations
nnnnnnnnnnnnnnnnnnnnnnnnnnnnnnnnnnnnnnnnnnnnnnnnnnnnnnnnnnnnnnnagatgcacataagtaaagcaaggatcctatcatggagcgatataccttttggtccacacatttaccattatcgtcgaggtctaggtggccattggtaggcatgggtgtcttgataggtttggcatcctccatcccaaacttcttgagtatgtctttcacgtacttggtttgagagatgaaggtgccctcttgtgcttgtttcacttgtagcccgaggaaaaaggtcaactcgcccatcatagacatcttgaaacttttagtcatgatactactaaattcttcacaaaaagaggcattagtagaaccaaatattatgtcatcgataaaaatttggcaattgaataaatcattttcaagctttttagtgaagagagtagtgtccgccttcctaatttcaaaaccattttttaaaaggaaatcttggaga

SEQ ID NO: 19551 - DNA, 887 bp, Oryza sativa
gaggttgagtaaatagttaacccgattaaggatcataatcaaggcaagtaccctccctccctttgaatatattgaaactcaagctttcggcaaacatgttgttttacaaaatttgcacatgtaattctaatgaaggaataattagaataccttgtttgtactcaaatggatctatttatctttttatatatgccaaatactttgccttgcttgacaagcttatcatggatatggatcatacttatccatgttgttttgaacacatttaaacttatttccatagatatgccatggagaattaccatagttggccaggcaagaaacttgcaactactatgtgcacctcagttatacacctacaaatatgccaccagacacgctgaaatgactgcagcgcctgcatcactgatttccccccttatatcagattcgatacggtacttgggcttcgatcttaatttctttctagctagctgaaccacagatatttaaaaagaaacgatggagctggtagctagcgatagatactctgaagtctgaacttacagtgctttggatcaggagtgccgtcaactgcacgagaacatatgcaaatcgagtgtgtcgtgctggcctgcagctacctatctgatcaataattaatatgtgcatgcatatctcatgttaatttactctctgtggatcgatgcctattgtcaccttccttatatatatatatatatatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgattcatac

SEQ ID NO: 19552 - DNA, 2241 bp, Oryza sativa
  unsure (1)..(2241): unsure at all n locations
gcccgccccggccggctttctccatcgccgtgccagccgcgcccgcgccggccggctttttccaccgccgcgccggccacacccgtgccggccagccttctccaccgccgcgccggccggctttttccaccgttgcaccgccctggaggaggagagaagagggagggcgtccgggccagaaggccgccgccgctactccgtcgccgctgccgcgcaaagggagagtggcgagagagagaggggggttccaattatgatccgtcacagataaacataaccaacgatgagttaaaataactacccgtcacatatgaatgttacatacgacggattttggttacagtccatcaaggttaactcttaccattggtgggtcttttaatccagagttatcagtgatcacttatctgtgatgaggacctaacgcatcgcaggtaagggtatgagtccgtcacatatgacctgatcgtatagtgtgaggtcatcctctagtgtactgcacaggccggttccctcgtgggctgcttgtgaagtaaaacaatcgtgttaagcatagttttttggtagtgtgtttcatatttatttttcacgcgttgaaataggacaaaaagttgtttctcacattaattttcacataaattgtatttcactgtgattttgatccatatagtggttttcactaacatgaactcattgtgggcctgatcgattgagtgacctgtacaccggtaaaaaagggttaattggatccatgccactacaaatatgtgaaattagaaaaatgccactactattcacgatattatagttgggtgtcactgcaattttagaaaattagatccatgcaactccgtcgcgtttttccatccactctctgttaacaccgtctctccgcggtgccgcttcgcatttttctgtgtatggacgccgccgccgctccactcgatggaggtcaacttcgccgtcgacgacaccatcgcgaagatcgaaggcggttgcggccgtcccggggcccggggtcttggacgcagccatcgccatgtgggacgggaagacggggccgatgtcggcggcggcgccgctgaccacgcgaagctctaaaggtcatcgtcgctgccgatggcgcccccgagcagcctcgtgccggcgacggagtagtagggaagcccgtcctgttcgaatgaatcaatctccctgaccccgtcatgtcgcgcgggctcacgcctttcttgcggaaatgccgcgacgatgttgctgttcaccgcagtgttgctcgccgtcatcgagttgcgccggccgggcaacacttcccagttgctcccgcgcaacaggacaaagcacattagttactggcgtgtgcagtgcagagcatcatggccatggagatgcatgtacacttagcgccatggccatgcaggtttatgcatgtatatatggaccggcgtgagcagcgagagcgaggatgtcaggaaggagaaaggagacaacgctggggcaagatgagcctgatagtcgccgccgtgagcgtgagagggccgcgacgctggtgactacaacgcccgtagctggagctcctcgtcatcttcgtcggttcatccgcctcctcgcgtcattgctgcagtgctggaagaggtcgatcggcgggcgaggtgcggcattcggctgccgcaccatgagggcgtcggacagtctggcgacagccgcgcgcgctgtcaaattggcttgcggccgtggccgtgacgaggcggccgcgcgggctagacggcgccgtggagtacgggctcaccgccgtggccgccgagcacggtgtcgattggccggaggtacctcgacgccggcctgctaccgctgccgccgccgccggcggcatgcggcgaggtgagatcgtgctcctcgtcctccacccaaggcgcatcgtcgccgcaccatgacctcccggccggcgtgcacgagccctcagggacggccagtgggcgcccgtgggtggcgtcgacggtgtagacgcagtcgctggcgctgcagtcgacgtcgtctgggaagtactcatcatcacaaaagtcgaggttgccggcgtcggagtaggcgcccgtggaacacaggaaggcaaagccaggagtgacgcagagagacggcgtcaacgtggagggatggaaaacgcgacggagtggcttgannnnnnnnnnnnnnnnnnnnnnnnnnnnnnnnnnnnnnnnnnnnnnnnnnnnnnnnnnnnnnnnnnnn

SEQ ID NO: 19553 - DNA, 548 bp, Oryza sativa
gagaacatctttgccaatctcttttatcaatcatcttccggcttatctctaacaggtggtattctttgatgtggattgcggacgcttctggggacgatgaggtcctttggcttgctgcctttccgtgaaaccttgatgtggttcgtcaaagactagactgacgattgttgcctttgatccgaagagacacatctgaaactcttagtccaaacaaatgcctctttggttgatcacttgattttcttcgccatcaatcgctagactatttgattcctaacagattttgggtttacggaaatgagaccctaggtctccctaatcaacaacaaaatgtgcacaactcacagcacttgcactcttaacatggatccttcataagcttatcaaactcattcattatctcatgtttctctgttattacatgattgacggggaacaactataaaacaaaagtatttgaacactgatataagagtattatggttgcttctgactagcgctaggcttatcaggtactgtatttgctccagtgaccacttggcgattgg

SEQ ID NO: 19554 - DNA, 814 bp, Oryza sativa
cactgtggtgagttgtgttgtgtgaggggtattgtcacagttcctttccgaggtaccgtggtggtgctgaggcgcatggtgacatgttgtgggattgtatcttgtgggtacagtggtacacctctaatcagagtaaaactattcgaatagccgtgcccgcggttatgggtgagttgagcaatgtttttcgtgattaatcccacactattcattaatggtacttgtgataattaatttgactcctggtttggaatggtatattcctggtatggagtttggatttgtacaaccggggttggttgttcagatgaggttgggcccatgcaacacggaagtgttgtatggtgtttatttaatactgcttaataattcaactggtttactattctcataaatatttattaaatgctgtttatgcaaatgagctttattatgccgtcctttgttatcctatgcacttgcatatttgctgtgtggcttgttgagtatgtcatatgctcattcttgcaatattcattcatcagaggaggagtacttcagtgaaggtgatctggaggactaggcttggtccgggttaagttgcctgtggagtggagtctccatagttgttccgtagtttgcttttattttttttccgctgcgtagaatgttattctttgagaggaactatccacctctgtaataatttattatttgcgaatattaaatagctgtttatttgtactctattatcgatttgttattgtgtgccttggctgatttctggacgagggtttaacacacatgtaagcgtttgaaattttgggtagaaatt

SEQ ID NO: 19555 - DNA, 3735 bp, Oryza sativa
gcctctccctcttagaccgtgcgccgcccggccgtcccgtcgccttccccggcgtcgcaacagcttcttctcccccggcctgccctccgtttcgcgcggtgaccgccggaggcgcgttcccgccgtcgtccagtggcgttgccgccactgtaccacctcaagccgcccttgccgcgccgctcaggtgcgggccgcccgcgccgtctcctccctcggtgtcgccgcgtcgacctccaccccggcctgccctttgattcgtccgaagaccaccgtcgtgccgcgccggcctctccatcctcctcgccggaatttccccggtcgaccgcgtcgccgtcttctccggcatcgcagcggcaaggtcgtcctcggcatcgcttcccctccatccaaacccctccgcggtcccatcatcgtcgcctccgttcgttctcgtcgtcgacgtcccgtcggtcgcccggctcgtcgtctcgtggcgccacctccgtcgtcggcatcgctgcggcgtgttccacgccgtcctcgcatctgtgcagctgctgccggctgccctcgtcgcctcctcgccggccccggtcatcgtcgtcgtcgtcctcctcttgttgtcctcatcgtcgtggcgttcgtccttccgtcaagccgttcgcgttcaccgcccgcgtttcgtcaagtgtgcagcatccccgtcgtcgtcttcgtcctcggctccgcgtcgtcaagccttgtgccggccgcgtctcgccttcgtccaaggatcaccgccgaagtcgttccctcgccgttcgcctccatcgtccccgagctgtctccgccgcgcccgttcgtcgttgtcgttcccatgcctcgtcgcgtggtggtaaggatccctctccctcgctgccccgtcctcgtcctttcggtgccgcccatgcccgttgtgcggttgtcggccccggtacccgtgtatcggtgtcggcagtcgttcgcttgtgcgtgtggtgaccgtgttagtgtgtccgctcggtagccgcgtggtttccacgtgtgcagcccgtgtggtgtctagtggagttcgtttgtcggccactcgcctcggttgacacacgggatctgcttctgtcgacccgtggaccgtctctgtgtacccggtctaccacggtcctttaggttgacatgtggggtccgcatgtcaacagcgcagccttcctgtcttttccagactagcgcttacacatgttttatagttgcaaagcctaattacaataatccgtaaatctccatgtaacaacattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcttgaagcgtggttcgcggtcgtcaccgaaggttcagcaggccgttctctgtgagcaaggcaagtcacatcattcttgagcatattgaatcccagtctataaaattattttgatttaaattaatgcattatcgctttatttaaattcccgcgttatcactgttttatttaaccatgcctatttacctttgttatgaccttattattgttattgatattattaccttgttcaccctagaataaacaaaaccccaactagtgggcactctattcatggttccactagtatgaatttaggtaggtgcttcgctgattaattaggcaacattaggtggtttttataactctagactttgggaatattcatatcacttggacatattggaatggtcggattattgtggaattggatgcacacctccccctctattcaaaaccctcaaaatggttttaggctgggctcggggtgcatggttttgttagtagcacctcggccacataaggaccagtcttcgggcctctgttgcaaagcactaccgtacttccacatgtctagtgggtaaggcttagtttgtggctcagtctggttataaacaaaagtacacggattggagatggacgaagtcgggggttgatggacattctccaggacaaatgaaggctacacgagctgcggcccggtagtcgagatgtcatggcacagggctggtgtcctgctgctaggggctcaatcctgcctgcctgtcccgggggttccggccgtaggtgggttgggtcggtactcttgtctatggctaggatgggttggaaactatgtcatgtcttccgtccgtatgccgtggtggtatgtggcacgtggttgcacgtgaggaagatgtgtcttgtgggtaaagatgtacacctctgatcagagtaaaacctattcgaatagccgagccctcggttatgggcaagccgagcaatgtacccaagtcagtgttttaaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaaggctgttactgcaaaactcaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttaaaaatgaaactatttgcgaaagtccctttttcctcctttcccctgtgctatttgcaaagtgtttattcccttttcttccttcttcaaatttcaactagtactagatggtcagctttgcgaagaagaagatgtcgtcagttgtttgccgaagctccggaagactgcaggatccgctagcgaagcgaaggaagaagtgaagccagctgtgaaggagtgaagatcttgggaacccgtcgcagaacctaagccaccctgtagggtagtgttgttagtcgtgtgttccttgcttgtgtgtgtagcgcgtggtttgcatcggtgggttgtgatgtaaccatgctaggttgattgcttaatcaacttgcagaataagtgaaacaaacaacacatcagcaagaagagttagttcctttaaggtcctgtctctagttctggtctattctttcctggcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccaagcatgccgcttagttcacagcta

SEQ ID NO: 19556 - DNA, 451 bp, Oryza sativa
ctcaaggcggagagaattgcattggaagcttgagcattgcggtggatgagttgttcttgctccgaagtgagctccatgtcatcatgaggtatatcaatacctgtacaaacatcattccaaatacttggatgcaaagagattagatgcaacttcatcttgtgcttccaagcagcataatatgtctgatcaaattgaggagcacgccctgaaggcacggagacgaagttgtgagagggaatggtaagtttgctgtaatcaaaaggtatagtagctcccttgggtggtggagttcccttgctactcgcttcatcttcatttcattttccccgttctttccccctaagtccgacatcgtggatcactcaaaggtgtgaagcttgaatcaagagcaccaggctctgataccaattgaacgtgcagagatgtagcctagaggggggggggtgaaaag

SEQ ID NO: 19557 - DNA, 737 bp, Oryza sativa
  unsure (1)..(737): unsure at all n locations
nnnnnnnnnnnnnnnnnnnnnnnnnnnnnnnnnnnnnnnnnnnnnnnnnnnnnnnnnnnnnacacgaattgtggtcaatctagcaccaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctccgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtatatctttcattgggaaaaagctctcaaagaaggtagcatcacgagactccataattgtaccaacatgcatgtccggtacctcggatttaactattaaaaatctataggcaatgctatgatgagcatatcccagataaacacagtccacagtcttaggtccaagtttgcgnnnnnnnnnnnnnnnnnnnnnnnnnnnnnnnnnnn

SEQ ID NO: 19558 - DNA, 555 bp, Oryza sativa
aaaaggctgtcctaacgatgccttcgagaaagaaaatgacactcaaacgtgctgccattgccatgaccgaacctgtaaaggccaaaacatatgtttctccttcattagagagcaaatctttgactctaggcagtgcttccaacagggaagggaaacaccattggcaggaacaaccagctaagggctgtcctaggaaaagatgatttgtagaggcatgatatattttcatatgcttataatatcttttcatattatcttttcattatgtgtcccatggagctccttatctaccgatttgcaaaataggctatattttatagatatttggttgttaaacctcgaggcattttgtggacctcagtttccgtttgaggtgtagccttatcagcctcaacctgcttcagttactttgaggcagagataatcttttgaggcagtgttctctgccacaatagacaatttggggcaagagtatctgagacatggggaggctatctcgtaatctcttttgagatagactttgaggctgatttggttgctttgttataaaaacgg

SEQ ID NO: 19559 - DNA, 743 bp, Oryza sativa
  unsure (1)..(743): unsure at all n locations
nnnnnnnnnnnnnnnnnnnnnnnnnnnnnnnnnnnnnnncagctcaagatcgtgaagatcggaatcgtggtaagatttgcaagctagaagacaaggtggatcgtttggagaaggaattagccgcattgaagggagaagcaccgccgcagaaggcctggattcgtcttaccgcaaggaagagagctctatttgtccctcgctatcaattggcgccaaaggttcgtgtggtggagaaagaagttgctccagctcaagcggatcctccggtcatcatcataagtagtgatgaagaagaagaatccaagcgcatcaattccaagattgagtgggtagcaactcaagatgatgaagacgagccctcaatcgacctccgatgcttggaagaactagagtgacttgttaagtcgttgtcttagatcgatgtgttagtttgcttgttttaagtttgcttgtgtgtgtgtggctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagttcccccgttttctcttcttgtgccctgtccatgccagatggtgaacactcgtagcaatgggaatggtcccaacaaccccaataacaacaacaatggagagaatcccactctggccca

SEQ ID NO: 19560 - DNA, 729 bp, Oryza sativa
  unsure (1)..(729): unsure at all n locations
aagccatgtgccgaagcacgcaagcaaaggccaaaagacctaaatccaagctttgcaatcaagagaactacgcaggcgaaggttatatgggcgaatggcatgtgacgaagcacgaaggctccgcctggactaggatccatgcgaaggagaggaccagagggccctccagcccagggaagccccttccgtcataaccaggcagaccaagttggcccatctagagcccaaaagtgtaaaggacactgtgtgccctcactaatgtccctttcacaagggtatccatgtaaatttccctgtacaacctaaaccctaggaggtgtaagcctctggtctaggattataaatagcccccttggaccatgtaatgaggggatcctcaaaaatttttatcaagttaatatattgttttactattcaaaacatccaaccaatttccatgttcttcgacgtgacgcggttgtcattcgacaacacacaacatgatttgatgttaacatagccttgaaatctgtcgttaacaaacctactatcaattaataacaatacaaatctccttcacattcgcaaaagtatgcacaactactttgagatttgtgattggtcaaagaaacttctctcaaaatttctcattgtctgtggtcttgtgcatgtaagacttcatgtggagcttcannnnnnnnnnnnnnnnnnnnnnnnnnnnnnnnnnnnnnnnnnnnnnnnnnnnnnnnn

SEQ ID NO: 19561 - DNA, 698 bp, Oryza sativa
ctatagggcgaattcgagctcggtacccgttccggcgcgccgcaagcctaagcccgcggttaagccatccgatatcccgaccctgaaagactacaccgcccgcctggtggatcagaaatggctgcgactcgcggcgaggagaaaatctgcatgagcatgtatcaacgcattaatggcgctgactggcgcaatattttcgtcgtcggcgatctgcatgggtgctacacgctgctgatgaatgaactcgaaaaggtttcgttcgaccctgcgtgtgatttgctgatttcggttggagaccttgttgaccgcggcgcggaaaacgtcgagtgcctggagctgattactatgccttggttccgggctgtgcgaggtaaccatgagcagatgatgattgatgggctatcggagtatggaaacgttaaccactggctggaaaacggcggcgtgtggttcttcagtcttgattatgaaaaagaggtgctggctaaggctctggttcataaatcggccagcctgccattcgtcatcgagctggttaccgctgaacgtaaaatcgttatctgccacgctgactacccgcataacgaatatgcgttcgacaagccggtcccgaaagacatggtcatctggaatcgtgaacgggttagcgacgctcaggacggcattgctcgccgatagctggtgctgatctgtttatc

SEQ ID NO: 19562 - DNA, 630 bp, Oryza sativa
  unsure (1)..(630): unsure at all n locations
tcaacaaagcaatgcttgattaagccgataactgacacctatccaacaaagcgcgatgcaattcgcgcctggaatcggaggccatcatgaccagagacgagataacccgataccaggccgaaagcgttaagcgcgccagcatgccgccaatagtaaagcacagccagaccaaaacccaccagccacagaaggaagccgcataatgaacctcgaatcaatcgctaaatactttgcgcctaaatcaccgatgttcagtgactctcctcgcgcaaccgcatcagacagtctcaccggcactgacgttatggcggcgcttggccttgctggccacaagtgcgggtttggtttcgatctttacctctcgaaaatcggcattagcagcccagatatagcactggagagactctatgagcaggcacgtaagttatcaggtaaattcagagcactgtctgaactcgatgaatcagctcggtcaggcgtgcttaaggttctctgcgcttttgcataccaggattattcaagaagtgctgccagcactcgaaaatgtgattgctgtgatggtggcgnnnnnnnnnnnnnnnnnnnnnnnnnnnnnnnnnnnnnnnnnnnnnnnnnnnnnnnnnnnnnnnn

SEQ ID NO: 19563 - DNA, 1356 bp, Oryza sativa
  unsure (1)..(1356): unsure at all n locations
nnnnnnnnnnnnnnnnnnnnnnnnnnnnnnnnnnnnnnnnnnnnnnnnnnnnnnnnnnnnnncataggtaataaacttgggatcgaacaatatccttttaaaatgattcaggggttctattttcttaatgtaactcaaaaaacattcagactcttgaatacaagatggattaagttagtacaactttactaccgctagcttaattatcaaccatatcacttgtatacataccatgcaaatatgggtacaagcgaaaattgcaaaatcaaggaactcaaaatggatcatcttatgaaggcatataacgaacaaattaatggtaaattaaaacttggatttcccccctgtatataagttcaacaatttcatattttctccatagttttgaagaactttaaaaggttttggtgcatacaaatcacctacaccatcgctttgcttggtattgcaaaatatcaacattgtttgaagctaaattctttagtttttgcaagtttcattattttcttggaacaataattgtttaaaataagactataattatataaatttaattagtatgggtagtttacttataaattttgaagtgttttgaagtaaagtttttctatcatgtagtctggttatatcaataatatagttttgttcaataaatccaatattatttacatcaccagaattaataaaaatttataaaaccatccatgactacttaaaattttggtttgtctgatttgtttatttcaaatttagataatcacatattctccttctaatcggtgtgtttgtcattattcataataaaaaaaacactccttgtacagctgacacatcatattgtcactcaatcacatacaaatgtaaaatatttgtcattattctcggaccgctcattcctcattggtatcttccactcatccatcatcttataatagaagtatacaccatattttgtctaactatttagtttacgtaagggacaacaccacgctcctcctccctcatgcatgggacacagtgtccaatttttttccaaagcaagtttttaattaacacatgtaattagaatattacatgtgtaatatatgtgtatgtgacacatggtaatttttattctagcttcgccctgcttatatactgtatagagagattaattatattcaacctgcagtgcttgattcttcttctttctacattgcatcttcgcgatttgttttcatgttattaaaaaaaccaatcgttgcccattgatgatttgacacattttcattttagcgaagcagtagcgctataacatcatgatcaccttagctaccttaggtatacgatgcttcgtcatgcgtgtagaaggtaaag

SEQ ID NO: 19564 - DNA, 705 bp, Oryza sativa
  unsure (1)..(705): unsure at all n locations
nnnnnnnnnnnnnnnnnnnnnnnnnnnnnnnnnnnnnnnnnctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattatagatgaaaactagcatgaacgcatcattagatctacacatgtgaactacacagtttaacatga

SEQ ID NO: 19565 - DNA, 898 bp, Oryza sativa
caccaccccacagtgccgaccttatccatccacccaccacccccacgcagcgccatccatctgtctgtctctcctccccccctctttctcacgggctggccaatttccctttacgcggcgggtgcgacggagtagcggtggtggtgacggagaatgatggcccggaggtcctcacccggcccgggggccctcccccttctctcctcctccagggcagcccgccagtggagaaggccggccggcgagggcacggacgcggctgaagtagcgcctgtggtgatggagaatgatggcgcggcggtcctcccccggctctggggccctcccccttctctcctcctccagggcggcgcgggtaaggtggagaacgacgcgacgaggtgacagtgccggtggtggtggtgaagcccgggatctcgccggcctcctttctcccggcgcggcgttgggtggcgcccgccggcacgaaggccggcgtggcgaggtgacggcacgaaggcgggcacggctaggttccggcgcggttgccgggcaaggtggtggtggacggcggtgaagaaggccggcagcaatgttggtgccatcttttttttaatagtatagatgctggttttaaagcagacaccaataagattaaggcaaagatgccagctgggaaactggcacttatagccagttcccaaccggcacctataggattgtagtgacagaaggtcatgatgggctgtttagaaactccatactcttgaggaacaataattatttaggatattgagtactccttccatctacctagctacatgacgtggcatacatgctaaggaaaacatattttatttgtactacgtacatatcaatggagttgtctcatcgataagttattaggaccacattgttt

SEQ ID NO: 19566 - DNA, 811 bp, Oryza sativa
tcagatgtacttgacttctgcaagctgggatgtacttcttcagtgtgcagcaagataaacacttgtaagctggaaaaacatgaaactgaatcaccattagttttcaacgaaaaaggccaatgcgtacgatcattttccttttcatttcagttgctgccaatgaaggagtgaatgctgccgtggagcgttgcgagcatgcatgcgatcgcttctgcacaaatgaagctcagactgtcaccgttgtgtcctaatcaaacgcaacatgcaaccagaaagggtttcacacacatcgaagcccatacgaggctatgaacctggagtagtcataaataagttggatatcctgatatccaagccagtgtgctatcaacttctcttgttttgtgtctctttgtatttccaataagccatgataattgcaatatgttgtcttgtcctgaggacatgagcatacgataagcgatgatatcattggcaaataaataaactttctcatttgttttacgccaatgcctcatgagttaagacctgtttagttcccacgcaaaaacttttcaccctgtcacatcaaatgtttagacacatgcatacatggagtattaaatatagacaaaaaaaactaattacacagattgcgtgtaaattgcgagacgaatcttttgagcctaattgcgccatgatttgacaatgtggtgctaaagtaaacatttgaccatggttagatccatatattcttacacttgtgtttttttttttttgcttttcttttaccttaattgtgatggatctatgtattttaaattgtcagtgt

SEQ ID NO: 19567 - DNA, 642 bp, Oryza sativa
actgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggtcacccggttttgccgagttcagtggagtcatcattcggaagaggaagcgacctgggaaagggaagatgagttgaaagccgcccatccgtacttcttcaccagctcctccgaatctcggggccgagattccgtttaaggggggtaggtttgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaattcattaacaggatttttagtggaattttcagagctctagaaataattttaaccaattaaaaatcactaaagtgcaatttttaattccagggaaaatccttttcctttttctttttcttttccctccctttttcctc

SEQ ID NO: 19568 - DNA, 342 bp, Oryza sativa
tggtgaaaagtttttgtctagcaactaacgaaggcctttctcttcctctcctctctcacttctatcacgggtggcgaggccgacaagaaggcaccgggagcgggcgccgccgctgcattcacggcaaggagcggcgggcagcgcggccgatgaggaagtgctgggagtgggctccgctgcagtgcgggcggccaggagttagcgatgccaccctgcgacgcagattccggcagcggcgctgggcgaaggccacggcggtggccctccccagcccagatctgccggcggctgccctcccccgccccgatctaccggcggcgaccctcccccgcctggatccgc

SEQ ID NO: 19569 - DNA, 722 bp, Oryza sativa
agcgtgccccgccgaagccgtccgttccgccgagccgccgccgccgcggtgacgtcatcgctgacgtcatcggggtcgtccgccgtgagccggtcgtggacccgatcgatctcggccgtccatcttggatcggttagatctcggccgtccgttcgcgtgaaccgccgcccgtgcgcccggtccaccaaaaccctagcccgctgacgcaataaatcctcttttccttttcaaaaataattcattattgcgtcataattcaattttaaccgatttaagtgttttaatccggtttaatctttaaaaattcataactaattcatcttagctccgatttagttggttcaagtctctaaatttttctaaaattgagatctacatattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaatcctttgagcatgttgatcctatttaaagctattgtttcttttcaactattgcatttattttcgaatgtcattgggtggaattaacctattctttgttatggcccttttgtacattgattaccttattccttgataccttgggttattacaatttgactagttgagctttatttatattgg

SEQ ID NO: 19570 - DNA, 1055 bp, Oryza sativa
gagcttatgctttgcgatcgacttgcacgcatactctttcctggttgccttgtccacgcacaagtatgttgtgccaaacaggccatgcccaagcttgcgcccaaggttgtacctatccttgagattctccgccttttgttggagcactgactccacctgcaacccggcgctggagatgtgcttcttgacctgagactgatgcctctgctgtggctgggtgctcgatgacggcggcggtttggtcggttgtttcggcctgggatgtggttgagttggctttctcactggctcagagataacaattggtcttggaggggcagtagaggtgagctgctgctgtggcggtggcggctcggaggtcggtgaagagggggaagagggctggacgacggggacagagcgcgagatggtggggtgggatggggtggaggaagtggtggttgatccatttcgccagatggcgcaaagaaggccgttcttcgacaaactacaggttgtgccaacacagacgttgcccattagaatggtgctgttgtggtcatgctggtggttaaggttaccctcatcgatgtcctcttaagttttttttttcttgtgatcaagaaactttaaggagttgggtatatgcgtagttgcagttgatttcgtacaacttggctggtagtatagtcatcattttcttaatgccccttgttcacatcacattcttggaacatataactaagctctatggaattattggctactctgttaattaatcctagcaggaaagacttgcatccctttagggatgtcctctcatttttgcatcctatccaaattaacttgtatagaagggctgcgtttgacaaagtaagctagagtgacatactgtgtctatttttagcagtaaagtatccatcgtttgtttgcactctcagcatcatatacttaaaagtaatgacagatggtctaagatatttttcacacattaaatgtacattattaaacagcaggacagacaaagatttgtcacaaggaaggaaagaacaaggacatccaatttgaactttgtt

SEQ ID NO: 19571 - DNA, 2876 bp, Oryza sativa
tttaggagatcacttcatgaaagaatgcagatttcatccttgactacagtgaacaactccaccaccattttcatttccaccatgaagatgtgcacatgtctttcattccaaactagccagcacaccgtcacctaaatagttgcataaatgttgatcaaaatttgacacgacagattgtgatgatacaagtcagtacacaaacatgtaaatatgaattcgctctgaatatgtatgcatggaggaacataaacaaatcattcttcatatgtcattgcatatgtattattcacttgttgattttgtaatttttgtttcacaatgtatacatcgatcctatacctgcatgtctgtgtagtgacttatactattgtaatccatctcgtcaaaatttttatacaattagtattatgtagtgtgaaagtaattggtgcctttgcacctaggcggctaggccattctacatatgcagtgagcgggcccattctacatatgccttttatcagctgtatgcccctgattccttcacgctcatctgagacccaagcctccatcctacacggctgcaaatcttgtggtcagttgctggccatgacaaactctagaatacatgttttggaaatacatattgtgccctccacaggttgccttgtgccagatcaacaaaacatccaactgaaactacaaggttttatggtcatatttttcctgatgcctcctagtcatatcaaactgagacatacactaagctcgatctctattgatttcttttatcctcctcctcttaccacatactttcttgctttttcacttgctacagtacttacctattatgtctattgacatttgacaggaagtgaatttgtgatgcatagtgaactgaatactgaaagaaggggtggtatatagaaggaccaggaaatatgatgcggttattgcccttctatgttatatatacaaggtggtcataattaaatttctctcatatagtatcatcaacttcttgggttgatctgaattaaatagtgaaaataaatgtgctatgatttctacatagactttttgtaccattaattactcacccttggagagctagaaataatgaaggtaaggttttgaaacttttatatgacttgaagttatatgtaccgtagtacgtctcctcagaactaagggcaagttttataaaagatgtggtggtcacctccaattttatccaattatccatccctagcctatatagatgtattgcatttaataccctagtcccagtacacttgccaccaatcaactcctctaattttctcttgttcttgaagtttgtgtggaggttgccccttgcgtgaggggtggcttctcctctctcttctcttctctcttccgcatcatcatttaagcatatagtggatgcaatggaaagttaattgtgttgggcacaaccaccactgacaggcagtcaggcatatatacagaggtcaccaggttttgtaatggtatgaaaaaaatggacagagatgaattgccttgcaacaagatgagcagcactatatttcttttcctgattagaacaactaccaatctgtgaaagaactattaacatatacatggaatgcttccacctgtatcggtgttaatctctcatcatgccattaggcaatggttggtaactgcatctgctagatttttaattcactatcatcccagatgtagctaatttctaatccagcctcgcacaatcattgaacacaaccgatgccggggacctccacaaattgcttccactggcggccacagctagctctcagctgcaaaatgtatattcctatcctccagcttctcgtgaataaactggaaatccttgtaataatgaatggttgagtgcatggcttatgcagagaccggaataatatattcctttatctaaaaaatgtgcacaatgctgtgccatggctagtactcgtgttggggaaaaggatagaaggtactcctgttcagctagccacggtagctagccagccgctgaagtaagccataagggaagatccatactactggtcaccatgactgtcgtgacaatttttaacggtctactacgggagtggattctaatccctcgaggggatatcccatcgtatatctttttcttctaaatttgatgtaaatagttgtgaaaaaatctgaaaaaaattgacaatgtatagtataatgatacctactagttcacgaaaattcagtttcaacttcgatctacacatcgagaaacaaaaaagacaaatttagatataaacagtacgctactattcatatgctgaatttgtcttttttatatctcgacatgtgagttgagtttgaacttaagattttgtggagttgtatatatgtgttgtatgaatgttgccaaattttttcagaatttttcataaccgtttatatggtttttaagtaaagaagggaacatcccctctcgagggattagaatagtttcctaagttgtgctcaactaataaagtatatggccacttctttgccgctgcttcccacttccatatcacaaaggcaagacagctcaaaatgtctatcttccatcccccattctcttgttgggtggtgcttgctagttgctcctacttgcaatgggaagccaatactaatgaacgaaagtgcatacccaaaatttgagggttatatcagaagagtagagaaagcttttattggagatggtacttactgctatgtactagatgggtggtgtgtgcattttctaccattttccccaaaaaaaatatatgctaattttcgaacgataattactattatattttcatgggaggatttggaattattcctattggcaatgcccgtgccaaaaaaattcttat

SEQ ID NO: 19572 - DNA, 5152 bp, Oryza sativa
gacaatgtatagtataatgatacctactagttcacgaaaattcagtttcaacttcgatctacacatcgagaaacaaaaaagacaaatttagatataaacagtacgctactattcatatgctgaatttgtcttttttatatctcgacatgtgagttgagtttgaacttaagattttgtggagttgtatatatgtgttgtatgaatgttgccaaattttttcagaatttttcataaccgtttatatggtttttaagtaaagaagggaacatcccctctcgagggattagaatagtttcctaagttgtgctcaactaataaagtatatggccacttctttgccgctgcttcccacttccatatcacaaaggcaagacagctcaaaatgtctatcttccatcccccattctcttgttggttgttgcttgctagttgctcctacttgcaatgggaagccaatactagtgaacgaaggtgcatacccaaaatttgaagggttatatcagagagttagagaagctttttattggagatggtacttactgctatgtactagatggttggtgtgtgcattttctaccattttccccagaaaaaatatatgctaattttcgaacgataattactatcatattttcatggtagtatttgcatttattcctatatgtcaatgcacgtgccaaaaaaattctcatatccaataaggggtgtgacggttccccataaaaaatggtacatagtaaatacaccattttctaataaataagtaactaaagggctcgaggaaaaaaatgccatacacctagttttataaaacaaaaagagagtgttagtagacaatgaaaaatctgctatatatacattagtaaaactatggctttgatgaagaatgctcctgataacaagtagaatatagcatatcgatcggtaactgaaactaagcaactgaaccaacaattaattacacggtatacagacctgcctggaaaaaaataggaaaagtaaaatatatttaccttaacatgccctgtggctaggtagatcgaatgaatatttgacatgctggaaaatgttcctcaggagtaagggatttcctactagccatcatgaccttttgttataagatgatttggtgaatcattgtacttgtccgaaattctatttggcttggcccattggctagcgtggttaccgttttcaggatgactctcattcgtataacataaacaaaatttcccaaattttgcctcatcatatttatccttggccccttcatttctgttgtggtatgtatatcaatctctacaaacatactattaggtgtagcgtcacaaacattataaaaaagatgccccctttttaactagctagggaaataagatgtgaatgtttaaagaaggggtgatatatatagaagggtaagtcgatatggaggagagccgtattgctttgtgcactgcagtactataggatcactctttaaatctcattatctctagacttcaattatttagtgcggtcagcaatgcgcgcggtggcatcaccaccagagctgcagcaaggagcaaaccggggacaaatgggaggggggatgtagaggaggccagccaggccgggtgccgcaccgagacgttgatgccttttgatgctggcgaggtcgggaggcggcatggtgaggatggaggaggcgggggactgcatagtgtgaattgcaaagggtgctacttcctgcacataaacataaaacaaaacaaaataaatagggaggcgggggactgcatagtgtgacttgcaaagggtgctacttcctgcacatgcataccaatgtcacaaaacataaaacaaaacaaaataaataggaatactgaacgaataggaaaatatttcttctttcatagaaaaacaccaagttctataatagtagtttccatcttggtaaacatgaacataaaaaggccagattctatgaataatagttcccatcacgagtagacataaaaatccttttagcattactggtaagctgataagtagggccaacactactcaacgaccatgaatagataaccaaattgcactttctttctgctacacatgatacttaattattcaaatggaataagaatcgagaaacaaaaacaatcgagaaccaaataacataacaacattatgtacttaaaagttaaccaaattgaaacctgaatagataatagaaagttaggcatcatataagcacgaaataatcaatattaataattactcatcatgttaataatcgacaacaagtgaattaaacatagtagtcatccatttattacatgtcaatcatattcatcatgcacttgccttaattgaatataacccagcatcacgccagcggcgccaaaaccccccagacctaaaagaataaaataacagtaaaaacctacttccgaactaacaatatatatgctactagctaaatactccatgtaatccctcagaacaaactagagaaatctgaaactcggaatttgaacaacccggctaaaactctatttcttaccgttaccataaattacttttaaaccagtaaactagacgaagcatttgagtacctctcagacatctatataaagttatctacaagttttgtgttatacaaaagatatacttcaatttccatcaagctcagatctaaagaaagtaatggcagtactggttttcttacaggtcaacaacactgattttcttacaggccttaacccgattgccacggcttcgtccgaactccgattatggcaatcatatattactaagcagcagaacaaacaatatgtgtcacaatgaggtgtatgcaaaaaaaaaaaaataaagaaagaaaaatctgttactcaggaaatttcttccatgagaaaaaaagagtaaagagctggataggtttttgtcagctttccttcctctttgtacagtcgttgttagctttatcactggttaattctagttgtatcacatcaaatggtaaaaaaaaatatcgaatataataaaaagcaaaggaataatgacaatggaggaaattttatttttatgtgtcacatttgttcaatcttaagaaaatatttgcttggcacttaacactttttttagaaacacattacatacacagatgtccacaacgcacgtacagtcacctctatgaacgcacacacgcacatcgtaccttgcatatcactgaaagaataattatccgtaaatgggagcatccgtgttaaatctaaaatttgaacccgggtggattggttccaccacaaggaacctaactagttaaactatgctcacttcgcgcttcgaacttaacacttagttgactcatccatctaattaaaatatactttttattcatatgcaaagtacagctaatgaacatgtacacgcatatgagctatactcgcctatataggttcacttccgaatattcaggtgtgtctaaatagcctggtcgatctctttcatttgcagatttcatccttgattacactgggaaagtgcaccgaataccattttcaactatgctcttactatatttagtagaattgttatatgacacatggttttatttatgggagaactacgtcctcgagcctgaggtctgaatttattcataatagtactcctattgacttcggctttagtgatgaacaaatttgctttgtcgaaatccttataatgagtagcatttgctgctgccgaataaaccaactttaagatgggataagatgctcgataaggcatgaggtttaatatcataacagtttcttcgtagtaacaccaacaaatctcatccataactctttgtactttgaaaacggacatgtggatgtgttttcgtgctttgaaaaccctcgtacttaagtagacgatcggttggtatacttttcttctgagtttctttggcccactcttcttcttctttatcctaggggtatactttaacagtttgaaacttgtcataaataagattattccccgcttacctatttcttttttttaacacatttgtttcgttctagactagccatcacaccatcatcaacaaggaatcaaaagccttctcataaccaagcctcgtcctgatcttgtggtcttatgaacttaacatgcagctagccggacatctttcattgcacaaattcttagaaaaacataagtatgtacaccttgaatgccaattctggaaatatcgtgtcgtccactgcatgaacaaagcaagcaactgaagctataagcttggatggccaaattttcccagatgccccctagtcatatcaaactgagacatacactgagcttgatctctatcaatttcctatctcctgcttttattccaccatccttactttccacttactatagtttcctattatatctattcataagatgtgaaatgtttttgatgcatagtgaactggggtactcgaagtgaggtgctatatatataaaggggagaggaaatatataatgcctcgatgcattaagttcatctaggcatagaccccgctatgttcatagatggtggtggtaattacatgttaattatgctttctacatatagactttttgtagcattccttaatcacccatgtgaagaggtaaaaacagtgaccataaagttttgaaacttttatgtgacttgaaattgtatgtactatataatcaagtcaccttggaactaaatatagtggacataatagaaacactgctaaaaaaaccctcatagggactggccttataggtgctagttcatttaaaaccggcacctatagacttttttccacctccgcacgttgaaaaaaaaagaacaaatacctttataggtgtcggttcattagttaaaaccagtaccaatactatatgtgccggtttttttaaaagaactgacacatatatataatatattataggtgccgttaaataaaacaccgacatctatattatattataggtaccggttcttttaaaaaaccagcacctataccaaaccgagccggccgcctatatctactcgcgtgcgtcttttccttatccacaatcctacgcgtctcctccttgtccacaattgcgcacgtctcctcttctccgtcgtgcccttctctcccttccttccgcccccttcccc

SEQ ID NO: 19573 - DNA, 1016 bp, Oryza sativa
  unsure (1)..(1016): unsure at all n locations
accaacatctaggtcattaagttcaagttgactatgattcatcataaatgaaactctaaatctgttttggttattatcagttgtagagattgttgtacatttgtatcctcaacatgaatcattcataaacatagcaaactcattctttatatatataaataaactcattctttaggttgatataggatactgagaaactggacccgaatcagccaaggaaggcttatgacaacaatcgacccaacgacggtcatcttgtctataaagaaggagaagttgcaacaaagcaagatggtcatacggaaaagtgtttcagtaaagacaaggattgaaattattagacttgaccgggaagtcaagatgggtaacatgaatagtggtaatccaaagctcgatcgaacttttggcttgtatcagatgctacacagaataaaaacacttgcactagttactgctcaatgtgctttcctcacaaacgatccagtgggaaagaacacatcaaggttgaaggtgcaaaggaatatgcaggaagtcaaatgatgacaacacgaagagaaaaatggcaagtaaaacgaatgtaaagaaagtgaatataagatgtcttttcttgggagctcttcccaattacgagccaagtgatatgttcaaggataatctacggaggtcagaccaaaatcatatcaatgtttagatccaacaaggaagcttcatctttggtaggttaacaatcaaactaatataagccgctcgtaaagttacatgacaagttaccaaagtatgacaagttttataacctggttatcttgagaaacattgtatgatgagagagttgttgatcctaaagcgattattgacgtgtaccccaacttttcttgggacggggatcaatgcacaagcaattgggaaaaggtagttttctgatcgagacagcgcacatgtccggtcgcgtggagctcagnnnnnnnnnnnnnnnnnnnnnnnnnnnnnnnnnnnnnnnnnnnnnnnnnnnnnnnnnt

SEQ ID NO: 19574 - DNA, 5111 bp, Oryza sativa
cttgtatcagatgctacacaaaataaaaacacttgcactagttactgctcaatgtgctttcctcacaaacgatccagtgggaaagaacacatcaaggttgaaggtgcaaaggaatatgcaggaagtcaaatgatgacaacacgaagagaaaaatggcaagtaaaacgaatgtaaagaaagtgaatataagatgtcttttcttgggagctcttcccaattacgagccaagtgatatgttcaaggataatctacggaggtcagaccaaaatcatatcaatgtttagatccaacaaggaagcttcatctttggtaggttaacaatcaaactaatataagccgctcgtaaagttacatgacaagttaccaaagtatgacaagttttataacctggttatcttgagaaacattgtatgatgagagagttgttgatcctaaagcgattattgacgtgtaccccaacttttcttgggacggggatcaatgcacaagcaattgggaaaaggtagttttctgatcgcgacagcgcacatgtccggtcgcgtggagctcaggaacaccagatctggtcacctggagctcgcataccaccggatctagtggtggtgaccacggtgcggagagggaccctagcagcgacatcggcgtggagagggacccggcggcaggcggtgacctcgcgcagagagggaccctggcagattgacgacaggctggaactagggagttagtgcatctgattgttgttcatctgtgattggtgatggattggattaaggattattattgttgttgatgatgattagtgatggatttgatttgtgatatgtaaaagcatcggctcagcttgagccagcttttttttttgaatctgggatagcacaaaggtgccggttctatgaccggtgtcattggtgccgactgggaaactgtcacctattgccagttctcaactggcacctatagctgtttgtgtactagtgaaagtgatattgcgtgcagccccattaacagtcagtgaggcatataaaagttgctagattctaggctatgcaaatcaagtgagctgcataaaaagtcaagacaactagaatttcatactatcaaaacaaaaggaatgcatgcgtttatcattgtgattgtaatggttatatgtcttctccaaacccttcggttatatatatgtttcccttgtatcaccttagaggaaaatcccaaaacctcaaaagaaaagaaaggattagaaagtagcagctggctccatgctcatcatatcatgatgaaaagaaaaccacaatgacaatctgccataaattgctaacgttaggagtagagatcatgtagatgggtgaaatttgtagacaaaattgaatttattctatgctagaaggtttgcatgggtgcagaagttgtaaatattctcaatatgaaaatgttcgttctgcttccacgtggatcaacaaagtgagaaatcattgatcaaatttcctttacacggagagtgatcaaccaggaggaagaaaacaatagctagccaccgactccaagtcatgaaattagttcttgatgagtattagtagatcggctggattagctagcttgctcccctattataattagtaatatatcccaaagctatacatataaactgaagtagggctattatctatttcagaggcttgaaccaatataaaaatctttctctcctatctactttactgcaatctcgcgtataacttagtattaacgtcccccatgaaatacaaataccgttgtcgagtatagccatttgacacattcgtatcacataatcaaaatttatcagtttttacctcatcatatttatcctcggctccttcctttctgctgtggtattccaatctctacaacatactatgaggtgtagtgccataaatattataaaaaagatgctcccttttgaactagctagggaaatataagaagtgatattcaaagatggggtgatatatagaactgttgggaggagagctgtattgctttgtgcagtgcaaatcgtgggagagctctccttatctcattatgtttagacttacattattttcacttggtatggtgcatgaggctgttttgtagcatgcgcacacagcctcacaaggaatgatatggtctttgaaaggaaaaccgttcttctcgtgaagtgagcatatatcttaactgattaggtccccccccctgctggaaaggtccgcggtagcggcgaaggatgcagggtcgtggagctgacctagatatggagttcgtcagagggtggctgtcgccttggtcgagctcctcgtctcgtcttcgtgagctcatctattgtctgtggccgagaacaagacaacatgagcatgtgaggtcatctgttgtctgcagcgaaggagagagcatgtgaggttgcctcacgtgggcagtattttcgccgttcccggatcccacaacatgagcatatcttgccaatgtggcaaagtatgtgcacactcagagattgtactgctatatcctacttacaaaaatcgtttccgggaaacaacaagaaataattatttttaatcaaatcccgatctaagaatagtttgatgaatgtttatccacaagtttatttggtagagtatccatatacaaccttgtaattaactggctatttcctattttatggaactaatattttctcttatttttctattacatgcacttgctttgttctgtcatggtctcatggaggccgagacattcattgcctgcacaattacaatgagatttaagactactacgcccaaggaacactcaacctcaaggttaataatatacaagtgggggtcttgtgtacctacaagttcgtgggtatcagagctcaatatatatctctactggagctgaagttagagctttgggatacacatgccatacaacctagagtgtttgccaggcaaatcttttgcttgtggcaaagaattaaccttgatgttcttcgatgtaatctcattgaacttgactcatatgctggtatggccacccttttcctgatgcctcttattcatattgcgctcttgagaaaaacacaaaactctctggaattcttgcctctgttaatccccagcaccatcatttttagttgtggattgctcgtatgtttctaccaatacaaagctgaattgtgaggaagagtaaagagtggcacctctctgtctgcttttttttaccagcaaagtaatacttgttgaccaaaagactggtttatgtgtatatgaggataaggtatccattatttatttattctctctgcatgactgttgaaaacgtaagtgtttgatagtataggagaggaatactgcataacgtgggacgattgtatcctaatataactctaactaccatatactctaatagtaaggaaatgtggactacaatattttcaacagataaaaaaataatatatatcattaagcagcagaacaaataagatgtgtcacaatgagatgtatgaaaaaaaattcttttactcaggaaacttcttccatgctaaaatatgtatagagcatatgcctgaagaatctgcattttacttgaacttgtttagacattggtggttgtcagagcattcaaacataagtggaaaggggtgatagaaaaaaggggaaattattgatgatggtaccgaaggcgattattgtgatgtagtgtgaatgttcataattaaaataaaatctattattgcaaagtgcaaaaccgaagaaggaccccaaaggaaaagcagaggttctgctcaccatgcctgtagaatgaaacgatggatccagtccagcaaacaacctggtttcacccaaaaaaaatttaaaagcgaaacttgtacttgcaacttttcatggtagacagggtttccttaacttgtgatccaccggatattaattcatatgcttcatacactctgctatgcatttgtttttattttcattatgtcattcgcatctgcttgtattacgccaatagcacaaggaattgttaacatttcaaaactttagatagaacataaatttttttgagtaaattttacaaaagtacatgtattttgaccatactatcacaaaactacagatttagcccgaagtttatcagagaactatagatttaaggccatgtatagttttatgataattttgttactaaatatgtagttttttatactctatcttttatgaaagatttggtgctagatctgtagttatgtagcacctaactgcatgatcattcagctggggagattatgtaggagtagtcagggcagaaaagaagacatgtactcctgtgcatgatggttcgagaagttggtttctatcagttgttagcacctatggagaaacaacctgtgctgatttgggagactcttgaccagtttggtgcggtgcctcctaaaagatatctctgactctggcgataagattatttcatgacatattgcctgatgcctcctatccatattgcatatattctactttgttttagatatttatcaaaaacaacaactccatgcccctacaaccgagggtgtgtatcacagtctctttgatttctctcacattcttagatttctctcacaacctgaggtcttgttggatggcaattgctaattgcttcgttggaatgatgagtcgatgtggtggcaaagtactgttgcatgtttatatatactgaaagatgaggttgtatttgtactattaggagatggataggtgaattactgagactgccttgtaaatttggaaaaaagctgtttagggggcataagtatcatcaacctacagaatttctcatgccattagaatttgtatttcactttcagagagtctcatactctcgtctcaggtgacaattagtttgaagattccatctgtattatatatgcaaagtgagtaactgtttgtgtatttgtaatgacataccgaatttcttttgccttcaggacaagaaattgcccctccatgatccccacataattaaacaattctggggtatcagatttattttctgaaaggttggccaaccaattttattaagaatcaattttttttttgtgggggggggggggggggggg

SEQ ID NO: 19575 - DNA, 3440 bp, Oryza sativa
  unsure (1)..(3440): unsure at all n locations
nnnnnnnnnnnnnnnnnnnnnnnnnnnnnnnnnnnnnnnnnnnnnnnnnnnnnnnnnncctgaggcttgcgtggcctattaccggtccttgaatttctgaatgtcattactgtgagctagtggaagtaaaattgtgtgtgaagctgaatatccttttggtgttcaggcctaagcttcgggggccaaatcacctgtagtgtctgcagatcaaggtttttgcttgtgattgtacatgtgtgctccctggaaattttatcgtactagatgcatatgctagtttgtccaccattttcctgatgcttcttattcataccactcttggatacacagtggaactcaatctattgttcacgccttctgtaatcgtattcagctccatcctttttctgttgcatggcttgcaattttgtgatggatactaagtgagcagtgacattgtctttcaatggtaaagttacactcatcgatcaaaagatgggatgatggatatacataaggatattatccatttcacaaccatgtctttttccacattccgagatcaacccaaaacaacaaaataagacatgcgtgttacagtaacaacttcgacttcaaaacgttactttataccttgcacatcaaaaccacttagtgtaaaagaagagacttgaatattttttttaaaaaaaagtaaaaaacatacaaaaaaacagttagaaatatatatatactgtctggagttagaatatcttttgagttgagggtaaaaattatttacgcatcatcccatcttcgtactagatttttgaagttgtagctagctgttgatctctatgcttcacaaactatactatcttgtactatgttgtaactgcatagttttattcttttatttcaacttgtggtgttaaatgtaggtaaatcgtgaattttgcagcttaaaagaaacatattttttttgcatttaacgaaaattagtacatgaagtattccacagtttgggtgagttcctttcactcaaacagagccaagagtagagattcagatcagctgcaagactaacattgctgaaagttagcacacatgtactgttcactacttaaaaaataatttttcccgacacttggattttattttttcaagtggactaaaaatattctcgcttgtgaaaatatcagaagttctataggtctagccccaactgaaaaaaataatcaatttatacaagtgggatctaaagaagtttgcctgtgaaaatacccttcattttcgcaggtagacctccttagcctccacgtgcaaaaatcaatggcagtcgggacctaaagaggcccgccagcaaagcgtggaggcacttttttatccagcatcgccagccaccgacaagcaatccttctccctcacctacgccctccctcactcaatctccctcacacctctactagggcttcgatccccatccctctccgtccagcctccaggccacttggcgatagcgggcaaggcactacgttcagcggcattagcggaagcagggaagggatgacgttcggtggcatcagcggcggctacaagcgcggttggcggcaacgggctggaggagatgagaggtcgctagtggaagctggcaggctcgggatgcaacagcgacatcgacggcgatgatggcgaccccaccattgacgacgactacgtacgagctcgggggaggcggatccactcagtggccagcttgggagaggggtgtatgactatagcaaggttggaagaggcagatccatcgccgacggccttggatccgccattgccgagctatgtagtgtcggacccaccgttgccgagctcgggagggggtggatccaccaccagcagctcgggagttggggtgcatcgtctacagcgaaggggagtggcgatggctgtggaggccttggattggcatgaacatactagaaatctgctggtcagaccgcctgatggttgtcagttggaccgacatgagactcccagccgaccgactcctaatcgacggtcagggtgtccggtaagattataaggtgtccagttagaccgttgttcaaatttagatcaatttagtactagtgcctaattggctatctaaagatacattattgcatatgagatctagttgatatgatgcatatttgtttctcgttttttaacatttctaccacgggatagcaaaatttccaagatttcagattttttggaatattttttaaaaaattgaacaaactttagcctaagttgaataacttttaccaaattcacacaaaaattgaaaactttgggcaaaatagtttcgttcacgcgggggaggggtgttcccgatattgcaggaattcgaagtgaaattgcatgcataggttataattatgaactgaacatatgcaggtagcctcacatttctttcatcacaaaaattcttaaaaaaacattctgtagatcttgaatgtcaagcgtggaaacatcgtgtcctccacagtttaccatgtgccagagcaacaattcatccaactgaaaccataagcttgcaaggtcaaattttcctggatgcctccttgtccgatcaaactgagatatacatgcagaacttgatatctattaatttcttatctcctcttactccatcatccatactttttgttcactatagtttgctattatgtttgttcaaaagatacgaaaatagtgaattggtactgaaagatgaggtggtatatataaaaggacgacgaaatatataatgcctctatgcatttaatacccatctatatatgttcgtagcaggaggtagtaattacatttctctcatcaatctgttggttaattattttgaattaaagtgtgaagtagatgtatatataattatgctttctgcataaactttttgtgctattccttaatcacccttgaagagctaaaaatagtgaagaccactttgtatacatgcaccatagtcaagtccaaactaagtatatagtggccacaatgtaagtcggattgcgcacaaccggcactgaagtcagccaggcatataaaggttgacaccctaaaatagtcaagataactaccatttggtaccataaaaacaaaatggatgcacgggaatgcatgtctttattatagtgattttagtgactaacgattacatgtcttcccctggacaattatgttataagtatgttacctttgttgtatcaccttaaagcaaaatcccaaaacattagaggaaaacaaaggattagaacggataagtagcaggcatcatgctcagcataccatgaagaaaagaaaaccatagtacctggcattaagttccaatttttaaagtagagatcatgtagatgcacaaatttaatttatagaccactgctgaannnnnnnnnnnnnnnnnnnnnnnnnnnnnnnnnnnnnnnnnnnnnnnnnnnnnnnnn

SEQ ID NO: 19576 - DNA, 20291 bp, Oryza sativa
  unsure (1)..(20291): unsure at all n locations
nnnnnnnnnnnnnnnnnnnnnnnnnnnnnnnnnnnnnnnnnnnnnnnnnnnnnnnnnnaccagttgtagcaaccgtgaccaacaaatcgagcctaaagaagatctttagtaccggttctaaaatgcatattaagtcaaaaaaaatgtgggggatacatattcaaactcaagacctctcacctcaaccctcacacacctaaccatcccaccaactccacatatttgacttggatagagattatttctttttaaactaaccctagaggcatgtttagtccgggttggtgttaccaactgggactaaagatctggttggtgtaaccaacctgtactaaattaaagatgcatttttactacctattggtaacaccaaccggaactaaagatgtttttggaacttggacttttagaaccagtactaataacatattagtaccagtaccagttcttaatctaaccgatatatttgtgtttttgtatcatgacaaaagatcagttatccagtagtggataagacatttttttgggtatgcaagagcctttgcatggatgtgaagaagttgtaagtatttgaaattatcaaaacattcattctgattccatgtggatcaataaggtgagagatgattgataatatttcctttatatggacacagaaatgcatgcattgtactgctgaggtttggctactggtgatactacaatggtagtcagtagaggcttgctcgcaaaagatgagcaggaatatgtttcatttctgcttatagaacaactactagaatctgtgaaaaaactattaagatatgtagtgcctccactgaccacttgtatcggtgttaattttctatgccactaggccattgccgataactgcatccactatgtttttatttcactctcataccatgagagattcaggtgattatttgtatccaaagactccattatttgtatcctatattcaggtgattaatcatttgtatatacatataagaagatagaaaactgcccatcgatgaaaccgtgatcctcgttttccatgctagtgtcaaatcattatcttttaacacatccttgaccctgcgaagcagtgagcggtggcggcagcaagcaaatgtatcaggggtgttgagctctagctcatgtcggcagcggggcttggttctagggggtgatagaggcagagctcggatgtgagggccagtggccggagtgactagtaaagcatgtggtcacacctttgccgatgcctcctactcccatcacaaagcaagatgatgtatacttggaatctctatcttctctctcccattttgtttgttggctattgcttgctatttgctcctacttgcaatgagaaaccatgcgctgaaaaggaagggctgtatcctaaatttgatggggtatataaagagttggaaaaacttttttattgaagatggtacaatgttttttttttgttctgctgatcgaatgaaatggaatgctttaaaaacataaaataagctttatcattcttagccaattacatcaagataatataattactctaagactacttttggcattaacataactagaatgcacatacaacctattattattacataaagagaaatattatgccgcagcagactataacacaagctatttcttcctaacaccccacagcagcaacacttgggctgcaaaacaaaaaaggctgtcctaacgatgcctccgagaaagaaaatgacactcaaacgtgctgccattgccatgaccgaacctgtaaaggccaaaacatatgtttctccttcattagagagcaaatctttgactctaggcagtgccttcaacatggaagggaaacaccattggcaggaacaaccagctaagggctgtcctaggaaaagatgatttgtagaggcatgatatattttcatatgcttataatatcttttcatattatcttttcattatgtgtcccatggagctccttatctaccgatttgcaaaataggctatattttatagatatttggttgttaaacctcgaggcattttgtggacctcagtttccgtttgaggtgtagccttatcagcctcaacctgcttcagttactttgaggcagagataatcttttgaggcagtgttctctgccacaatagacaatttggggcaagagtatctgagacatggggaggctatctcgtaatctcttttgagatagactttgaggctgatttggttgctttgttataaaaacggcccagaaatcacatcggaaaccaaatcgcggaagaaaacgccataggagatccaaacatgatgacgacaccgaggtacgatatttgataatggagttcagccgaggcatacatcttcggggcactgattacgggcactccttcccgatccagtatattagagcgtatcaaagttataacgactcacggctggtcgccgccggcagccactccctctcgctatgctaaatcgccatgcggttacaacaggcatgctcctctatttatgagagatcctaggatagactccgactcatactcgagtcctaatacctattacaactccaagtcctaaattgtaaccgactttgtatacatattcgacataaactctaacatgtttcatgttgtctatgatcctgtagtgcttttctgttgtggcatgctaattttctagtccaacatacggagtctcgctccggtgctttctacttggagtagaaactaatttgagtcgttgatcatatctaattgtaggattgagatctatttctactcccaccagagttagtggtaatatatatgtggaggggtatattcgtccaaggatcataattcgcgtaggggtattatgtaatttatcagtatcgacgccattcccatccatccccgcctctgttgccgtccatctccctcgtcgcctccgtcttccatcctagcgtctcctccccctccagcaccgtccccttctccgctccctccgtcgaagctcgtctccacgccgccttgtgagccccctccgttgccgtcatcctcccccacccccttcttcagcgagttgcctcacatcgtcgcgcctccacctgccaccgccgccacattctcctcgccatcagccttctccgccacatcacctccacctgccaccgccgccacatccttctccactccaccgccgcccccttttccactcccctcggtgatctcgcatctccatccgggatctccagagctccgccctatcccgccgctacccacgtcgacccaccttctgccgagttccacctcagaccctagcaccgcgccactcaccgccggtgagccttcgtcctcctcgctatccccttcctcgccgtcggccacctcccccacgctcggctctagccccgtccatctccgcccgccgttgctcccacagccacgtgggagagcccccaatccatcaccccacaagcggaggacgcagcctttggatccaatggcagcgcacgcctggttccccttcgtccccatgccgcctcaagcacctccatcggagcaggaggaagactcgccattggagaatagcggaaggtaatgcccggaaatttgcagtaagacgcgctcccctaatgcctcccctcaactttcaatctcaagttgttttttttttaaatttcgatttgatttctgaggctaccggtttcctgttaatctgcagcatgaaggatgagatgatccatctatatctgaacaactccaccatggcgttggcgatcctgagagaggcatgcttgctgggtgctccgaggtgccatggcattgggatgctagtgggagcattcggtatttgcaaggagcaagtgcgcgaagccatcttggaaggtacgtgtggctgcttcgttgtatcaattggatttggcgcgcaatgttgtgctattgaattatgatgtctaaagttgtcatctttctgaatgaaactaatgttcacctgttgtgggggctttagaatgggtggctattactagtggctatatttgcattgaattattatgccaccatcaattaatgacgagtagatgatgcatggtgcttctttcctttgaactctggttgccttttcaccaattatattgctcgttttggttcagtaaatgcactgtttatttcagaacaaaacggttaatgttaacagcatttttacttatttactctgaaccacctgctgatcttgttttttgctccgtgattgttgtacatatcatggttagctagctgtaacagtttatttctcaacttgcccttttgacataagtgctcatggaatttacttgttcccatgtgatcatctgatctcttatatgtagttgcctcctctttgtataaaggaaagaaacttgaataattgtaaaaggcaacaaaggttgagaccagtcaaatattgaaggggtaaataaattgttactaagggcctcacttgatgaataaaagatagcatggtatggtaattgtcctttatagtattgttttgcatggctgattttagcatgagaaaaacccatcctcttggacaaaaatccatttatatcgtggttggtacttggtagcagtggacagtctttaatcttgttcagtttggacttgatcaaaattcctgctaagtcttgtcgaaatatattcatatcttgctgcataaagtaaagggagaacattttatatgattttcataatgggaagctttggtgcaaaatatgaatagagttcattgtggttgcctgaaatcattgtattgatgtcagaaatcattgttgattcacacagataatagacagaaaagggaatgaattgagcaacccatataccaacgttacatgtccttcagttattggatcaaccacaggaaggttaaaaatattgaccatataagaggaattttgcttaagttctaaaagaatatctgaatcacatcgtaattcataaggaatttcgcttaagttctaattaactttggttgatcatgttgcctgactcactacataatatttggagtgttaatgccaattcatatagtgctctactatcactattttagtagtgcatatactgttaatcaaaataatttcattttgcaacttgtatatatatctctacatgaggactttgcaaagcaacatctcaggggcctacaatgagttgttgctcaggtaacaagtttcagtatcaaaattcataatatgttcactacaggtttcaggttcatatatctgaccaaagtactgtccttgccagattcagttccaaaatgagacacagttctcaccaggattacaggtgacggaacactttgtcgtggctacatagcacttgcatgcagaggggtagcagcttatgaagccacctcttgtttcatcagaggtaagattgagctaaagatgatgaatttagaaacttcataagctggcatgaactgaacttactgacaaatgcttaatttagaaacctgacaagatctcacgaactaacacaagaaaatctggtctttatgcacgaactttgggtgttcagccagcaggacgttgcggagctaccaggtctacttcagcatgaggaagcagtcaaccaacaatatcggcagcaagcacatgctgggaatgagactgtgttaatcttattaaatcaaaaaattagttcatgttatgccatttatttagtgtaattatagttatatatgtcctgttgtatgcttatgctgccatcggccaatctatgccgttaggatatgcatgtaagaactcagaagcggtgtatcaatcgaaaatcgattgattttttttctcacaaaacaagcatatgatagataaatgatcaattgaaaatcggttgaatttttttctcacaaaacaagcatatgatagataaatggtctctgatcttttcagcctacctaatttttttctccaaaacaaaccgttctgttttttattctatgcgcggtcgacaaaaaaaccatgatttcttaaaatcgacccaatctgaacgatcatcctgggcttaataatttttttgtccaaaataaaccgatctgctttattctatacgcgatcgaccaaaaaccatgattttgaaaaatagacccgatccggacggtctcggacttaatatttttttccataataaacggttctattttattctatgcgcgatcgactgaaaaaccattttttaaaatcgacccggtccgaacggcctcggacttatttttcttatccaaaataaacagttctgctatattctatgcgcagtcgaccaaagaaccatgatttttttaaaatcgacctggtccaaacggtctcaaacttaatatttttttttgtccaaaataagctttattctatgctcggaagacctgaaaaccaattttttttaaatcgaccaggtccgaatggtcctggacttaatattttttttccaaaataaactatcctactttattctttacgcgatcaaccgaaaattcttgattttttaaaatcgtcccgatctatacggtcctggacttaatattttttctaaaataaaccgttatgctttattctatacgtggttttttaaatctatccggtccggacagaccgaacgtgtaccttttactacctagtagatgttcgacagttttttttaaccataacattcgatatttttagccgcatgatccaacatcaacaacggtgactgttaagtggctaacgggtccacatcaaaatacagtacaacaaacgaaggatgatgtccgtaaaatctgggagaaaaataggaagttacagtgagttacagcatgtaactgcatgtaattagcatatactataactagtataaatttgccttcaatcctcaaattggatatagctcagtgacaaggaagtcatgcaggtgacgcggaagtttgagggatcgattcctatgttcgcttgtttttgctgctatttcgtttctcatcctaagcacgaatcttgatgttaatccaatgacccagaaatcgacagtttttctctgagaaatctgtcacaagttatttagggcccctttgaatcgcagggtagaaaaaatggaggaataggaaaaacacaggattctgacaggatttgaagtgtaaaacagaggattgcaaaacacaggaaaaacacagaaatgatcgtttgattggagcgcaggaaaaacgcaggaattagatgagagagatagactcaaaggaaattttccaagaggttggagctcttgctaaatttcctccaaattcacatgcaatatgccattccataggaatttcataggatttagaaagcttcaatcctttgaatcaaagggccaaataggaaaatttcctataggatttaaatcctatgaaattcctacgtagatcctttaattcaaaggggcccttagcaattccgatccagataggtatcacgtacccaaaatccgatcggcctgagatgcggtggctgcgtcgtgcctgatgcgatcaagccaaaattaccaaaattacccttaatcagcccatgccaaaattacccctaatgcatattagggagattactaatctaccctttaaaataaacggtcaagattaattctacttggagtatatactacaagtagaaagcaccggagcgtgctccccaacatacgtagattagaggacgaggagaattctatgcgcgttgatttcaaatttattgaattttctggacatgatctcattcatagaactatcagtttaatttgaagtcattcatcctaggcagtgtcaagtcacaacttagatttctcgtctgacaagcttgatttaggatctttttctggaaaactttgtatacagaagttgtagataatgttgtaagctttccagcgaatccaatattaggtcaatccgatacattcaggagaagttttgccctttgaaacttgattattctgtgaatgggcggagatgctgattcgtttttcagtgggtaatagaggtctgcggatggcagttttagccctgtcacccaactaaacttaggtggaaatttctgtgtagttagtcatggagtatttctttgttcaattcggttggttgtgaggaaatgggcagatggagcgatgtaaaacatttctgaattaggtgtttacagcaggggatcattcaggtactcgattcaatgaataatttgctttcctgtgatctgtaatctgtgacaagagatggttcattatccttcttgagcatgtgtattgcaatgggcacataccactgggaattagttggattcccctttctgtgtatcgcaattggagaaattctctgtttgtcttgcgggagggtgcacactgcacagcatgcgaggggagggaaggacggacgactctgctcttaggacgtgctttgggtgaggggaggaaagggcatatgaatcaaatttttaagtagtacagataaaattgaggattgttattctctattttgttcaccaagcgcaaaaaaatggtttgattgaaacacatggttttttcttatgtactggtttgtttgctccgttttccaaacctaacccttctaataaactactccctccgtatcatctgttttatattatatattgctttcacttttgtaaaaacaatctttttattgtttgacctagtttatagaaaaatataacaacatttatagcattaaattagttttattaaataaacattgaattcattttgatagtttctttattttatgttgaaagtattgctagatttatctatgaacttaatcaaagttatgttaaagaaatttgacttagaaaaaagtcgaactgacttataatatgaaacgaagatagtagatatttatgattttaaaatttattctacttttcataaaacacatggcacaaacaagtacatttcattatctcaaaatgaaaaaccaactacaactacgtttgattagacgacatacctactttcttctatcaaaatggagcatgaggcattgctggtctatggattacaaaacagtatcatttagagaaaaaaacagaacaaaagttcaaagggaggacgggcgatcgactacgccgcgcgcgtacggcgcacgttctttgccaagatcatgtctagatgcagacaaaatggaggtgtggctgctggctatggcacggcatggcggctggggcaagctagggttcggtagacacctctgacatcggtgatgtctcacacatcttactggaggtgatgtgcctggtttttcctcttttataaatttgtgcgttctggtagatctaagggttaaaaccttgatgtcaacgttcttgaaggcgtcgcattgaaagttttctggtattgtatcctttgtggctgtccctattggatcggcttcgatgaataggcgatgacaaaatctaggcgattgaatgcttcttgctcagtttatatgatgttatcttccacttatggttcaacatcactcatgatggtgatatgtgtaaaattcgattgacaatgattgcctacagattttagagattccgcttttagttataggaagacaatgagtagatataacttgtaagctattgggaagaaataatggttatgtacattttcaccaaccattgatagaaattccctgtctttgagaaaatatttgaagtagttttcttgttttagtaaagctgtgatttttgtagttcgcatattcatgcatcctgaaatctctgtaatgattggttgtatatttttataaaatccaagataaaaataaattttattatctaaataaattgctggcctatatgttgggttacaataaaatccgtgctacgtggttgatatcatgcatgttgtcagtggtggtgatattgttcacgtagaagtgtgtgtagtgaatacaacttaacaactgtagtaggaggaaaccttcctggacgccatcaccgccagggactgaaactttggaatgaaatttcaaaaatacccccacccccaccggcaagcacatatatctcacttgaaatttccggggttttttttttcaattgtttgtgaatttgatcaattttatttaaaattaatcaaattttcaaataattttggtcaataaaaataccgaaaattcggtaatttcaggaatgttggacccttggctcacgctctgtcgccctgatgacgcctagcgaggtaaacacctccccctcacacacaagtgtagagactcgtcgctggcaagaaacacacccaccggagaaaataatctagccctgtcgcgatcgtaacaggagacactaatcatcgccacagatcagttttgccgacagtattggttatgttggggaatctggatcctctgatatccaaatgtggaccattgtcaacacaaaacttgtgcacttctccccaaatgcctcctattcatatcacacccctctttctctcactcatcttctttgattttagccactccttgttagttgctactactccacttcgctatgtgtttgtgcagtgtggaaaatggaagctacaagctagctcaaatatgtggtggtatagaaaagagttggataagttgttttcagtttttttccctcctagtacaattgtttttagcatgtcgtgtagtagccaaatgttacaaaagaggtcaaagagagaatgaaatggagcagcacacttaacaactgctgcatgcatgtggagaaagctccatctaattgcaatatgttttttttatattcatctgcaagatatacctagcgaacatgtgcatgcgtatgagttatatgcttacttctgaatattcatgcgttggaatagcagccatagttgcatcatcatattcagctgaagatgtacaagagtcagatcagaaaacgtcacatacgagatgaatcagaaaatgctgaatcagatctgaagctgcgagaacattggttttggtgcgcatgaagcagaaaatgtgcgtgcacatgcgtacgagtcatttagacaatgctgtgagaacgttggtattggtaaattctgtcacccctgtcaacacagattccggagatgaacaatctatactgatttgggagattctttcatgggatttgttccacaagatatattccctgatgcctcctattcatatctcgtgttgtaatttgttttggaaaatgaaaccaaccattccatgcctctgcacctgagggtgtatcacactgtaatacacccattatttccctccccctctctcaatcatgttctaaattcttcttggatggctcatgctgcctgccttgctattgcttgaatgagttgtgcatgtggtggaagaactactgcgagaaaaaaaaggcgaggcggtataaatactactaggagatagatagatgaattatatataactaggaaggtggcccgcacgatgcgcgggcatttatattgttgaaagataagattatagtttatttagaaattgtctcataggtaataaacttgggatcgaacaatatccttttaaaatgattcaggggttctattttcttaatgtaactcaaaaaacattcagactcttgaatacaagatggattaagttagtacaactttactaccgctagcttaattatcaaccatatcacttgtatacataccatgcaaatatgggtacaagcgaaaattgcaaaatcaaggaactcaaaatggatcatcttatgaaggcatataacgaacaaattaatggtaaattaaaacttggatttcccccctgtatataagttcaacaatttcatattttctccatagttttgaagaactttaaaaggttttggtgcatacaaatcacctacaccatcgctttgcttggtattgcaaaatatcaacattgtttgaagctaaattctttagtttttgcaagtttcattattttcttggaacaataattgtttaaaataagactataattatataaatttaattagtatgggtagtttacttataaattttgaagtgttttgaagtaaagtttttctatcatgtagtctggttatatcaataatatagttttgttcaataaattcaatattatttacatcaccagaattaataaaaatttataaaaccatccatgactacttaaaattttggtttgtctgatttgtttatttcaaatttagataatcacatattctccttctaatcggtgtgtttgtcattattcataataaaaaaaacactccttgtacagctgacacatcatattgtcactcaatcacatacaaatgtaaaatatttgtcattattctcggaccgctcattcctcattggtatcttccactcatccatcatcttataatagaagtatacaccatattttgtctaactatttagtttacgtaagggacaacaccacgctcctcctccctcatgcatgggacacagtgtccaatttttttccaaagcaagtttttaattaacacatgtaattagaatattacatgtgtaatatatgtgtatgtgacacatggtaatttttattctagcttcgccctgcttatatactgtatagagagattaattatattcaacctgcagtgcttgattcttcttctttctacattgcatcttcgcgatttgttttcatgttattaaaaaaaccaatcgttgcccattgatgatttgacacattttcattttagcgaagcagtagcgctataacatcatgatcaccttagctaccttaggtatacgatgcttcgtcatgcgtgtagaaggtaaagacgtcacatgtgttgtatagagagacaaagaggacttccgaggctagatctcatggtctaaataatatgtccaccggtttaactaaaaatcgataaacaaatatttttattaggaaatagtctaaaataattggtacataatatcatataatggtgttaactctatttttaaatattgtagatctaatttatttacatctaattgtaaagagttatatgttgacattcaatattagtaaagcaactattatgtaaagtttattatcatgaataataataattatagtggctcaactaaatacatggaaaaatggaaagggaaaaagaggaaggtcctcttgagttgaaggaaaggcgggtacgtagggagagaagaggtggaatcgtagtttaatctaacggcttataatattggacacaccaatttatgtggaaattaagggatatatgttttgttttttttctcaaattttgtagcatttggtaacttgagagcgttttgaggaactttaatggacatacgtcgtatcgtttggttgagacacttatataaggacaatattaaccggagaacatccagcacgttttgtccctaaattgttttcgtcagttttgctttttataattttgtaacataatagttatctttatactatattgtatttatgtaatacatagaagcaattatttataatgttattcatcaactgtaaagaatggtaggcttattttctttaaaaaagcatgcatactaaattaagtgttaaatgaaaattaagacttttttaattggatataggttattgttttctattaatggatgaattgggtggacatgaaagtccactaaatgcattggttatatagtctaatatgatttggtgtagttcgagatgcggcccaggaatccaagaattgagaatttttttacggtggattaattgttttttggattttaatatttgtatgttaaaattcagcagctatcagtgagatggagtaacctcagttttgtatttttcttcagaacagaagaattaaacattggtgctaattacgtctaaatagaaaaaagtacatttagttctaataacaatgattaaaagaagcaatattaaacacataccacataactgttgatcttcgttctttctgccccataatgttttcttgtctgtaaactcaaagtagtagtccgagaaacattcttttttgcttcgacctattttattattgtatcgtgataaaaaaagattttgagatatctttcggtacacagtacttatcatgttccataactttgattatttttaaaaaatgtataatgagtttatcttaatttttggcctaaagtggtttgccaattgctttgggattgaggcatgtattgagttgcctcgaagaaaatagtatttacataatagaacaatatattaaatgacatgtttgcaacaatcataccttgcatctagtagactcatctgtataccatagaactcacagccattgtaagattaaccgcatcctatagcctaatcactcttactttaattatacacaatacttatcatgttccataactttggaacttttaaaaatatataatgagtttatcttaatttttggcctaaagtggtttgccaattgctttgggattgcggcatgtattgagttgccccgaagaaaatagtatttacataatagaacaatatattaaatgatatgtttgcaacaatgataccttgcgtcaagtagaatcatctgtataccatagaactcatcagccattgtaggattaatcgcatcccattgcctaatcactcttaatttaattgtccacctatcattttttctgtgttaacgcagtaatcaaattgtaaagtaccatgttatctgcaaatgttcatatgcaatataatatatacatttatgttattcaatagatgcaatatagtgtagccttaattaatacaggatagcattattgtgttcttctataggtgcacgattaccttcttttgccaaatatgagcagcctgaattgactaatgtcaccaaacacctcttatgccaagatgagtcgccagatagagtcgtgtattgtagagattaaaataccatctggtcgtggtgttgctgaaggagataacactggtggagaaaccctttgtagtcccggttcgtaacccccctttagtcccggtttccaaaccgggagtaccaatccgggactaaagatcgctatctttagtcccgggtgaaataaccgggactaaagatcgagctgacctttttttttttcatggccctgttgctgcatggtttatatatatatatatatatatatatatatatatatatatatatatatataaaccatgcatatatatgtttcaatacatatatatgcatacatatatatatatgtatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtatattattttctatagtctacttatatacaaggacctaatttattaaaggagacgtatagtaagaaatctaaccgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggcggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtaaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctggggggcccttgagtttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacatgtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggacatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtttgcagggcgagtgtcagttcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttgcacttccgttatgatgtgtcgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgtttccttcctcgttcaagtactggtttggatcctcgttcccctcttcttcattccagtactggctgcttccctccgcgattgtgtcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattgtacaaccctagctagtaaataattatatactaagtctaattccaaataaaataatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtataattaagactacaatagtcaattgctacttgtcgcaccaattccatagtcaataattacatactaagtctaattacaaataaagtaatcttatattaaaactccaataatattacatgctaagactaaaatagtcatctatgctaagtgtttcgtgcgtatatgctaagtctaattaagactacaatagtcaattgctacttgtcgccccaattccgtagtcaataattatacatactaagtctaattacaaataaagtaatcttatattaaaactcaaataatattacaacactacacaatcttatatgataagtccaattacaggtctaataatcttaattaattgcattacaaatataacaatcatttatattattacgtcacttgcctgctccaattccttctagggctagctcttccactcaggcttgacggacgactccaacaacacgtcttttctgcaagataaaaaagatgtattaggataaatgcgaagtaacatatatatatatat

SEQ ID NO: 19577 - DNA, 684 bp, Oryza sativa
cggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacatgtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggacatgcgttcatcaaccttccttgccacctcctcttgcatgttgagttcgtagctcgatacccggaactctaggtctgcaatcttcgcctcggtatctctcttgctcctcatccgactc

SEQ ID NO: 19578 - DNA, 822 bp, Oryza sativa
  unsure (1)..(822): unsure at all n locations
nnnnnnnnnnnnnnnnnnnnnnnnnnnnnnnnnnnnnnnnnnnnnnnnnnnnnnnnnnnttgaatgagcccccaggcccccgccaatcttaacttttttcttattctttcttctaaggccttcatgcctcttttttgtacaatttaacttaatctgcaatgagaaatgatgaaaaaatttttgtgttagttttattttgctatatatgagatgaggatgatctgtgccgtggtctttttgcgtcttagcttgaaataagggcccgtgcccaagtcccagtcctcgaaaagcgcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagtacgagtgaccttattttaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcctgagccaaaacctgacacccgacccccccccctcctcaggggtagaagcgacgaaggtgttcgatgttccatgggttaggcagctccgtgcaatcgcccgtggccagccgtaccgagcccggccgggggacaccgatcactcgatacgg

SEQ ID NO: 19579 - DNA, 680 bp, Oryza sativa
  unsure (1)..(680): unsure at all n locations
nnnnnnnnnnnnnnnnnnnnnnnnnnnnnnnnnnnnnnnnnnnnnnnnnntgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttaaaatccaaagaccttgatgtcatcctagggatggactggttagccagacataaaggtgtgatagactgtgccaacaaaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcattaccatggggagctcccgttattcttggggaaaagaaagaccatactcagagaatgtgtgtggactattgggcactaaacgatgtgactattaagaa

SEQ ID NO: 19580 - DNA, 325 bp, Oryza sativa
cgaacgagagccagaacgaacacgtcaacgtacgttgccgcgagaacgtgaacgagaacgagaatgatcgaacgaacgagagcgagaacgagaacgatcgatcgaagacaagcgagaacgagggaacgaacgtgaatgagaacaagcgaacgaacgtgaatgagaacgagcgaacgaacgtgaacgagctagggaacatgaacgagcgaacgaacgaggacgaacgttaacgtgaaatgcaatatatatatatatatatatatatatatatatatatatatatatatatatatatatatatatatatatatatatatatatatat

SEQ ID NO: 19581 - DNA, 5361 bp, Oryza sativa
  unsure (1)..(5361): unsure at all n locations
tgttcatgcttgtttaagtgttgttttggtgattttgttcttttctctttagattccgacgttcccggagagtccgattttacaggggaagattttgaagagtttcaaggccagcaaggcaagtcacacagatcccaaacaaccctttgagcatgttgatcatgtttaaagctattgtttttattcaactactgcatttatttttgaatgtcattgggtggaaataacctattgttttgttatagccctttttgttcttgattaccctattctttgataccttgggttattataacttgactagttgagctttatacattggttcagctagatattagatataattgcacactagtgggataacttatgcttcactattatttaatgatggcttaatgatagctcatgatggttaatcatgattggttaagtaattaatttgccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttgtttataagggggtgattatgatccgggaacggtgcactgctttgaattgtgttatgcaggaggtattgtcacaatctctattcgggtacttgttaagtatcgcgacgcatggttgacatgatgttgaggttgtgtcttgtgggtacagtggtacacctctggctagagtttaaactattcgaatagccgtacccgcggttatgggcgggtctaacaatgtctttcgtgattagtttcacacctctcaccgtaataaataatgttgtaattggtaataacttgtttagctcctggtttggaatggtatattcctggtttggagatagaactgtgcagccgggattggttgttcagaatggttgggcctatgcaacacgggtgtgttgtatagtgttgatttaatattgtttaattactcaactgttttattattttctcaattgcttattaaatgctgtttatgcaaatgagactatattatgccatcctttgttatcctgtgcacttgcatatttgctgcgtggcttgctgagtatgtcatatactcaccttgcaatcattcatcagaggaggagttctacagtgatgctaatggtgtggatgattaggtgtagccctggtcaagctacctgtgaagtggagtcgcctgcgctgtttcttttattttccgctgcttagatctttattgttttagaggaactatctacctctgtaatgacattttatacgcttattaattagagtaataattgtactctattatcaatttgttattgtgtgccctggctgattcctgaacgagggttcacacacatgtaagcgtttggaattttggatagaaattccgggcgtgacacccggtgtgactggcaccaaaaccatttcaccatatatctctaaatatcagtatcaattatctctcgtgccaattgtttatcatgaaataataatcaaaacacactttgatttcacatatgccaatgtgtattaatgtttgtggaaagcaaattatcatttgctgcgttcagggagctcactttgggaacttttcccccacgcacatttaacggagcaactcatttgcacatgtttagctaagtatcagctaaaatggattttttaaaaactatgattttaagcaacttttcaagattttttttttcaaaaatatacaccttttagtagtttgggaaacgtgcgcatggaaactcacatgtacgaacacagcttaagtggtattaacactacaacaaaaacctcgtatagaggcacttttgtagaggagttttgcaaattgcttctaagatcataagttttatagtgtagagacacttcaaaaattatctagaaaacttttactctagagacaattttagctcagtttgttagatcttatcttatagaggcattctttcggcactataaaatgcgtttaatatgtaaaggcattttgttgagacattttaaactatgtagagatactttttagaatgataatgtgtaactaaagaaacaaacatacaagtaatgacatggaggtgagttggttagtgcattgaagattaaaatgatttaaccaagagatcaaggcttgacaaaagcaaggatattattatattctcttttttggactgggtttatatggttgtggtacaatttaatgtctctagaaaatgcctctacaatcttatagacattttataaaatctctcttcgtttatagagagaattcaccataagacacttattattagacatgttttaaaatgcctctatattgttgtaaaggcatttgaaaagtgcctctattatactagaaaaatgtctcttacaaaacattnttcttgtagtactgtaacattaggtgctagtagcagtttcactgccgattatgcacccggagattctaaagcgggcagcaaatagagtgttgtcacactactacagattcgatttttccatgtagtcaaaaccgatttttccatgcggaggtagcgcccatctgcacctaggtgtttgcaaaaatcaacattatcgcgtgcgggcagcccaaccgcacaggatactctattatcccgtgcggccgggttacgtggactgcacgggataatcgattatcccgtgcgatcgagttaagaggacctcttgggataatagattatcccatgcgttatgttaagtggaccgtacaggatagtagattatcccgtgcagttcagttatgtcgaccgtacaggataatctattatcctagtcggctagcatgtgttaggccgaccgcacgggataatagattcgtgcagtcaccctaacaattgctaaccgttggggaaaatgtacgtactcattattttttgtgtatttttgaatcgtaaagttacatataaattatacaagcacaattagaaacatcgatatatatatatatatattacatagcatatgtacatgtctagtgttcataatattaaaaatagatgttttttattctattgcatgttctctctcccactcccttaggtttttgaattgggggtccatagcaagttcgctgtaagggtcatagaactcccttggatggttgcggatgttgcaacgaatgaaccggcataagtccgcgcagatgttcagaagcgttttctggtcgaaccagtttgctgtatatgggatgctcggaagctatggaaaatagaagaaaaatgatatgtgttaaaagcgacttaaatgaactatttcctatatgtaaggagcatgatgacttatatctgtaaactcagttatgtatcttccacggaccctgagcatctcgcacacttaatatccccataggttggtactgttgggttgcttgtaacactgcgtaagaacagtagacacgtcagtaataagaacaaacaattgcatcatatacttaacgaatatatatatttgattacataccggccagcgtccctttacgagaagtcttgtcctcttttgatcctttacgaacccgccatgttttctgtaatagtcgtgttctctacaaagatgaaatatttgattgagctaactttatctttgatcctttgctttcttcctcttgattgccttcttctataccttcccgaacacgaccttaatcttcttggccatgtcgaagacttgtgcaccagttcatgcttcaggaggaagatcgttctctacggacttgtcaaataagttggccatcttacgccacttgtgcctctgtggtaagaaccgacggtgacgcatgtacactgtcttccttgaggaggtgaggtacctgtatgacgtgttgtcgatacatataagacatccgaacttcctcttaagctatcctgggagccaaaagttaaccggcaggtcgttgatggtaatgaatataatggcacgtagagtaaaatgctccctacagtactcgtcgtacactcgtatcccttctttccaacgcttcccaattgtcaaaccctcatcttgtactagctagaacctctggttcaacgtgccacaacatatcctccagatcaaaatcaatatatgtatcatctataccagagccaccacattttgggtgaagatgcacttaaaccccctagtgggttttggtgattaatgacaatgtggttaaaggggactaacgtgtttatcaagtttattcacaggagtttagtcccaaagcaagttgtgatgactaagaatgcaaggagaccccccaattcgaatgttcctaagtgcgaaaatcgctgtaggtgattagactaggtttttcactttcgaaattgagtttaggaaaaaccgtactattaagaggggtttcaagtgtggttctatggtatacaaagtgctcttagtcatatccatgagtcaaaagatttttggaatcatttttgaaaaatgattttctccccaggacagagagggctacccgaaggttctggccggaacttccgggcgccgtttaattgcaaaaattttcctaagtgctgcccagaagttcctagcacttgcccggaacctcatggcaggtttccagttcaaacatgtgagtaccggctagatgacatcacctagccgttataaatatggatttcatccccaggtcaccctttggccattccacttcagttctttcatgttcgagggttttctagccactcccaagcttcctttgctttctccactcaaatctagagcctatcttgtgagattgagagattagatgagagtgtaggagtgttttggagatggcttgaagattaggtttgattgagcactttggataccttgtgggctgtcacttgggcttattactcttggagatcttctcctagatggttaggtgtctcccgtgagcttccaaagatcttgtggatgtcgtaggaaagtttgtgaagtttttcctcacctccgcaaggaaacgaggtaagtgagtaaagattcttgtgctgagttttcagaggttgtcctaggtagagcaacttgcacttgtggtcttttctagaagaaattttgagttggatcttggtggtctctcaattctagaaaataacctagaagtgttgagttgaaggctgtggacctcttctgggatctttgcataagtgagccaaggggttaatcgagacccggctctttggagcacctcaacggagagtaggattcgtgtgatccgaacttcgggaaaaaat

SEQ ID NO: 19582 - DNA, 1468 bp, Oryza sativa
cgttggtaatcctgcatatacatttttttttactaacgcgctgtttgtacctcacagctgcgaccgttggagagcacttgctatgctatcaagcaacccggcaaggggaaggggccaatggttgaagccatcagggcgccggcgtacaccttcccaaatatgtctgccatcatctggccacacctaggtgggttgcctaatgaacagaggagtagcttgcaagaatccattgccgagtacgacaggcaggcgaaagagagtgcagtggagatcgagcgccatttcaggatagttgttgacaagcagcatatgctatgtcagcgtgtaattgatgcgccacaagcaaacagagcagcagcaccccaacccattgtgcctcagcccgcccgatgccaagaagtcaaccggaggcaaagcaacgtgcaacccaccggcgccgaaaccaatcccaatgaagaggatgagcagcagcaatagcagctgcagcagcatgggtgcgtcgctaaaccgagtttgcttgatcaacacacagatcaccctaacgatcccacgcaagtgagccggcccatgcatgcaaattgtgccctacgtacctcctgtgcgtcatgatgcagcagatcaggcccagtcttggattgctgactcaccggttctgacacagcgcacaccacccccacggacagcgcacccctcacaactgaggaagttgccgctcaagatccaaggcgccagacaccgtggaagacacactaggcgtcgaggctgtgtgtgcgattggtattgatccagttgcttcaaccggcattcatatggaacatgctactagtgccggtgaacaacaatctcacccgacggaggaaacaactgagctgccccacgccgaagataccacgcgatgtaaggagaattagttacccattatatcgttatacatacatcagcaaagtgatatccttgtagtacatttcattacttcgcagcctcgcaatttctttccgtcacgccgtcaccgtcatttgttctaccgccggacacggacatgatcgacacacaagtgaacgagaaaatcaaggagatttgcaggctcgagggggctcctacattctccgtggttgtattctcaaacatcccattcgtcgagttcacttgtgcttcattgcatcaaatcatattctcgtagtttgggtttcctctggacacatttttttttgtcatcaacttgagcatgagcacttagggattgtctgcttggtcaaacagtacgcaccaaaagtttaattctgaggcaatatgtgaggtgttttctccagttgcaaactgcagtaagatagtcatttattaacttcactgatcaaggaaccactaagctagtggttcaaataaacaaccccactggaaatggatgagaaatcaagaaaatatcattatgagtaaaatttgaactaaactctttagttcattatttttg

SEQ ID NO: 19583 - DNA, 5010 bp, Oryza sativa
  unsure (1)..(5010): unsure at all n locations
cttttcatagacgtgttcagctcgattctattcaaggatgacatgaagtacaggctagataattatggaaaaaggattttcattccgacttccatatcagtaacgtgaataacgccaatttctactgtattcctttttttcgtacggtgcagcaacatgattgtttttctgttcttttttttcgcgagatgtgactcttttggttcacaccaacacatggccacacttttttttttttgcagcttctcctgaacattgattttatcaaacaaaatggaaagatacaaattttccactgatgctttggccggaaacttgcgcgactacatccagcattggttagttattaatttttgcataaagactaatgccatgtttactttttttccctgcatcgagcatcttttaaacccaacaatgctattgtaagtttcgtttctttacttccaaacactgaatggacagataatggttcctgtgctccaccactatcactggtctctagatgcaatcaacattgcacacaggctggttgacataatggatacaaacaactacactttgctcggaacactggtaagcgaccaccatggtgcgttggccaaacgcatcgtcaagcgtctgagcgatgcgctgcatgcggtagtgccgaagagcttctgcaggttcggcggctttaggaagaacatgatggagtgcccaaaaatacaaatttgctccatcgactgcgccttctatatcatgcggttcatggaggcttacgacggcaacatggaatccatcgagaatctttccatcccggtaactatagcaatcacccccttacatttgtatactgactcattcgtcgttcatttccacactattctataccaattcacgtccaacatgtgttttgcagactgactcggtgattgtccggtcaagcaccctgcaccagctgatgttcagcgagtacaaccaagccgcgcctctccattccgatatctagaagttccgcggaactgatgttatcgatcctgcggcctaaaaaaacagtcatgctttacctttttggaaaaactttttcattgggatacatgatgtctttaccatagcttagaaccagtgtggtctcactatatatgtttcttttggtgtttgtcactgtacatttcgaatggtactggttagtgtgatgaccctttatagaatgtcaaggttggtgcatatcctgacatgtgtttttgctcggcatgcattatgactattggtacctgtcaacttcaatccactagtctgaaaaacaaaaaccctattttttgtgtttcctcctattggagtcaatttttaactcgcctagcacaaccaataaggtcctgacttcggcaaggtacattcaatgaattcaccagagtcaacacacaagttactttttaactgaacatgtataccccactatctatgaggaaaaagaatccgtgtttccactgtgagtaaagttaaaaaaataactcctttttcatcccgcctaatgttttcaaacacttcaaaggttattacgtgaagagtcaagcaattgcccaacaaacggacgtagcttgcttcactggaagaacagaatattagttaaaaaaattactctcaaaagcacaaatcaatcttgcaggcacgaacccgatgatgagtaaaaaaaaactagtttcgcgtatagggggcaacctgtacataatccatccaagtttacgaagcattaagttaaagaattactcgccattcccatcctgaccatcgatctgctgagattaaataaaaggattcaagaaaatctatgtatacttactcgtacgtgtgcccgtaataatagttaaaaataactattagtagcaaacacactaaaattctccgtggtgtatccaaaagctttaactatcggctagaagtaaaactttaactattattgccacaggtaatatcagttaaaatttaactggcattcaaatctacaccacgactgtaacatacccaagcctataaacctgagaactaaatttaatttaaatgcatcatgtggttgtggagtgattttaattgtttttggatcttaatagtaatatgtccgtactaacgttacggtgtcataacattttttcttaataagttattaaaattcgactgcaatgaaaataattttcctagaatctgtccatttaagctttcagtccaaggtcatatataaaaaagaaatattatgatataacttaaaattatttattcaagatcatcaatgattatatctaatcaatttaatatacactatatgaaggtcatatatcaaaaaaaaatattatgatataacttaaaattatttattcaagatcatcaatgattatatctaatcaattcaatatacactgtatgaggacaatgcatatccacacaaaaaagaatggttgagttattcctcaagaaattaagatagacaagtatgaatctttttttggtaagtatgcaccgttaacgacccaactgattactacaaaaaaaacattgacttctggtaaaatatggttgaattttgtcaaaaatttaaagtcagttcgaatttttaaacttgctgaaaacacaaaaccaaacatttttgccagtctaataagtttgatttttcttgtaaaccctgctggagagtaaacctcaaatatttataacaggacgtattaacaacaaaatatataactcttcttatcattattacttcttttgcatgtcttaaatcaatctcctttactgaaacatatattgtcttttgattatttgatttgcattatcaaataccgccgtgactataatactcttttggttatcgctgattcaagcattcaagctaagtatttgtcagcaagctgcaagccattcctgatgcgtttctgctttccagcggcatacatccttccgcgagccaaaagttctatcaaggccatctgaagtataaatagccagctacatcctttgattatagttgagtcatcatgtgtacagaaaaaaagaaatgcagtattacctcatattatctttctactgctacaactttattaattttaatatgtttgcttcgtcgtagcatccgccactttggcacaaccttcatttaacattgtcaagttgtcaacctacatgctacagcacagcctcaaccctgcttccatgcatagacaagctctcttccaatgccatttttggcctcaaccatgcttccatgcttagataagctctcttctaagaaatatgtccttttaatataaagacctaatgagtttcagtgttattacatatctcttctatataggaaatatgttgttaatcaaaacaatgcaaccctgatcggcaagaggcaaagataaatataccatccagtatctcttctgtacaggaaatatgttaactaaaataatgcaaccctaatcagcangagacaaaagataacatgctatcactgaatgtgagatacatatttatccagaacaagtgatgtcaagaaacatagctttagaaaattatctgtataatatttgtatgtttatcttccctaacattaattttctaatcgttggattcagaccatgtcccaatccactttacttcccacacattccatgccctaatcttatatatacatctcattacactatgtattgattgtatcagtacattctatgtcattgcaaaggcaagtttctctacagactaataaaatatgtgctatttgtttcttctgtagaatgatttggtctgacagaatgagaagtaaacaaaaatctgaaaagcaacatatactataaggaactgaacttcattcaactaccactacagagtgagactgattttacttggcactattatggagtaccaatcaagtggaagccgcagccttcctgaccttaccttaatatatgtggtatttgatttaacaaattaatccaccgaaaaaagtcaccgctataaagtttcagtgtctgtgatcaagacgatcagatcaatacacggtggctgccaagagtaccttcgaggggcgcaacaacccacaccgaatcagctacaagggttttttatagtatagatagaagcaacttccatccatccaatacttaacttattttatccaagtttgcatggcctagtaaagttataagtttggaatggagtatacatgtgttcctacttgccctgctgccgcacctccatggcaaacaacaaacagtactatctgatgctgtctacaaaaatcttagaaattaaatgggctgcatataactcttcttcccctgcaagaagcatttgagtgaagccattaaggaatataacaaaaaaaaattctgagaaccattgtacaaaagctcaatgaaatgaaattaaggagtacctgccggtgtactggatgtgaagaacagatatatatatcatgcaatggcatgcttaaataagtgtcctgacaatggcatctcgtatcatgccatattgaaactaattttaagcaaagccattatgccattcacttccacttcaagtacatgtatcgcagattatacactaatatcttatgagtcccacttccacttctggtttgcataaatgaacccatattcacaaactacccaaaagtaaagttggaataccttcgcctgaataccaatgtttctacttttcagcaatttggctactgaaacagaaacaaattatcaacaattccttctcagatatagttgtaaagatatttatgcatcatggttcaattgcaccttatgagtattgacatgaaaatggataaggaatatcttgcagagatgcttctactctgagtagcagcagacgtttacctgcatgataagcttccgcatccaaccagtagatgaagaaacacaaccaaattccactgcagaaatcttgcgtttgtagcaaaattccacacacggccttctacatattacttttggtgctcctcatatgcagcaggtgctttatatttcccttaac

SEQ ID NO: 19584 - DNA, 320 bp, Oryza sativa
atgatttaaaatacgcattattaatttagacgatttttagggcgtgacactcctcaggctgtgactctggatcaatcaaacgatctcgtctacacttggcaagttgatgaaggtagttggacttgggtcttccaatgtggtgcataggagtggtgtcaaaaccaagagtcttgtagagccgaacgggattctcacgagatcctacagggaaatcatgagatgccctttcagccccagaactgcgaccaccacctttcccgtgacctcttgtattaggggcatcacttccttgaccactatcaacatccctaatctgaaca

SEQ ID NO: 19585 - DNA, 779 bp, Oryza sativa
cttttaaaataaattctagaaattccaattaaacaacaatttatatattttaaattttcagggtgtgacatcctgagatcacttcttggtacaagatggtcttgataccaggaataaagctcaaacattcaccctatatccaaaaaccccttttgtgaaaatttttgcaaattccctgctgtgccttttattgcgaaaatttggcttttatccccttcttgtggtgtatattgaccatggttatgtaatgttgattgtaggctggtcatatacgtcataagtctctgcatgtccatagttccctatttccccgcgttgaattctcatctcttccttgtttttggtcctgactgccctttatctgtcaggccggaagttccgggcctccttgtccggaacctcggggtatcggggagtatatatactcagggggagttagaagccccattctctctcctcatttcttctctctccccgacgccaaccctagccgccgctatagtgctcctagtggcgattttcactttcgtccaatcaaattcgtttcttctccgtggattcatccacattggtggctgggaggttctttctgtgatcgattcgcagtttcttctctcaaggtagaacttttggattccctctctcggttcattgtgtttttatcccgatctctaaatctgtgaaccttgggagaaaaccacttggatagtcttggttctgctacccttgttgatcactgatctataggatttgttcacatgcactggctatttttgaaa

SEQ ID NO: 19586 - DNA, 841 bp, Oryza sativa
  unsure (1)..(841): unsure at all n locations
nnnnnnnnnnnnnnnnnnnnnnnnnnnnnnnnnnnnnnnnnnnnnnnnnnnnnnnnnnnnnnncgaaacctggtcacaatatattatcaccacatccatacgtggatcaggtatcataataaagcggatgacttttgcctcgtcggtgcccagtcatatataccggcctttattccagcttgccaatggctttgcccaccgcctcctctgttcccgctcgcagtgtgatgacgccggctgccacctccgctcgtagtcgagcgtggacgtcgacgaccgtcgtttcctcctctcccgtttgagtgcgacactagcaactgccatctcctccgccccttcttaatcttcctccccctccccctagcgcctccactctgcccatcccctcagccagatccagccaccgccgaggttggggcgccagatttggcaaggacgacaggccggcaacaggaggcctttcttggctcgatcgggggcttggcgacctctggtgcagtggtctggtgtgcggggacgtcaggaggtctcaccatcctcacagtacagcggatgcagtgactgtgtggtagggcgacaggaagggagacatctcagatggcagatgtcagtgaacatcttgtataggatctttcatttattttgcactcgaggcgttcgacgaaatgcccatggtataaacatgagaagttttatttctgtcgcgcccagttttagtttctgatttctgttcagcagaaaggaggcatgcagacaatccattgggcacggctgatgatcctagagggacaggaactggagttctcttttggctggctaggctatctctggttttgagact

SEQ ID NO: 19587 - DNA, 4297 bp, Oryza sativa
  unsure (1)..(4297): unsure at all n locations
nnnnnnnnnnnnnnnnnnnnnnnnnnnnnnnnnnnnnnnnnnnnnnnnnnnnnnnnnnnnnntaactggagttctcttttgtctgtctagtctatctctggttttgagactttataacattatgtaatttgaaactatgtaatctcaggctacataatggatttggacttgtcttgttgtttagtcctctcgtagtgttctttagtcctggggaggttcataagtaccggggaggttctgccaatttttttattaaattttgacaacttttaacatatcgcattagttggcctgtttggtagagctctaactcctaaatttaacttcagaagttgggtctagagtggagttgaggtgctgcctaaaaccagctccacctctttagtttattttgtgagagagctccacacagttccgctctcattctaggtggagctgagctccagctctaggagaggtggagctagagctggacctgtgccaaacagaccatgtaagcgttaattaattaatgatctttgttacctacaaatacaccgataatcttattcatatgcaatactagtattaaattcctatgcagcacaggctccgtagcagtcggcccattagtcctatactcctattcgccaatccaccacttctcacaggtaaagcaccttttcttcctctcacattcgtcttcctcgatgcaccctctccttttcatttttacgcaatctttccttccgccatctcctttccattcactggcggccggctacaatcaatctccggcgagctcccactgcaggttctcctttcgcccccgtataaacctcccacttgatgcagcactccaacacactgtatgacccattttcatttctcttcatctggacctcccaaaagctcgactgcagccgcttggaaattgtgaccatggcgagaccgacagcggaccacaacaacgaaggaattttgaggtggcgcgacatggagagataagatgggggagcactggaagaaagcgtcgggacttggggagaaatatgcgggcttacggcggcaatgctttacccattctaatcttaccccttgcaaatggatggatgtgagtggtacctcgtggtacctggcacctcataataaaaactctcatttttttactctactttgctctatgttcaagtcagtgatctaagcataacgctgtaattaactatcctatataaaaactagatatatgttgattaattttgtttcactacccttgaaatcccatctccgtcctgtattcaatatttcgtatatatttaagttatgacatgaagtgaaattaagatcctaaagctctaacctcagtgtttcacgtcatcgtcagttctcagccgttggatcagtgacttgtatcgtttctcagccgttggatgaggaaaatgcatcactgtcagattgaagacagcccaaccatcatctcacacacagatagcacatgaggcccatgtaataacttggaccacgtgaggcccatgtaataacttggaccatgtgaggcccatctgtgtcgatctaggcccaatcaacagtgaaggagttagggtttgtttttttttttttttggctcagtgggggtttcctcatggagttagagtggtggcggtggcggcgcttctttccatcaacggtgctcgggaccgtagcgttagcttctcctattctaaaacatctttcgcttcaacttccctgttcgactcttcatctccttagcaacgaaactgacagccacctccttcgctaataaaagcatgcaccaccaacgattattcttagcgatgcaagcagagctgcgtagccaagcgcctgcttgcctagatcaactattgagctcaggtagtcaggtaattaatcagtttaagcatgtcaggttaatttctttagctccctctcactctctcaacattttcttttaatttcatggatcccaatttttccttttttatttcttcttattaatcacacaaccaattcaaattcgacaaatttaatgttgttaagtagttcttgttttcactgaaatctctgaagttgttggaagaaatcagtggaccgaccaagattattactgtccgcatcacatctgatagatagtttcagcaaattctcggtaaaatgctttagcagtgcagcatgagtggtaagaagaaccacatctttttcgaatcatgatatttatgtgtttctatatattgttatggtcttagagctgttggttgctccaagtataatttttatatgctccacaaattattgccttcattgacaatgttttaatatacagcttattactctgagggatgagtggtggtatgatatgctgtatattttatctgtgcagggcactttttttctctgaatggaccataatatctgttgagatattgcattcttactcacctgttcataagataaattattgcatggaaccatggactgaatcatatatcgtgtgctctatgcagtatggacatttgctaaaatcctactcaatttatggtgtaatgtatatgtagctcctgtaagttcttcctagatgaattctgaatattaatgtttgcttcaaatgtaatatagcgttgacagtcactccattcttaccttaagttataaatatctcaggctcttactttctctgttctgctaatacaacttcgaactagttatctatataaactaatttgttgtaatagccacagcttccatattcttaatttacctacctgctcttttatagaaaaacaattgggaaagcccctcttgtatattaattgtataaagtttattttaatttctctaccccttatggtttacatcttttgctaaccaaataggaatatatattaatgtacttcaactggctattttttttattattggaatagacatttctcattgatgtttatattattttatatatattacaattttatgactgaattgtatacccaaacatcccgcatcaacgcgtgaggtgtcaactagttatacatatgtcagggatctctacagtttactctgcggctcttcctttagtctcagatccgctgctcccgacatgagctgcgacccgctacatcgcaccactcgtacggtttccaccggcatccaccacacaccacaatatggtttgctgaccgaaagctgcaaacaatgtactcccatcagccagctttgtgcgcatgatgcctcaccatggccggcactcacaccgggtaaggatggtgctcagagtcagagatacttggcaactcacactctcgagtaaccacggcagctgccacagcgagacacattagaatgtcagcactactagtcactatggatgtaatgaaaaccttcgaattatttttcttgttcggtccacttcttttctgatgcttcctactcccatcacatcacaatgcaagacaacttgaagaaactagattctcttatatatctacctctcccattgtcttgttgattgttgctcgcctgctaattgctcctagttgcaacgacgagagcccatatgtattgtagtgaagaaagatgtatatatatacccaaatctggagggatgtatgaaagagttggacaagctagttattgaagatgatacaaactgttatgtcctggatggttggtaggcaatttttttctgtcgtctgcctccagaagtattttaaaatttaaatagcaattactatcaccttttgtttggaattagtatttaaatttggacatgtcaagacatatgccataatttattttgccttttgtcccatataactatgagatgaagatttccgagaaaacaaataggggcaccggcctagtactacgaaagtaactaaagggctcgatgcttgaaaaattaatagtatatattcatagttctataaaacaaaaaagagtgtaagtagataatatcaagattctatatgcatttctacgactgtctttgataaacaatgtggtcctaataacttatcgatgagacaactccattgatatgtacgtagtacaaataaaatatgttttccttagcatgtatgccacgtcatgtagctaggtagatggaaggagtactcaatatcctaaataattattgttcctcaagagtatggagtttctaaacagcccatcatgaccttctgtcactacaatcctataggtgccggttgggaactggctataagtgccagtttcccagctggcatctttgccttaatcttattggtgtctgctttaaaaccagcatctatactattaaaaa

SEQ ID NO: 19588 - DNA, 1697 bp, Oryza sativa
  unsure (1)..(1697): unsure at all n locations
tcaaacatttttaaaaaagtcaacggcgtcaaacattttgggatagagggagtatattgcaagaatgctttcaaaataagtttgcatggattttgcaggggagccaaatgtgcatcccgttaaatcaagggcagaatcgaaaggtatccatcccaaaggttcagcagcaggtgttctatttcacatcctactcagtaaattagtggtcacttctttcctgatgcctcatactcccacacatcctactctgatgcaacatatacagcttcaatctctatttgcttttccattatcatgttagttttatttcgcttgctagtcgctacaaaatgcgctatatatatatgcaccagaaactgcaatgtctctgacggctaaaaactgtcaggaaaaagcaaaataccgtcaggaaaataggtccttacgtgtcatcgtcaggaaaataccgtcacaactagcttgtcggggaaaaattaatttgcctgacgtgtgtccgtcaaggaaattattcctgacgtgaatgcacgtcagggttaattttcctgatgtgaatttcacagtcagtgatatttcccatatcactgataggtttgaccgtcaaagatatttttctaatttttctgacaggtacaaccgtcaggaaaattggtcatccgctattgtgataatttaccatatacagggatgatccatatatatacattatctaatagcaaaaatggtcattatgatattcatcacagataacatataaacagctcaaattccatatttcattcagaaaatagaaagatcaagtccatcatagaatagttctagttcactatttcaacataacacacaagttgaacaactagagtttgcatggcctaagacacctaatagcacgtactttcaaagtctcacactccatctatatggttagaaccatatagacaaaatatccaaaagcattagtatgccgcaactccacattggtatatcaaaaaccttagcccatcttgcatgacatgtgctgtagcagcatcaaggagaagcattcaaacaaccgatacaattgttggtcgatgttgttactgccaccattgcttgaagcaatatcacatccatcattgttgtggtagccattgcagtcaacttgctgtgagcctaaatgggaggaatcagttccctgtagcagtttgaaaagtttatgattaattattccaattctaactagtaataaaaatgcatgcccatgcagcaactaaaatagcaataatggtcatccaacccctgcagcaagttggactaattgtaactatctaaactatttccattttaagcaagattcatatcatgacaaaaagttctattttctactactgactctaagattacacataacagaaaaatacagctaatataaatcaatcactaattcacaatgattattacatgatgtcaacaaattattcattgcaatcacaaatttgcacgcatgattaatgtagcgcccattctgtcgtggcgcctagcgggaaaactatctcttaaaaactctatttgcgaaatccgtttctttgcttgttgtctagtgtccgtgccatctcagatctcaaatccccgatctatcgtcaagttccctccccaatccaaatccttnnnnnnnnnnnnnnnnnnnnnnnnnnnnnnnnnnnnnnnnnnnnnnnnnnnnn

SEQ ID NO: 19589 - DNA, 1857 bp, Oryza sativa
catctccccctccctccccggctccctctctctctctctctctctccccgctctgcccgtgagccgcgtcgagctctccttctccactctcgcggccgttcccgccgatgccgcccaaatcgccgcgccgcccgcgcgcgcgcgcgccgtggtggccgaccggccagtcgccgccgccgtcagcgcctgccgcgccttgccccgcgtctgccgcccgtgtcgccgctccactccaaaccgccccgccgtcatcgccgtcgtcatcgactcggccccgcctctccccgcgcatgcctccaagggacggaggcagagctccccccctcttccgcgtcgccctctctccctcctccttttccccaaagcggcaaggaggcaagccctctttctctccccctttttcccttttcccttccgccggcgtcatcctccccccctcctgtcgccgttttggccgcgagcgccgagcgccagctcgctcccttgacgcccaaggtcggtttccaaaccgacatcgccgccctataaacccaagcgcctcccttcctctttcccctcccaatcttccccgtttcttgctcgcgccattgctgtctctcccgccggccaccgctgtcgcgtgtgccggaggagccgtgcgcgttaggacgcggaaggggactccgggcgcttgccttcttcctcttccccggcccgaggccggagagatcactcccgtgccgtcggcctcttgtcacagcgccccgcctcatctcggtagtgcttttccccgttctccctcctcgatccatctcctccccttagttttcagtagtagcatgtgtagccttcccgtagctagctggcgccgccccgaccgttgccgccgctcgctgtgtgctcgccgccgtcgccgcccgtgctccgtagcgcccgctcgtcgccggcctcgctcggcgtagctccgcccaatccgacgctagcaacggattcccgtagccgcgtagatgcactcaccgccgggaatcggcccctcgtgacctcatcgccgtttcccccttccctcgccgccggttgccgccgccgcaatccgccgccgtcgagctccctccggcgaatccgagccgttggctcgtctgccctcgtcctgtgcaacatcccggtgtgctcgccttcgcctgtatcgccatggatcgctccgccgctcgccgccgtcgtccgccgtccgttccggccggagtcgttgtctacctcccgccgggccgcgtggcagccacgtaggcgccacgtcggcgccacctcggccgcgactggattggctgacccggccagccgctccctccgttttccccctatgcgcatggtccgcggtgagccgtgaggctgcgcgtgggcccgccgcaccgcgtcctccgcgaaccgcgcgcatgcgccgcgcctccctccccaaaccctagcacgccccgcgtgcacctcgctcatggtgagccgagtcgccgacaagcgggtcccacccgggaccacgcgggatggacccggcccaccggctctctctcctccccgcccgcatgagcgccttgggccgccttcttgggccggccggcccattaagctcggccgagccgccccattctctcgggccgcgccctagccgcccgagggaagtctaatttccctccctccttcttttcttttcttttctttttcaaaaaggatttaaataaatccttttcctttagaccaaaaatccagtaatcttagaaattcaatatcttcccaaccgtaagtccgtttgactccgttcaacttccaaaattcctcaaatctcgagatctatctaatggcacgcttagaggtcaagggtaccgagctcgaatt

SEQ ID NO: 19590 - DNA, 6478 bp, Oryza sativa
  unsure (1)..(6478): unsure at all n locations
nnnnnnnnnnnnnnnnnnnnnnnnnnnnnnnnnnnnnnnnnnnnnnnnnnnnnnnaatatcttcccaaccgtaagttcgtttgactccgttcaacttccaaaattcctcaaatctcgagatctatctaatggcacgcttagaggtcaataatagggctttattctcgccgtttgctgagttgtcccgtttcgcgtgtagtttcggagcccgaagaccagcagtgcgaggatttcgaggatcaagctcaagatctcgagcgaggcaagccacctttgaacatcttgagcctatatttgaacttaattatgttgcttgaaaaatattatgcattgataggatcgcacttagtctgcttgtcccgtctgcaaggcagattggcagacctacctaacttgttgcatttgacccttccattgtaattgttataccatgttcccttgtacccacctagttgcgcctcggtaatcgtgcactctgcactggtatcgacggtcgccctcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacagtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtagccgttctgcacgggctggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttgaaaaatctgcggctgatgggatcagccaggcccgggtggccgtttgaaagctgttggccgggtgccaatcttgatcaattcaaaagactgatacattgcacatactccgaccggacgagacgcactgtctcatccgtgttgtttgagaagcactcccttagttgtttcagaaaagagtttaaataaaatcaatcgaaaaaaaaatagcagcctttccttgaagcctgcattaaacacttatttcccatggcttgctgagtactcctgtactcacccttgctctatataaataatcccccctagttgctgaagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttcctgtgatactagcactgtttcctgggactggtatcgattaacaggttaatttggagcgtcacgggctagttccggtcgggactagttcggggcgtgacaattaacatatgtatatggcaatagtggttatatcatactttaagagaaaatcacattaacaggatatttatgagaaacttagaatgcttaagtaaatagctacacatactgatggatctgttcaactaacaaccatagtttaaaggtattcggcatatgttgcaaggcatctgtataaagcttaccaatagaactctaattggaaaaataaaccaacgggtaacagatccagagaaacatcaccccagaccgaaggaaaattactataagagcagaaagcatgctcatagcacaccaattatattgctcacagaacagaattcatgtgaatgctatcattatgttgcttgtaatacaatggtggatagtaaaatcatcaataatttagtttaccaaagatctattaaggaccgcaagaggtggacacaaaaaaagcttacgatactttggctgaaccctttctaatcctgtaatttaaggtgtacctgacattaaaaatgcagcaactttcagtcatataaatggtgaaaataattaagctgtagttccactcttaattactgaaatactaaaattatatgttaaaatacttcagttgcttcaattagtagctgtggtatgagacaatacacattaatagtggccggctctcttgtaagcattctatcgtcatagtatacaagcttattacattttctcatactattatagtagtgtgagatgcagttatgcttggagctagctaccatcaatttaacgacaaaggtcccaagtatgtaaatcctcttctagtagaacatatgctgtggccattgcttcccatgtggccatccttagctgcatcgagccctctaacaattgtagacaaacctaagtttaggaaaaagaaattcgctaaaacaattctctgcataccatgaaaatatgattggcttcagatgtagcaaatctgccatcataattttctagagatgatattagcccatatctacatatctgaaagagctaaagaacaaaaatatggccggagcaaagaacagctcaggaagagacatgtctcgtacggcagaagcaactatgatggcatagaaaaaaaggtctgttcaagtacaaaattttagcccatttgaaagtctacatgtactacttttgttgctacccttcacacaaaagatatgctgctgatagaatgtaaaaagaaactatgcccatttccttgtttccaacacaatcttctagaaaacatagcaatataaaatgggggcaccaggagtagggagaaaaagaaagtatgtttacctcacattagtattccttagcctttcacccatcctttgctggtgtcatccactaatccctatgcatgtctgtagtaacagcaacattttttttgtgaaagctaccattgtttatcacttactgcaaataatagtggaaataattcatcttacctcgtataagcaggcagcatcctgttctcttgaaacaaaaagcatctactggcagaaaaaactgggggtttgttcagctagcataaaaaattgggggctctgtgggtatatccttgagcaggaaaacttaccagtagatctagggtgcatccactgaaaatcgaaaaggaaaatcaagaacagtgaagaatgttgtggattcatagaaaaagaacagtacaagagagaaacttaccctaataatgaagtaattggggattttgatgcagtagcttcaacctcgaacagggatttggttgctggagttgccggagctggtggaggctgcaactttggatctggactgagagatctggatagagaggcaggggagatagttagtgggcgcggtggagggcacgatgatgccggagatagggtgggagggtgaccggagattctagtggagagaatccatggtggttgatttgggggattaatggtggtgaatctgggggaaggaggcagtggaaagggggtgaggagaaagaagaggggtctgctggcagctgaatgggtatctgtcctcagctcctcagtcctcactagtcttgagcctgaccggtcaaagcacaccacaattattctcgcgcgctcgtcccgaaatttttttggcgcggcagcaaaattattggcgcggtccctggaagcctcgcgggaagcctcgcgggaacccaaacttttcttctgacggacaaaccacgtcagcgaaattcatttatcatgacggttccgataaacacgtcagggaaatagaatatttctgacagttttacaccacgtcaggaaaattcgtctagtcctgacggctgaataaaatcacgtcactaaaatattagcccgtcagagctagttgagtttctggtagtgcggtgaggaaagagttgaactggtatatgtgttattgaagatgtgacttcctgctatgtaccacaaggttgctaggtgtttttttctgccattaccctcggagaaaatattttatttccaaacggtaattactaccatattttcgtggtagtcttttcatttattcatgtaattaattaggacaataatgcaggtgcaactgccttaatttgtcccatatatcgaataaaggttcccaaaaatggcatctggtaatatcaccactaattttctaatactgaaattgaaggctcgacacttggctcgatgcttggattcaacgttatatataaatataaggccatttccaacccaataactaggatagtgtctatagcattaaataagctgtcacataggatgaaaactgatgtggcaagtgaataaatgaggaaagagaagaaaactatgtcttacatgagacatggtttctacacaacatccaagacattatgtgagataagtagcattaaatttaagtatgaaatagtagtgtttgcattggaagagtagtgtctaatactagtttcttgataatgtggagtttatggaaactatgtctagtgttttgggttgggaatggcctaagctcgctatacattggtaaaactctgtctctgatgaacaatatatggccctcataacaagtacttccgggggagcgcgtatgtgatctaactaaacaggtatataatagtccacgggaactggtgactttccaggaaaacttaaaaggaaaaactaagaaatatactccctccctccgtattttaatgtatgacgccgttgactttttaatcaacgtttgaccattcgtcttattcaatatttttttaaaatataaaaatatttatatcatgcttaaaagacatttgatgataaatagggtcaccgatgaaataaatggtaataacctaaatgttttgaataagactaatgggcaaacgttaattaagaggttaaccggcgtctacattaaaatacaatacagagggagtatttcccttagggcacacgatagctagacttggatggaatcaaagttcccaacatgctgccagatgttaatgtggaggatgtacatatataagtacatttaaagtagccatatcacgatggaccttctgttataaggagatcttttggatataagttctcgacaaaaaaaaaaaattattcagcctagcccgtcggctagcatggttactgttttcgtgatgcatctcattcgtatcacacgcatagagatttttctggttttatcgcaccgtagtctggcctccatccttcctgttgtgaaatgctacaaaatattctatgatgtgtagcatcacaaacaataaaaaagatgttccttttttacaagttagctatataataggagtaaattaattaaatgtttagagatgggggtgatatatataagggccggaggatgagagaatgcattgctttttcaacaccctccgtatctcagatagcaaaatacatggttggtccttaaatatctaccagagtatcatttagatccataaacttataaagtacacatctatatctataattttggttgatgtatcacccaaggtctcaagaaaacattttttagataatggaggatttatttaaactcagttaattacatcaagatggtacaatcacactgagtcacccccggtctctgcataaaatgacacaaccaaaaaaagaaagaaacaactaggaatatctcccaagcataaaagtttgacagaaacatcttagtgcctatcaatccatagactagaccaaaacccatgttcctaggtaaaaaaaactcctgcgccacctggtccaactgtcgtgataccaccacaatagtatctcgtgtcccggtttatggaggatagcccagatacgtagccatcgggtaactaaagtgataacctgcaaaggagaaaacaccatcttgttatcaaaaattatttcattcttgcttagccaaatggaccaacacaaagttatcgcgcccatcaaaagcagattcctcatgtctttaggatacatgatagccaactcccaaacatatgactaacattgcgaggatgttttaaattataagctagatgaattacaaactacacctagcaagataagcgacactgaaagaataaatgttggctggtttcatccttgtgacaaaaacaacatgtcttactacctttccaatttctcttagtaaggttgtccttggtgagcaattacgcctagcgttgataccaaaggaagattttttactttcaccttccaaatgcgtctattgatattcggaaccccggtatgtg

SEQ ID NO: 19591 - DNA, 7158 bp, Oryza sativa
  unsure (1)..(7158): unsure at all n locations
nnnnnnnnnnnnnnnnnnnnnnnnnnnnnnnnnnnnnnnnnnnnnnnnnnnnncagattcctcatgtctttaggatacatgatagccaactcccaaacatatgactaacattgcgaggatgttttaaattataagctagatgaattacaaactacacctagcaagataagcgacactgaaagaataaatgttggctggtttcatccttgtgacaaaaacaacatgtcttactacctttccaatttctcttagtaaggttgtccttggtgagcaattacgcctagcgttgataccaaaggaagattttttactttcaccttccaaatgcgtctattgatattcggaaccccggtatgtgttagagctagataatgagatttaaccgagaagaccccattcggggtgaggttccagtgaaactcatcttgctcatgtaccagaaccaaatcagctatgtgaggcaatatgttataccaagcagctagtttttcaccaattaaatttagcatttagccaacttagaaatccaccatggcaacaaatttgcgtttagctccttgactacagatttgtccccaaccctagtcctctctactctatatcttaccgtctttctaaccgggacgggttggggaggggggagggctagaggggcaaaattttgctctttatttgaagaaaaaaaatacaagagtctcgctaggtaataacaaataaattacaaccacaattttcgtgtgatatatagctacatatattatatctattttttgttccaaattgccgatggataaaagttggatgtatggaagtgatcgagtgagcccagagtttagaaggggcattgtcggtttcataaatgttgtagagcaagacaagaacataaggaacaatcaatgcatgacttgtccatgctttgattgtaagaatgagaagatgtttaccagcaccgtatgaggacaagcatgacgcatatctgatctgtcgaggattcatgaagggttacacatgttggacaaagcacgaagagcaataggcactgaataatggaaggcaatgaagcgagcagccttgtgaacgaggaaggacacgaagatatgcttgtcgcttccccattgggtggtgatcaggtggatgtcgataatgataccgatgacacctctgcgacgggctgaaaaacctatcggtgaacggtgagagttggggcccgacaagtatatctctatcatcggtcgtgacggctactcgccagacacaaatgagattttcacattagtgaccaataatcagtgatcacacactttgtggttaatgatgagggttgtgacccgttacggatgactggctccgtagtagtgtgaggtgtgttgcctgccttcacagtgatgatggcaccgcggcagattcatgggatcaccttctccttatcatactgcatgcatgtatccctatggggatctctgactaccgatgatcgatcactgccgtcctaatcatcatgatgggttaaaagcaaaatgtttgccaccatgtacagccacattagagcaggtacaataggaggctataagccatctgcaaacatattttaagtagataaatgaggagagagaatagcagcgggctatagatttgtagccaactgtaacacggactccaagacgcaatgtgtgtatgataggtgggatcatgtattaatagtgtagtatgtaactatatattatatgaataagctattagattagctatagatgaattgcagctagtagttggctatactattaaacttgctcttactgatccagacccatcaaatgtgttttggacctagggatttctgctactgccaaggtctcaaaacatctcccagccagtggtcttattcttgtgcacgtagaaattcatgtggaacgcgatagttctgctagctggaacaaagtgttgagattatagacatataatgatttaatctattccataaataaatcatgacattacagatgaaaactagcatgaacgcatcattagatctacacatgtaaactacatagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtagaaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcatgcacgcgcgccgcctgccaggcgaggcgagcgagcgcgcgcgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtggggtaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatatatattgatactctcctctagtttactaatggtttgttcttcccaggatctaattcacgggatctccgatcacatagactgggttaccaccatagtataactcacatgggtctcaaacccatctccttcgatgcattgtttatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccagggttgacctcgtcaaaatggtctgtttgcaagacctccatgaaacagcaccaccacccagtgtgaaaacagatccactagtggctttgatctcatccacatcagagatccagttagaatcactataaccctccagtaccgcaggatacccagtatagtgaagccccaattccacagtacctttcagatagcgcattactcactcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaccgagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaccaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctccgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtatatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcaaagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagacttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcgaaacaggcctccgcactcataacctttaccaataaaatatccatgtttagacacgactactttattagactcaaaaaccaacttaaatccgtctctaatcagacgggagtcactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccaatgttgccaatggtcacatcagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacg

SEQ ID NO: 19592 - DNA, 6635 bp, Oryza sativa
accatgcaattgatgtgcatgctagtatgccccccatattccggatgcctactattcatatcactcccttgaatcgtaacaaaattatggagttcttgcctcctctattatagttcctatctcaatcttctatctatctatctatctattatatactaaaaatccattaaacttcctacagacgctccctaagccgccacgtggcaattctataaacgctcataagtcgccatgtggcgttttaatatattagaaacatctgaccctcaattttcatttaaattggtgggtccataattttgcaccattagattagattaaaaatagaccctcatacgtatgcctccctcaccgcctgcaagtacgtacgtacaagtacgaacgtaacataccccccagacttttttccttttcttatacaccttcttttattattttgctttacctaatatacctccataatattattggtgtttgaacatatgtttatttactaaagaaatatgtaattatcatttattttgttatactctgtccattaaatttcctacaaacgctctcacgtcaccatgtgtcactctacaaacgcttctacgttgctaagtagcgctataataaattaaagaaaatcatataaattcttagagaaaataaaacatttaatcctcgattttcacttaaagctaagagaccattattttagacaattaaattattagatctataaaaaataatctctccctcctaatatcccgtttaaattattaaatctataaaaaataatctctcactcccaatatcctattcacatacaagagaaaatccttgcatacaattcatccgggaaaaaaaaggcaaaagctatacggatgtacgaacgaaataaaaaccaaagatattgataactatgattgaaaaaaaatcactgccaagattaattataaaagcaccagcctaaacgatcagccaagataatcaccatcagctcacggctccagcacgtatatgcattatctgctcttcttatttttaggttgttgagatatcttaggcataataaaatctaaacaacatttgatttatatcttcgattgaatgtagactttcatggttatcacggtcagtgtcatcttcgtggagggctccatgcatgtattaacttttggtcagtttagttctttacattcttgacaattaaatcaataatttaaatctatatattgatgttttattatcaaattaaaaaatagtgtgagccatatatatgccttcaccctttgcattttctatgatatagagataaaatatattactctacgaactttaaattaggtcagtgtcatctgcgtggagggctccatgcatgttttaacttttgaaaactataagttggttttatgattaatttagttctttatattcttgacaattaaatcaataatttaaatctatatattgatgttttattataaattaaaaaatagtgtgagccataccatcaccctttgcattttctatgatataaagctaaaatatattactctacaaactttaaattagtgaacccgttattttatactgttaaattaggtctattgaaaaaacaacccccccccccccaaaaaaaaaacaaaatctcccatgtaagaaaaagcaaagtaacatatatacacatgtaaaaatatatagctaaaaatatacatacatactatgatcagagaaaatcaatggtttctaaactatgattttccatgatataaaaaatattacccaaccaatatacgcagttaaactagatcaaagatgtaatatgaattcaatggtctgtaagtgttcatctattaaatatatatcaatttcaataattctgatgtattcctttaattaaatgaactattattgacctatagtagttagtgctaactgataaatacataatggcacataataattaatgtcataataatttttcaaataattatggtgtacaatatcacctgacaaataatttgaatctacatatgtaaaaatgaaaaatgaaaacaacagaatttagttatatttttttcaagtagatcttatctaattttaatatgtgagatattacgattttcaaatattttttttgaatttttcaaaactatttgattggtatttgaaaagtgagaagcacacatgatacatagacatgataaactttattaaaaatacttctagcgagtgatatggctatactacaaccccttaatccatcatgagaactatggtcatatatgtaggttttttgtttgtcatatagttttggcaacaagtaaacaatccagtaacacccataatatattttcttatacttcaggaattccgatgtgtcgggcatagttgatggatgtatgtcatacactctactaacatgataacctcactcactttcaaataagaatattgtatatgtattattgaaatttgagtaatattgatttacactataaacaaattgtgtctactatataccacaaaacaactcaaactttaaaaaggattattgtaatcacctccgtcttctctttttccattctcaaaagggtgccaagcatagataataaagcttgctatactaccatgatatagcaaaggcatacatttggatgagttaagccaccatgggtacttaacgatgcaatcctttatgagggtactaatagtgaattagccgttaaaactgttctccacgatggtcttgatgggcacgactatgtcgatatgtgacccatgtttcaaggtatcgaggaagaaagccttggtagttatgttcggcttcatccgttagatgggtattcatatcaaattttaacagtattatcctattaactcatagaagtgatattgttataatatatttttttgataaaatattattggaatatttatacatagatttggaaataagtcagatcgacatgaacagttaggttagtagtggagataatttttttagtcgattaacgatgtattgttcttattttgatgttacaaatacaatttcatctattaaataatcactcaggtttcaaaagaacgataataagtatccataataaaataaaataataataataataagtagtggcgatattaggcaaatttatatataaccgggacatagtgatttatgtttgaatctaggaaacgcttttgatataaacattaaacaaaatgcccgcacatctgcgcgggcttctttcctagttatttttaattccttctatgggctttcctagtttgcttctaccaatacaatctgatgagtgacatttattctctcttttttacatgtagttttcattggtccaaagatgagctgatgcatatatataaggataaagaagaatctacaataatctttgtccaattcattttcataggcgggagccaatcgccagaaaataaaaggtgtggtgccatgaaaaaacattttttttagtactgactaaaatattaaatagcagaaaaaaaagatttgtcacaacgagatgtatgcaataaatttactgttactcagaaatcttttgttctatgcaaaaacatgtctaggggatgtctgaagaatcttcattccacttgaccttgtttagacactggtgcctgccaacccactaaaatataggtggaacggggcagtaaaaaatgtaaaattcattgttgacgagagtgaaggtgattaatgtcgtgtgatgtaaatgttgataattcgaacaaaacatgtctatgaagtgcaaaactgaaggatcctcgagaactatgtggtttctcccacaaaaatagtaaaagtgaaccatgaagttgcatctttcatggcagataggctttatttagcttgtgatttactacatgatttagctcctattcattcttgtatatattagttaattcatctgtgcttgcaccataactctgctaagcttttgtttttgttttgttgtctgcatctttctgtactatctcaataaagcaaatgaaatctttagcatttcaaaaattccagcagaacataagttttatcctcttggattcatggacgtttttgcacaatgttggaggcatgccacgaggaccttcaaccgaacctgccgaaaccgcctaaccaatgaggaaccaagccaagaccatcaggttcgactaaggcgaagccatatgtcgaaagccatgtggcgaagcacgcaagcaaaaggccaaagacctaaatccaagctttgcaatcaagagaactacgcaggcgaaggttatatgggcgaatggcatgtgacgaagcacgaaggctccgcctggactaggatccatgcgaaggagaggaccagagggccctccagcccagggaagccccttccgtcataaccaggcagaccaagttggcccatctagagcccaaaagtgtaaaggacactgtgtgccctcactaatgtccctttcacaagggtatccatgtaaatttccctgtacaacctaaaccctaggaggtgtaagcctctggtctaggattataaatagcccccttggaccatgtaatgaggggatcctcaaaaatttttatcaagttaatatattgttttactattcaaaacatccaaccaatttccatgttcttcgacgtgacgcggttgtcattcgacaacacacaacatgatttgatgttaacatagccttgaaatctgtcgttaacaaacctactatcaattaataacaatacaaatctccttcacattcgcaaaagtatgcacaactactttgagatttgtgattggtcaaagaaacttctctcaaaatttctcattgtctgtggtcttgtgcatgtaagagttcatgtggagcttcatcctcgacaacttttctagacttcacgagactttgtgacatacaggccagacatcttagaatgtctgccagcaagatcttttgcgtcttatcaagaccatgcttgtagaagctttcctgatgcctcttattcatatcacactatcaagtcataacaaaactctggaattcttgcctcctctattatagtctcaactgtctttccttaagttatgtggtttagcttcgtagattgcttctaccaatactatctattgagttgtgaggaagagtaaagagtggcatttattctatctttttaaacagtgaagaactactcattgtcattgggcaaaagactgggtgatgtatatataaggataaaacatccattatttatttgcagtctgtgcattaattgtacgacacttagggaataaggatcagggtttaattttttggtttggccgattctatcggaggtcaaatttaaataaaatattaccaaattcaaaaaaaaaaaataaaaatttcagctaaaataatatcgtaccgggggttggggtccgaaatgaccaaaaatttcgttccggaattttgaaccctgctaaggacaaatggactgagcagaacaaacaagatttttcacaaggaacatccctttggaacattgttttcacgatatgcaaaaacagcaaaaaaaaaaagagaattaaatcacttgcgccaatgaatatgattgataccaggcaatgcagtagacctatttattactgcatactactattcattatttttcttggttcactgcaaatgtaaagcccgaacgaatgtttgggctttccaacactaagaactcatacacgcacgtgactttcactggcatggctatccattaccctctggcacatgaggttaacttaacaaactatatattccctccggttataaaatttttgacgtttcgaacatgatctcacatatcaagaagtaatttattagagtgtttatccatattttgtccatattaaagatgatcctgtgctaattgtaattacatctctatgtatatatctagtgcgttcgattccctattgttgagacattttttaattgcatgcattcagggtcaaccagtccaagattacatgctgaacaaaaatgtcaacaattagcattctctggttccaagcctgaaacgtcaataatattggtgcctgagggagtaaattacttagcagctggttccaagcctatataacatcaatagttttagtaccggaaggagtaattacttagtaattagcagcggtgttttcagtctgtatgtggtcagataggagccataatcagatagaatttttcaaggagttgattcttgcatagtggcaccactgccagacaaatttgcgaatgtgtaatacaaatttggtgttgtagtggttgaaaatagagtttttgcaatacacatactcaatgtagtaatatttgtctgggctctaaaagttttttagctctgccagtgcctgtatatgcggttttttgcacgtagaagtgcttgtggagctaagatagctctgctggattgtgccacctggaatgtttgccaataaccaatttttgccctttgtgatcaaaaaatatgtggtagtcatagttgctttctagaacttgactggtacgctagtacagccaccattttcctgatgcctccaattcataccacactctcgagacatagccaggctgtctggaattcttgtatcctctatagcaaaattcgagct

SEQ ID NO: 19593 - DNA, 5930 bp, Oryza sativa
  unsure (1)..(5930): unsure at all n locations
nnnnnnnnnnnnnnnnnnnnnnnnnnnnnnnnnnnnnnnnnnnnnnnnnnnnnnnnnnnnnnnnnagttttagtaccggaaggagtaattacttagtaattagcagcggtgttttcagtctgtatgtggtcagataggagccataatcagatagaatttttcaaggagttgattcttgcatagtggcaccactgccagacaaatttgcgaatgtgtaatacaaatttggtgttgtagtggttgaaaatagagtttttgcaatacacatactcaatgtagtaatatttgtctgggctctaaaagttttttagctctgccagtgcctgtatatgcggttttttgcacgtagaagtgcttgtggagctaagatagctctgctggattgtgccacctggaatgtttgccaataaccaatttttgccctttgtgatcaaaaaatatgtggtagtcatagttgctttctagaacttgactggtacgctagtacagccaccattttcctgatgcctccaattcataccacactctcgagacatagccaggctgtctggaattcttgtatcctctatagcaaaattcgagctcgatttctatattaaaattcccagatcaatttattcatgtgtgggtgcctactttgtttctaccactacagtactatcagttctattgtgatgaagagtaggagtgacattctctttttctttacttgcaaaataagtatctcgaggtacctaaattttacactattttttctacctcgagatagtatttgaaggtaccaattttacagtagaaaatctctcagtactttctcaagaatgggtaatactcattggtcaaaagatgcggtgataaatatataaggatgtttatttacaatctctgcatcgtgcccatacttctcaacgcaaggaacataaatagtttcaataaatgaaagaaaatatataattattagacagcaggacagacaaggtggtgaataagtgtgaaaatcattgatgctgagagtggaaggtgagtattgttatgtaaatgttaataattcaaacaaaatctgtttgcaaagtgcaaaactgatggatgctgaagaccaagcagagcttctgctctccaactctccgttcctgaagaaggaaacatgcaagaactttgtagttcctccctcagaaatagtagaagtgaaacttgtagttacatctttcatggcagataggctttctttagcttgtgatatactaccagatgattcatatgcgcttcatgcatctcaactcaactcagctgcgcatttgctttccttattattatgttgtctctgaatctttctgtattacctgaatagagcaatgcaaatcgtcagcatttctaaagttcaaggagaacacaagttttattttatcctcttgaacaagggtgtagggatgtttttgcacaacacgaattaataataacataagctagcttgaaatctgtagtcaacagacctcctaattaattaaaacacaggcttccgtcacacaatcacaacagtgtgcagaacaacaatcaaatttgtgctgggccaaagaatcattgagatttgtgcaactgcctatcattgagtcattggcagtggtcttgtggtgcccatagaagttcatgcagagctcgatcctttgtgacgtacaggccataccacctagaatttcttcctacaagaaatgttccatcttgtcaccgagctagtggttgtgttcgtaggtgatttcatagaacatgaattgtatgctagtacagccaccattttcctaatgcctctcattcatatcagatatgacacacttgaatcataacggaactctttcggaattattataacggaactcctctattataatccccacgcagctccatcgtttttccttgtgtggtttttgctagtttacttctaccaatactggtatattgtgatgagagtaagagtggcattcattgtctctcgcttttaccagtaaagtacagctcattggtccaaagatgggttgatcacttgctgtgatattaattgtgcttaaaaataaggacaaaggactgaacaaacaagatttgtcacaactcacaagaaaggaaagacgaaggaacatccctttggaacattgttttccatgatgtgcgaaaaaggaaacaaaaaactacatcgtttgcacaattaagatgatcgataccaggcagtgcaagagacctattaattattacaaattattcactacaaaacctgaacaagctttgggtggttttccaacatatatagaactcatacaagcacaaggcatcatgtgcacaggaccccatggacatactctgccaccatcctagtgatccatgacccttggcaaatgaggttacctcaaccaactaattacttggctacgggtgttccaatatgcacgtggtcacaaggtaaccatgcttagatggaagtacctaaggagttcgtctgccactgcccggcaaccccaggaagtgtcccaggcttgtcctagaatgtgtaatagaaatttggttttacgcagtgattgaaagtaaacacggaatatccttagatgtgactacgaaattagggataggcgtaactccgtattatgatcttctacaaaccacttttcatttcaagcataccaacaccacaaggtgggttttaacatggcttcacaggcccattttctccagttttgatagtacaatagtgtaaataggactatcaatacctaacctaaaacggtatgtataccatggaggacttatcagtttggcatgcaaaaccgagggccgccgagcctcatgagcccggatcctctgcagccgggcctcgagaacctctcttattcgtcacgatcatcctaatcgtagcaggaagctcttggctgtcctcattgtctcgaccggcctccgccctccctcactaacgccgatggtgttcttcggcttcttttccaagacgctggccgaagaagttgaagaggatgccatcaatgtccttggctgaattgtttcgtgaatttgacaaatcttgtttgggtttgtcctggtgaaattgtatttgaatttctgaattggaggatattttgatcttggttttcattcttttttagggcatttttttcaagcagtcgacttaatagtgtcacctgcaaaaatcaattttcataagcggggttcttagggtggccgcctaagaaaatcaaatgaatgtcttgtagatttttggagtgtgtagtttgatcgtaggtgaagtttgggccgccttcgaaaacatgttttggtcacctacaataacgtattccggagtagtgtcatagaaccacacacaagaacaagatttcatgaatacatcatttttgtatctgtctctaggatctagatcctctatttaaggatcacttttcctttttatagataaatgtagctttaatgaactcaaccaattacatcaagataatgcaatcatactgagaacatatagtaagatgcatataaccaaacacacgcagtctcaactttatataaaaaaggagtgcaagaagtattatagaccatcaatcctaagactgcaatgccagccatgtccctagcgaggtaaaatactctttcaccaccaactccgagcgtacacatgccgcaacaaccaaatcatgcgaaacaggcttttgtagcacaacccaaatacacagctaatggatagttgagaaaatatcctgcaaagaagaggaaacaaattttctatcaaaaaccacatcattcttgcataaccatgtcaaccaacaagtagcaaccactcctaaaagaccatatcttctgaaatccttgtgaacatttcaaagccacctagtaacacatatgcgaaacactatgggggtggagggattgctagctcgacatgtataatataacaaacgaaatgggctaaatggcattcaaataataaatgtcttattgtctcattattctgacaaaaataacaattttgtttaccatgttagttatgtttagctagattatcctagttaaaacaactccctgtcgtaaatatcaaaggaaaatctttactttaagatatacttttaaattccagagacatatatttaaattaggcacatcactatggagtagtgctagacaatagtatttcatcgtgaactccccattagtagtcgagctccatttaaaattatcttgcccctgttttagttatacagtagcaaggagtcataataaactattctaggccactaatttcaaaccaattatgttccttctccatgaaaaaattggagggtcacttttcctgcaacatgtaaaaaatactatatcgaattaatgtaatactttgatctaagtggttcattccagatctaacggttaaaaatgccagaaaatgcacaatactatttatctttgccatagcaatcagggaaagacccttcttatattgaacactctttactttgggtacctcaactacgacgtaagggctatctatattggacactcttattggtttctactctagcctaagcattgacattgctgatgattggatagtggggaatgttagaccgtattgttgttaaagagattcaaggatatgactgatcttgtatcacattccttctttttcatctctatcttctactctatataaaccacataccatgtcttgacatatacatcattcatcatttgtagtacatctcttccctctcgtacaagtgttcaacgttgagttcagttgtttttccagtgccattgctgcacatctccaaccatggatggcctgctagcaatatagtagtgttagattgcctggaatggctgttgcagtcagttaaagaagaagagggggaaggactgaacacacgtagtacttggtgcgctgtgagccgctccttaggatcccggacaaggaccttccgaagcaggtccttggcaccttccgacacatttgtccacggatccgcgtcaaattctagcatgccatgcagcaccttgtcaaataccccctgctttgtatctgtgaaaatacggcggtaacaagcaattttgtgtcatagttcaagatacatgctggaaaccaagtgaaaagtggtgtgtcaatagtgtgtgcctaccagcccagaatggtggtacgccacaaaggaggatgtagatgatgacgccagcgctccacacatcagcttgctgcccataattccctctcaacacctctggtgccacgtaatacatgctcccaaccacgtcagtgaacgtctcgcctgaacgactaacacaatgcagttcttcgatggtgaaggtgtcataactgattgattgatttaacttggccgaagaatatggagaggccaaagtcaatgagtttgagtggcgcatcctcctcgttgctaacgaagaggaagttctcgggcttgaggtcgcgatgcatgacaccgagagagtggcaagactcgatgacagagacgatgatgcgggcaacctcagcagcctgcctctctgtgtaatatcccttgctgatgatgcggtcgaatagctcaccgccagtgcagagctccataacaatgtgcaccgccatggcatcctcgtagctgccccggatggagatgatgtttggatggccagcaaggtggtgcatgatcctgatctcgcggcggatgaactccacgtcgtcatcaatgacgagcttctgctttgcgatcgacttgcacgcatactcctttctggttgccttgtccacgcacaagtatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19594 - DNA, 1397 bp, Oryza sativa
  unsure (1)..(1397): unsure at all n locations
nnnnnnnnnnnnnnnnnnnnnnnnnnnnnnnnnnnnnnnnnnnnnnnnnnnnnnnnncgttcttcgacaaactacaggttgtgccaacacagacgttgcccattagaatggtgctgttgtggtcatgctggtggttaaggttaccctcatcgatgtcctcttaagttttttttttcttgtgatcaagaaactttaaggagttgggtatatgcgtagttgcagttgatttcgtacaacttggctggtagtatagtcatcattttcttaatgccccttgttcacatcacattcttggaacatataactaagctctatggaattattggctactctgttaattaatcctagcaggaaagacttgcatccctttagggatgtcctctcatttttgcatcctatccaaattaacttgtatagaagggctgcgtttgacaaagtaagctagagtgacatactgtgtctatttttagcagtaaagtatccatcgtttgtttgcactctcagcatcatatacttaaaagtaatgacagatggtctaagatatttttcacacattaaatgtacattattaaacagcaggacagacaaagatttgtcacaaggaaggaaagaacaaggacatccaatttgaactttgttttccacgacacatgaaaacagaaactaaaaacaagtgatgacttgcaacaattgggatatggatcctatattcccaaggaaagatgatatatcctaggtagtgcaacatacttatttatagtataatatactattgtctggacctcaacctgtcgttccgtatgtaaatacactgtaaacaagtactatatctagtaatctgcagcagtgacatagctagaaaaatcttaaagcccgggcaaatattactatgttgaatattttctatataatttatattgtcaattcctatcttatataatatcaaatttctacagcatgttcatcgacaagccagccactgatagaatttcgtttgaaaatcctagattccaaacagggcctacatggaccagccagtatgttagtcccagttttggcagttgcaagaagtgtatgcaagaaattttctgttacttggaaaacttatgttccatgtatagacattggttgctgctagaaagcccctacattatcttgaaaaggtaaaaagctataaatttagcacatctattttctattatatttatatactaaaagtcgattaaacctcctacaaacgctcataagacgcatgtggcatcttacaaacgcccctaagacttcccagtatacacctaggaagcctagcaggttaacgcacaagttcttagtgaggtgcannnnnnnnnnnnnnnnnnnnnnnnnnnnnnnnnnnnnnnnnnnnnnnnnnnnnnnnn

SEQ ID NO: 19595 - DNA, 6435 bp, Oryza sativa
  unsure (1)..(6435): unsure at all n locations
atagaatttcgtttgaaaatcctagattccaaacagggcctacatggaccagccagtatgttagtcccagttttggcagttgcaagaagtgtatgcaagaaattttctgttacttggaaaacttatgttccatgtatagacattggttgctgctagaaagcccctacattatcttgaaaaggtaaaaagctataaatttagcacatctattttctattatatttatatactaaaagtcgattaaacctcctacaaacgctcataagacgcatgtggcatcttacaaacgcccctaagacttcccagtatacacctaggaagcctagcaggttaacgcacaagttcttagtgaggtgcatcacgtcgattgcatggcagacctataagacatcccaatagggtaactcctaaaaaatagacttcttcttccacatcgccacatgaccatcttcacttgctataggttggctgccggatcacttttccaaatactattgtcagatctttcaccatagcaaacacgatttttccgttacgatatttaggcttagtatggtggtctgccttatcttcaaaatacgtactgtcagtatcatccatacagtgggtgtaagccttatactccttgtttgattgtcaatcgttaatggttatgaacagcaatactcgtaggttaaattgctcatatttgtcctcattccacacaatgacaactttttttctttcataacagtttcagatcttcaaccaatggttttaagtacacatcaatgtctttactaggttattttgggccttgaataataatcggcatcatgatgtacttccgcttcatgcataactaaggggaaaggttttagatacacatggtcacaggccaagtgcaatgaccgctgcgcatctctccaaatggatgcattctatccgtacttaaacaaaaccttatgtgtcagggttacagataaggcatacctcctatcctacgacttatgaaatatatcgataaggtataccttcgcgcatacggattgttcccgtaaatgtcacgtggaaaccacttcgaattatggaaaatatctctacgagtcaagtgatttccaaagtcctactcggaagggatagattttctgtaataccatactaggtccgatatcgtcaaacctttcttggggatcaagatgatccacggtataaaagggaccccctgggaagggttcaagacatcgaattcaatcgccaacacacccaccaacgcttacgaagccagattatgcggagccaaatcatcgggagatttcgtcgaacccctcgactacgatctcgtcgataccctctatttcgactagtatctttgtcatctgttctcatcataatcaatctcatataaactggactagggctataacctgataaggggcctgaactagtataaactttgtcttttgtctgcttgatgtcgaactacgtagaccctcgttccaacataccccaatactctactcatccggtccgcgagtatcactcgtcgacagtggcgcgccaggtagggggacttggtgctcaaggatctaccggtatgacttcaaggctccccgacaacagttccaacactggcgtcgatcaaggaatccctgcctcgagatcgctggtgtggaatcaagtcggatccatcgtcttttcggtctatatcgtcacaccgatctcgactggcccaaacactatcgggaacgagagaggcatggttacgactccgagaaacgatgccccgccgacaattcctcccactcaagtggagaacggaacatcgacggtcccaacacttgggaaaaatcctcaaatggccgaatttcgtcccttgtacaaaaaccagagctgacaaggaatactacctaaaagctgacatccaagtatattctcgaggattgcccggtgatactccacgtgaaagctgaactctacgcctgctaggagtgtgggattcaacgcacttcaccgacaggagtcacataacgcccaattcacaaatctaggtctcacgaccttacaagttgcaggatctttctcacaactttgagaccaccgcatcatcgtgtccaacaactgcgagttcaaactccatgtgctcccagggacccagatgcgatgacgacatcagatcggttcgtaggatatgtcgaagctaatccgaatgaaccatttgtgctacacctcctggaagactacgagtcctattcggagtcaccacgggatgtaaacgtggttgacaacactgaaacaagcgcgtccacagcagcgagaacactcactcagcagctacgaaccttagatgcgatattgagtgaaagtcctttcgacccggtcacgaaccccgacgtcaaccaatgggctatgcggctgcgagagacaatgactaacctcaatgtcgcatttgccgaagcagctgtcaacccggagcagcatgaggacggaggaccaaccgcaggagatgcaaacggagaaaatcccaacgggacacgtccctccggtgaccactcaccccgaggaagacgagatcctactccaccgcgtcccgcgaaccgcgatcttcgcgatcatttggactatcggcggagggacaggagagatcgcgacaacaaccggtgtcgttctccttcacgccgtggcgataacaccgccgcccaacgacatcgccaccacactcctccgcggcagagaagggacgacagtcgaggaggcgccccaaatgaagatcaggatcgacgggcccacagcggccaccgcaatgacgctaataatgacaaccggcgagatcagggagctaatcgccgagatcaggagcaaaactgtggcaaccgacgagatcgaaactcccgatctcccgctctcggtcgagatcgaggacgagatcatcgttcgagaagccgggctcccgaacccagcaacccctcatcgtcgtcatcatcatcatcagaccagcctcctcgattacgtcaacatcgcgggccaccttttgctataaggcacagatgcagggcattcacgctcgaacttcgagatgtgcggtggcccgagaagttccgaccaggtgcaatagagaagtacgatgtaagcacagatccgaaagaatttctgcaagtctactccacaatcctatatgccgctagcgcagacaacaacatgctggcaaattacttgccagctgcgttgaagggatctactcgttcatggctggtccatctcccgtcccgctcgatctcatcatcggaagacttgtggcagcagttcgtcgccaacttccagggaacctacaaacgccacgcaatcgaggacgacctacacgctttaactcagaaccaaggtgaatcgtcgagggactatattcggcgcttcaatgagtgcaagaatatgatccccgagatcaccgatgcttctgttatccgcgcgttcaaatcaggtgtccgagatcgatacaccacccaggagctggcgacacgacgaatcacgtctgcccaaaagttgttcgagatcatcgacagatgcgctcatgcagatgatgcattaagacgcgaagagggaaagagcaagacgagcgaagagaagaggtcgagtaacaaggatgcaccagaatcaagcaagaagagaagtcgtaaaagtgggaagcgcaaaccctcgggagaagtccttgccgctgagcaaacggacatggttgagcagtgcagtgtgacaagcggagcctcgacattgttctactcaaaatgccaggaccaaaagggacaatcactatccagggcaatgctaaattggcagtgcagtgtgacaagcggagcctcgacatggttgagcatactcccaacccacccaccacaaccgagcagcccaagaaagtgagcaaacccagcaaaaagtcaaagccagacggtgctatcaagataatcccgttgtctagctccaaccccgacaagatggtcaggataggggctacactgggtgacaaataggaactcgcgctcatcgccttccttcgcgacaatgcaaatgtgtccgcttggcaaccgtacgacacgccgggagttcccagggaggtgattgagcacaaattgatggtgcgacccgacgccaagccagttaaacaaaaactgagaagattcgcacccgactgaaaacaggccatacgagaagagctcgacaaacctctcaaagctggcttcatcagagaggttctccaccccgagtagctcaccattgcagtaatggtacgcaaggccaatgggaagtggagaatgtgcgtcgacttcaccgatctcaacaaggcgtgccccaagggccatttccctcttcctcgaatagaccaactcgtggactcaacagcaggatgcgagttgttaagcttccttgacgcttactccggctaccaccagatcagcatggccaaagaggatgaggagaaaacaacattcatcacgcccttcggtgtattctgctataccatgatgccattcggattaataagcgtagggaacacatatcagcgtggaatccaaggtgcacttggcagtcagcttggataaaacgtcgatgcctatgttgacgatatcatcgttaagaccaagacaggcgatccactaatcgacgacctgagggaaacgttcaacaatctctgcagatatcgtatgaagctaaacccggagaagtgcacgttcggagtatcatcggggaggctactcggcttccttgtctcaggacaagggatcgaggccaaccccgagaaggtcaaggcaatcgagaacatgaagttgcccacaaggctcaaggaagttcagcggttgatgggatgcatggcttcgctaagccgcttcgtcgcaaggatgggagaacaaggacaagctttcttcgccgtactcaagaagcaggaaaaattcaagtggacccaagcggccaagaacgcgttcatcatgctcaaacgctacttgtcaaacccactgtactcggttctcctcaaattaatgaagaattatttctatatatcgctgctacaccttattctgtgagtacggttatcgtcgtagagagggaaaaagtacaacaccctgtgtactacgtcagcgaggccctccacaaaaattagatatccacggttacagaaactgctctacgtcgtggtcatgacatcaagaaagctacgccactacttccaagctcacaaggtcatggtcgtctcctctttccctttaggggaagttgtcagaaacaaagacgtcgtcggccgcattgctaaatgggtagtcgatttaagccagttttatgtacagtttgtaccaaggacagccaagtcttagctgacttcgtagccgactggactgtcttagctgacttcgtagccgactggactatccccgaagatagaccggccagccaaatagataatgagacttgaactatggcgttcgacggcacactcaacagccaaggagcgggagccgggttcatcttgacatctccttccggagatcaattcaaccatgcaatccacctcaacttccgggcaacaaacaacacggtcgagtacgaaggcctactcgcgggaataagagcagcagctgcactcggtgctaagcgactaatcgtaaaaggagattctgagttagttgcaaaccaagtacacaaagactacaagtgctctaaccccgagttagccaaatacctcgccgaagttcgaaaaatggaacataggttcgacgggatcgaagtacgacacgtctacagaaaagacaatgtcgaaccagacaacctcgcacgccgcgcttccagacgagaaccacttgagcccggaacattcctggacatcttgacaaaaccctcagtcaagaatacgcacgacgaaagtaccacaaccaacaccgacatcccgccgggggctacaaaagtcgcatacgttgttgcaaacatcaagacaacaaacgacttgcgtactccgctaataaaattcctggaatcagacgagctgtcggatgacgacacggaggcagagaaattatcccgtcaggccaagatatactgcatgatcggcagagatctatacaaaaaggccccgaactgcatcctcctcaagtgcgtctcatccgatggtggaaaaactctcttccttgacatccacgaaggcatttgcggatcacacgccagcggacgtaccttggtcggcaaagcctttagacaagggtttttctaaccaacagccttaaaagacgcctgtgacattgtgcaatgatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19596 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnnnnnnnnnnacaatcactatccagggcaatgctaaattggcagtgcagtgtgacaagcggagcctcgacatggttgagcatactcccaacccacccaccacaaccgagcagcccaagaaagtgagcaaacccagcaaaaagtcaaagccagacggtgctatcaagataatcccgttgtctagctccaaccccgacaagatggtcaggataggggctacactgggtgacaaataggaactcgcgctcatcgccttccttcgcgacaatgcaaatgtgtccgcttggcaaccgtacgacacgccgggagttcccagggaggtgattgagcacaaattgatggtgcgacccgacgccaagccagttaaacaaaaactgagaagattcgcacccgactgaaaacaggccatacgagaagagctcgacaaacctctcaaagctggcttcatcagagaggttctccaccccgagtagctcaccattgcagtaatggtacgcaaggccaatgggaagtggagaatgtgcgtcgacttcaccgatctcaacaaggcgtgccccaagggccatttccctcttcctcgaatagaccaactcgtggactcaacagcaggatgcgagttgttaagcttccttgacgcttactccggctaccaccagatcagcatggccaaagaggatgaggagaaaacaacattcat

SEQ ID NO: 19597 - DNA, 1100 bp, Oryza sativa
gggaggccgagcgcgggcgacgggtggactgggccgacggcccaagaagaggaaaaaaaggaggaaaaaggaaaaagaaaaagaagaaaggatttttcctgggatgaaaattgcactttggtgatttttaattggttaaaattatttccaaggctctgaaacttccattaaaaatcttgttaatgcattggagcatggggaactcgagaaaaattccaccacgccgaattcaattattaattgcatttattaattaaggaattagctctaggttaattaagataatttcttcggacaatttatttaaccaatttttttaaagcaagcaaaaggggaaacttccgggcgtgacaaacctaccccccttaaacggaatctcgaccccgagattcggaagagctggcgaagaggtgcgggtgagtggccttcaactcatcttctctttcccaagtggcctcttcctctgagtagtggctccactgaaccttgcagaatcttattactttgtttctggtccttctctcgctggtttcgaggatacgagtcggcttctccacatacgtcagatcttcctgaatttcgatgtgatccggacttgcctgttcctcaggaactcttaaacatttcttcaactgagagacgtggaacacgttgtggatgccaagcatgttggagggaaactcgagctggtaagcaacttcacctctacgttccaagatcctgtatggtcccacaaagcgtggtgccaactttcctttggtttggaagcgatgtactcccctaagcggagtgacacggagatacacataatcccctgtttcgaaagcgagctcccttcggcggttgtctacatagcttttctgccgagactgcgcgattctcaatctttccctaacagctctgactttctcttctgcctcatttaaaacttctgtaccaaacaattggcgttcccctgtgtcggtgatatgggaccgggagtatcgtgaccagaggcttgaggcagacgcaatcgcccacgtggcctggcaccttcggggacgtcgggcccgagggtgaggtgtccgccctcctcctgatttcccccgaggggggggggg

SEQ ID NO: 19598 - DNA, 1494 bp, Oryza sativa
  unsure (1)..(1494): unsure at all n locations
ttgcgcctgtctccgccgggagtggaggtaggtgtgggctgtcccatcagaagggttcccggatggaaaccgtaccgatctccgcccattaaagagaaaaagaacagtccagtttggaaagagagagggcatgtggtatccccttgagatataaaaggaggaccttgcccatttagaagggggctctttttttgacttcttcccttttggaaggctgaggggaaagggagttaatcctttgtaactcgtccatacacaaatccacaaaaacacaggagtagggtattacgcttggcagcggcccgaacctgtatacatcgccggtgtctcacgtttcttgcgaggcgggtgatctttccacatacagagggagagcgagagcttgagatttcaccctaagcccccggccggactggcaaaggggggcctgcgcggtctcccggtgaggagccacgagctccgtcatctggcgcgccaggtagggggctcagcgtgtgttttctgagctctcgtactcttccgtgtgcgccaagtttcccttgttcagcctaatggccgagcaagcaaaggcgcacgacctctctccgagtgtgagcggcgacgatggggagccgaatccacgccgacgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgtcattcggctgccactccctcgtcgacaccgtcgactcgggaggatcagcatggggagccggatgcccgcctcaacatcgagcgccggcgtaatagccggcgtactccccgtgcaacggagggcgcctcctcgtccagagtgtcacctcgacacggacgtgaagatcagccctccgtgcccccggccggtggtgttggctgtagagcctttgtggcgagccttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggnnnnnnnnnnnnnnnnnnnnnnnnnnnnnncccgcgtcggtccactcctgggaagatttgtgccaacagttcaccatgaacttccaaggcaca

SEQ ID NO: 19599 - DNA, 2641 bp, Oryza sativa
  unsure (1)..(2641): unsure at all n locations
cttgcatgcagtacagcgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaactcctccggttccggagtggcagcttcggccgcccccggatccgccgctcagacagggcggcgtgacaggaggaggaagaagaggccggaccgttccggcgacgagggtcatgtcctcgccgtcgagggcgctccgcgggccactcgaaaggggaggcctgcgagcgacaaaaagaacgaggctggtacacccagcagggagcgcctcgccggtaggtggtgctctgtccacaacacctccctccacgatctcgcggactgtcgtgcggtcaaaaacctggccgagcgaacgaggaaatgggaggaggacaggaggcaggaacgccgtgagggcaagtccccggcggttccttccggcaaacggcgaagtgaggccaagcagaaggcccccgctgttgacgtcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaacgtgaagttggggcgtgtcctcgtagatggaggagcggccctcaacatcctttcccccgcggcttttgatgccatcaaggccccggggatggtgctccgaccgtcccagccgattatcggtgtgacgccggggcacacgtggccattaggtcacatcgacctaccggtcaccttcggtggacccgccaacttccgcacggagcgggtgaacttcgatgtggcggacctcagtctgccctacaacgcggtcctggggaggcccgcgttggtgaagtttatggcggcggtccactacgcctacctccagatgaagataccgggccctggtggccccatctctgtccgtggcgaccttaaagtcgcgctcgcttgcatggagcagcgcgcggaccacctcgctgctgcgtccaagcccgagggtggtgatgagaggcttggcccctctgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggaaaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcaagacttctggaggccggattcatccgtgaagtcatccatccggagtggctggcaaacccggtggtcgttcccaaggcgaacggcaagcttcggatgtgcatcgactacaccgaccttaacaaggcatgtcctaaggatccttaccccctgcctcgcatagatcagatagtcgactccactgcggggtgcgaccttttgtgttttctagatgcatactctggttaccatcagattcgcatggctagggaggatgaggagaaaactgcgttcattacccccgtaggaacttattgttatacgtcaatgcccttcgggttaaagaatgcaggtcctacttttcagcgtactactcgaatttctttgggtagccaaataggacgtaatgttgaggcttatgtcgatgacttggttgtaaaaacgcgcgaccaagaaactttactttcagatttagcggaaacttttgagaacctccgctccgcccgcataaagctgaaccccgataagtgtgtgtttggtgtgcctgcgggcaagcttctcgggttcttggtctcagcccgaggcattgaggccaaccccgagaagattcgagctatcgagcggatgcgcccccccagcaaacttagggatgtgcaatgcgtcactggttgcatggccgccctaagtcgttttatatcaaggctgggagagaaggcgctacccttgtttaagctcctcaagcgctcggggccgttcacttggacggaggaagctgaacatgcccttactcagttaaaggcgtatcttagctctcccccggttctagtcgccccggagccaaatgagtccctgttactttacttagcagcgaccccccaagtagttagtgcagcgttggttgtggagcgcgatgaggacaatccccattctgcgcacccccactctatggggattgggnnnnnnnnnnnnnnnnnnnnnnnnnnnnnnnnnnnnnnnnnnnnnnnnnnnnnnnnn

SEQ ID NO: 19600 - DNA, 14751 bp, Oryza sativa
  unsure (1)..(14751): unsure at all n locations
cccttcgggacgccaaaacccgataccctcaggcccagaagatgctttacgctattcgggtcactgtggttacgtcttaccccctcgggcaaatcttgcataatcgagagggtacacgacgggtggtaaaatgggcaatcgagctttctgaattcgacctgcactttgaaccacgccacgctatcaagagccaggccctcgccgattttgtggcagagtggaccccggctccagagaccgtctcaatccccgaggccagcacgaacccctcgcagctgcctcacaccacctactgggtgatgcagttcgatggttctctgtccctccagggtgccggtgcgggggtcacgttgacctctccgaacggagacgtcctcagatacttggtccgtctcgactttcgagcgactaacaatatggcagagtacgagggactccttgccggactcagagtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatgtacccagaagggataacatagttgccgatgaactctcaaggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacccgaggaccgcgaagggagtgaacgtgtacaacgcatttccaaacgctacgtgctggtagaagggaccctctatcggcgcgcggctaacggaatcctcctgaaatgcattcctcaggaacaaggcgttgagcttcttgccgatatccatgaaggcgaatgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttatcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttaaaaaagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggaggggggggggtcgggtgtcaggttttggctcaggccaaccccgcacccccctcgggtgtgcaggattggccgggggctaccacacatgcacatatatccctttttcctttatttcagcatttcaataaaagcagtttcaattttctaaaggttgtgtctgtgccgttttttccttttgaagaatcttgacttaaaataaggtcactcgtactcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgcttttcgaggactgggacttgggcacgggcccttatttcaagctaagacgcaaaaagaccacggcacagatcatcctcatctcatatatagcaaaataaaactaacacaaaaattttttcatcatttctcattgcagattaagttaaattgtacaaaaaagaggcatgaaggccttagaagaaagaataagaaaaaagttaagattggcgggggcctgggggctcattcaaatgcgcccgggtcgccggcctcgtcgccaccgtcgtcctcgccgctggcgtcgccctcctcgtcagagctgggggcgaacgcgagccgaggggccgagccctcgaagccgttgacgatgtggtcagcagcatcctcgacacgcgcgcgcgcgtcgtcctcggtcccgggagggaactcctccagcgccatccagggagagaaattggggtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgcggctctctcggcgcggacgcattcgagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcatgcgccgccagcgtcgcctctcggagaccagcggcggcctcgcggtccgtcaagcccctctccacggcgccggcgtgttcttccagcgccatggcacgggcctcaagggcctcctcgcgccgccgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttgggcccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtaggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggggcccaatcccatctggctccctggggggtccgcatgtagtctccaggcccagtgtactcccaggcgctccgggcgcgccgttgagccgcgcaatccgncgacgnanggtaatngccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggtagtacactgccgtcgagcagagcagcgccccgtgccatggcggtggaggaagagatgattgagaacgagcgcgtgtggcgaaagtagggcgtagcagagaaagagttagagctcaggcggcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttgcggcgcatgaagtggatatgcagttgtggcaatcgaaatggattgtatcgtgcgcgcgttaattacgctcgccgaccgaagcggcgttaccatatctccgggcgagacaaatctgctcacccagattcgcgcgctgctcaagtggtgtggcagtcttgaatagaccgcccattatgaacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcgtgaccagaggcttgaggcagacgcaatcgcccacgtggcctggcaccttcggggacgtcgggcccgagggtgaggtgtccgccctcctcctgatttcccccgagggggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccagtcagatcacgggttaggtggcgactggcggtctgacgcacgccttgccccatcccgtcaagacgaaagcctctaggctctcgtctcaagccggagctagcgtgttatctcttagagatggcacgttagccctggtcagatttataccaggcttcatcctaaccattacaggcaaggtgttacacgaagaagggcaaacatgcacgttgttaaactgacgcgtggtggacaagaatgaccggtctggcactggtcgcgtcagcaacgggtagccacgatctcacgttgcgcctgtctccgccgggagtggaggtaggtgtgggctgtcccatcagaagggttcccggatggaaaccgtaccgatctccgcccattaaagagaaaaagaacagtccagtttggaaagagagagggcatgtggtatccccttgagatataaaaggaggaccttgcccatttagaagggggctctttttttgacttcttcccttttggaaggctgaggggaaagggagttaatcctttgtaactcgtccatacacaaatccacaaaaacacaggagtagggtattacgcttggcagcggcccgaacctgtatacatcgccggtgtctcacgtttcttgcgaggcgggtgatctttccacatacagagggagagcgagagcttgagatttcaccctaagcccccggccggactggcaaaggggggcctgcgcggtctcccggtgaggagccacgagctccgtcaccctgtctgatcccagaagagcggagtacgacaccttcgtccatacagtgcttcaaatggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgcctcgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaataccgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggctgtgcctctagggcagccacgaatccgtgctcaactataccaaggttcagatgttccaaatcgcgttgaacctcacaacatagttgctctacccatgcaacattgcagtagctcttcctgctcaaagcatctgcaaccacattagccttgccgggatgataatgtattcccatatcataatccttgatcagctccaaccatcttcgctgtctgagattcaaatcagcttgagtgaagatgtactttagacttttgtgatctgtatatacctcacaacggttactgatgagatagtgctgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagatgttctcaatgaaccggcggtaataacccgcaagtcctaagaaactccgaacctgagtgactgtccttggtggggtccatttggtaactgactccacatttgctggatccacagctactccttgagcattcacgatgtgaccaagaaactgaacttccttaagccagaagtcgcacttgctgaacttggcatatagttggtgctcttttaacttttcaagtaccagctgaagatgctgctcatgttcttcctcggacttggaatagataagtatgtcatcgatgaaaaccacgacaaacttgtctagaaattccataaacaccttattcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacattctcttggttttgtctttcttctccacaaagataaccggagcaccccaaggcgacgtgctcgggcggatgtatcccttctgtaactgttcatcgacttgcttcttgacttccgccaactcgttggctcccatactgtaaggcctcttgtggatcggtgcagttccaggtaccaagtcaatccggaactcgatatccctttttggtggcattgttgtcagatcgtccggaaaaacttctggatactctctgactatgggaatatcctccagcttcttagtggttttctccactgctacctcttgttcttcaccagcagcctggtttaaactgatccctggcttccgcggcactagagactggaaggttaccacctctccttttgcatgggttaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtattaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccattatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttaccgtgctcctcctgacggatagccttatccaccagcttctcaaagtcctcataatctctagagatcaactggttagtcaattcatcatcaagaccagacaaaaacttctcctgcctctcggcattggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaactgcaggttctgttgttgctgctgtgcttgctgctgcacctgttgcaacacctgatggtactgttgctgcatctgttgcatcatcattgtcatcatctgagtctgattgtccaacacctgagcaattgttgggttctcgggcggtggggacggactgttgccagatgcactgttggcacgtgctccatcgatcggctcttcgctgccacaggcgttgttcgagtcgcgtgaaccattccttatctccatctgaaggggataggtagaaatatgagaaaaggaagaaaaacagggggctcaaactaatcttgcttatgaatttaagtgcaattatcttaatcttgattaaaacactgaaaaagaggcacgcaactcctaattgaggcagtcataccactgacacatgatatcgaccgccgactagcccacaagcaacaaacctaaacatgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacatttttcatgaacccaaataaagacactaatgcaactaaacaataaattaatacatagactagttgcatggaaaatgatgcgcataacattgcccccatcgaatatagacacgacctaatgcataactcccaataaattcccaactgactgtcgaataaactccaactaaaatttttctaaagccctagactgagctaattttttttaaaaaaaatccgatccgaatgaacgaccaagatttttcccgcaaaccaaagaggcaaaactccaaattttcccaaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgataattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacagttgaaggggaggatgaccacggccactagagcggccggccggagttgggtggaaatggagagctcaccggcgtgcgagagaagcggcgtttcggcgacgattggcggcaaccgagcggcggccgaggtagctctcgcggcggcgaagctaacggcggtggcgggttggcgcggcggcgaccctagcggcagtggcgcgcggccgaaggcgacggcaagcggcggcgctagcaacaagcggcgcgagctcggtaggaggcacgggaggggacgggaaatgggtgaaacgagagaggggactcggggaagggtttttatgggcgagggaggggcggacgtggccggggatggcccctatttggccggcgatgtggggagtggagggagagtgagagaggtggattcgaaatcgaatcccgccctctcgagcgcgcgcgcgggccgggagatgcgggggaagaggcggcgacgtgggggggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgtcccggagagagggggaaggagaacgggccggcccacaaggggaggccgagcgcgggcgacgggtggactgggccgacggcccaagaagaggaaaaaaaggaggaaaaaggaaaaagaaaaagaagaaaggatttttcctgggattaaaattgcactttggtgatttttaattggttaaaattatttccaaggctctgaaacttccattaaaaatcttgttaatgcattggagcatggggaactcaagaaaaattccaccacgccgaattcaattattaattgcatttattaattaaggaattagctctaggttaattaagataatttcttcggacaatttatttaaccaatttttttaaagcaagcaaaaggggaaacttccgggcgtgacacagttcgagaatgtttgtaggaagtttaatggatttttaatatataatagatagatagatagatagaagatagatagactatgtgttgtagcggagacttgccttgcaaattgaaaaaatgaaatagtttagggggatcctagttatcacatctaccttctcgtgccattaatccatagccgctaataagtgtatcagccacatttgtacttgagactctcatactatcatcccagcttcttaagattccatttgtgttctatattttagtcagtaatatcgtgtatttgtttgtgttctatattttagtcagtaatatcgtgtatttgtttgtgttctatattttagtcagtaatatcgtgtatttgcaggagatagctagagaatttattttgccagcgggacaataaattccctatccatgatcccacggaaacaactctggcactggtggagaaatgctttttagtcatggttcgcaacccctgtagtcccggttttcaaaccgagactaccaatccaagactaaagatcgctatctttagtcccggttcaaatacccggtactaaaaatagatctttagttccggttagtaacaccaaccgggactaaagagaggggatctttagtctcggttggtgttaccaaccgggattaaagagagggttacggcagtgagatgatcccctttttctttttttttcttttttattgtctcccaaatcaagtgcgatacatatcccaaatcaaacccccaatccacaaatcgaagtaacatctcaaatctacatcacaaatcaaagttacttatacacacaaataannnnnnnnnnnnnnnnnnnnnnnnnnnnnnnnnnnnnnnnnnnnnnnnnnnnnnn

SEQ ID NO: 19601 - DNA, 2674 bp, Oryza sativa
gtaccaaccgggactaaagatcctcggccccctgacatacgtctgacaggggatgaaccgggagtaaagatcatctttagtcccggttggtgttaccaaccgggactaaagatcaaaatttttataaccgggacttaaaaacaatctttactcccggttctttttgaatccgggactattgtgaatttgtcggaccgaccaaagaaggtatctccaccagtgtgggttatcctattttttaaacaaagtttgccgaatagcaaaaattctggcaaataagcttttcactcataattcggtaaaccgtcgtgctcgttagcaatatcatacaccgcgtatgtatgtttgtaaaccatagttattgctgtttcatgacgcctcttattcgtatcatattaagatgtacatacagcgaaattacgtgggcatgatgaagacgtcataattgcatgtaatgcatgaactgtaattagtgtttgtttgaggagcgattctcgatcttctgctctctactgatagtatcatgacaaaatttggtacaagacatttaaaaattgtgtaattagctggtagaaaaatctggattgtttattattaagaataaatttgtaatttgttaatagagtaatgagggtaacttagttcttttttttgtttttttttgggtatgggtcactaacgtcaggcccatttgcatcgtgccaccggtgggctgttttgattgttacactggctgtggctggtatcggcggcacatcgtcaatatttcaccagaaaaattggatcgcaactccttcgcccggaggcgcttttgggtggcaagtggtgagtcctctggcagggaggcgcgtgtggatcctgccggcggtgacacatcgatcccccataatccgtttctctgcatcccgccggtggcacgcgtagatcttgtcggcggcgacatatatataccggctacccgtttctctctctagccttttaaagcagaagtactatatattttagggcaaaatatattacgtcccgaattcatccggtctgtccggatcgatggataaaaaccatgttttttcgatcgtgcaaacataaattgaagcaaaactactattttagatcgttctaatcaggacggtctagatcgggttgacaatgaaaatacacgtggtttttcagtggtgcacacataacttaaagaactactattttaagataaaatatattacgtcttgattttatccgaatagttcggatcaggtcatcaacgaaaaaacaaatggtttttcggtcgtacacataaattaaaccagaactattttagtacaaaatatgttacgacctccggattttatctagtctcttcggaccgggtcgataatgaaaaaacacgtggttttttttgatacacacataaattaaaccacaactattattttaggacaaaaaaatatgttacatccggatttgatctgctctgttcggactgtgtcgacaacaaaaaagcatgcgggttttttggtagtacacacataaattaaaccaaaactattattttaggataaaatatgttacgactgaactgaatttcatccggtccgttcggacctaatcgacaatgaaaaagcacgtagtttttttttgttgtacacacataagttaaaccaccagaagtactatttttgtacaaaatatgttacggctggatttcatcttatctgtccagaccgggtagataaaaaacacgtggttttccgatggtgcaaacataaattgaagaactattattttagaataaaatatgttatgttttcatacagacggtccggatcgggtcgacaacaaaaacacatgttatctctagtttttcctttttcagtccgtacgtgaatacgtgatcctaatttcccattccaagttcgttttcgttttcctatttttctactttccgatcgacgcaggttctgttttacgtaccgagattcacctttcttcaccgtgatttatttactaatttttcataataccccttcttgatcaattctactaccgttaagtgagaagatagtaaaaataaatctaaaccctttaattaaatgagattaatagttcaaattgcttgatactacgagtacggaccatcggagtgagactcttgttcgagacatcagagccatgcacaaatgatcgacaagaaggcctcgttccctagatagcagatagcatgtacaactacgaacaaggccgtcataggcgatgcaaaagccttaccgaaggttggtatgggaaccatgtcttctcttgtgtgaatgatattctggataaatccaagccgacattcaccttttccctcatgcctcatattcccaaaactctttgatatcctctccgcatctttcttcttgttttgtgacttacctcattaatgttgctatgtctttatacagtgatctgttttttatatatggagtgaattgttgcatgctcaaagacgtgatataaaaagagttggagaagaaaactacaaggaggttttttaccgtaattgaggttgagggcatgcaataccatatcctagctgtcgatctgggaggatccaacgactgaaattggttggtacctcatggtaccgtgtctctatgaggggcggtaccaattgtgataaggtggtgaaagggta

SEQ ID NO: 19602 - DNA, 723 bp, Oryza sativa
  unsure (1)..(723): unsure at all n locations
ggggagagaaagaagaccacaaccgttgcacaggctgccgaaattggaagataaagaagagacccttaaacagttacaatccaatccgactataagctgctacagcagatacatccagggcagctgctattttatcctatatgttatgagatcaattcgtgaacgagcccggcctctttcatctgcacatttcatcctggattaaactgaacaactgccaccatcattttcgctccactctaaagatgcgtgtttgtttattcctgactaaccatcacatcatcgaaagaaggcttcaatgatggggctttcttctgtcattgagccggactgcctgaggcttgcgtggcctattaccggtccttgaatttctgaatgtcattactgtgagctagtgaaagtaaaattgtgtgtgaagctgaatatccttttggtgttcaggcataagcttcgggggccaaatcacctgtagtgtctgcagatcaaggtttttgcttgtgattgtacatgtgtgctccctggaaattttatcgtactagatgcatatgctagtttgtccaccattttcctgatgcttcttattcataccactcttggatacacagtggaactcaatctattgttcacgccttctgtaatcgtattcagctccatcctttttctgttnnnnnnnnnnnnnnnnnnnnnnnnnnnnnnnnnnnnnnnnnnnnnnnnnnnnnnnnn

SEQ ID NO: 19603 - DNA, 459 bp, Oryza sativa
cccagtggcagcggcgagactgatctgtcaggctccaggagtcgttcaaagggaccaggtgacgagcaggaggacgctttggactccaccggccgcaggagccgttccgagcattaggctcgttttcccattagtttatcgaattgtctagtttctgcttgttagtatgtgtgtttaggttgcttgtttggggtcagtcgacggtcgatatcatgtgcatatgatatggctgtcttaataaggatttttgtttgctctttttaagtgttttaattcagatcagaacaattgcagttttaattcctatataataaagcttagttcttgagcatctgtttttcttcttctcccccgactgcttttccctccagatggtctacaccaggactggctaccgcaccacaggcgagggcagcaacggtaaacaacgcgctgatggtgtgcaccccatcagtgatt

SEQ ID NO: 19604 - DNA, 711 bp, Oryza sativa
ttttgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatggttaaa

SEQ ID NO: 19605 - DNA, 715 bp, Oryza sativa
  unsure (1)..(715): unsure at all n locations
tgtcacaccctgaaaatccaaaatatataaattgttgtttaaatggaattttctagaatttatttttaaaagtcttgaaaagaaaatctaagtttaattattaaattccaatataaatttgggcaagataaaatttcattaaatactttgcttaattctataattcctagatttttctgggatttatttgagttaagaaagtatttttaataaatggaattgcatttaagaaataattttaattgaaaaaggttttaaaaagtcttcttttggctttgggccgaaagtcggcccaaaaccgttctctctctcctcggcccagtccggcccagtccgcagccgcgcgcgcgccctcgctgtcgctgacaggtgggtcccgcttgtcagtcgtcgtcttcctcgggccgaaaccctagtttcgcgccgccgagctgccgtcgccgccgctttccaaatccggccgttcctttccttctccggccgaatcaatagaggggaaatgatctccgggatctcctctaccttttctcctttggaatctttggttaaatcgctttggaaagctttggaatcgagttcgattcggatcggttttccctctctccaagccgaaggtttccttcgccgttgccgtcgccgtgggccttcgccgccgcctnnnnnnnnnnnnnnnnnnnnnnnnnnnnnnnnnnnnnnnnnnnnnnnnnnnnnnnnn

SEQ ID NO: 19606 - DNA, 1002 bp, Oryza sativa
gccccctcccccctcacctcctcctccaccgccgcccctccctctccctctctgctccctctcccaaccggcgagcagtgtcgcccacgtcgggcggcctccccacgagcgattctccctctccgtcaacctcccaccggcggcatgtgtcacgaccggaaaaataccttttcccaatcgctagtccattgatccccgtcccaggaaaagtcaggtacacataaaaaatcatgatacaaaagacatctttaaagcgataatatttacatatgcttgattggttactaaacagccaccaagtatgatagcatcaagattggtgtcccttagaattttgttggccgcttgcatggttagccgatgcttccatttataatcattatgggtatcttccttactcactgttacatcctttataggacgcatatgtcctttcatggttaagataggtgtagtcactaggactgaaagtcttgcaacttgttcaatgtctttaaccagagataggctagttgattaacttctctaccaacatctaggtcattaagttcaagttgactatgattcatcataaatgaaactctaaatctgttttggttattatcagttgtagagattgttgtacatttgtatcctcaacatgaatcattcataaacatagcaaactcattctttatatatataaataaactcattctttaggttgatataggatactgagaaactggacccgaatcagccaaggaaggcttatgacaacaatcgacccaacgacggtcatcttgtctataaagaaggagaagttgcaacaaagcaagatggtcatacggaaaagtgtttcagtaaagacaaggattgaaattattagacttgaccgggaagtcaagatgggtaacatgaatagtggtaatccaaagctcgatcgaacttttggcttgtatcagatgctacacagaataaaaacacttgcactagttactgctcaatgtgctttcctcacaa

SEQ ID NO: 19607 - DNA, 1289 bp, Oryza sativa
  unsure (1)..(1289): unsure at all n locations
tcccatcagcaagctttgtgcgcataatgcctcacaatggccggcactcacacgggtaaggatggtgctcagagtcagagatacttggcaactcacactctcgagtaaccacggcagctgccacagcgagacacattagaatgtcagcactactagtcactatggatgtaatgaaaaccttcgaattatttttcttgttcggtccacttcttttctgatgcttcctactcccatcacatcacaatgcaagacaacttgaagaaactagattctcttatatatctacctctcccattgtcttgttgattgttgctcgcctgctaattgctcctagttgcaacgacgagagcccatatgtattgtagtgaagaaagatgtatatatatacccaaatctggagggatgtatgaaagagttggacaagctagttattgaagatgatacaaactgttatgtcctggatggttggtaggcaatttttttctgtcgtctgcctccagaagtattttaaaatttaaatagcaattactatcaccttttgtttggaattagtatttaaatttggacatgtcaagacatatgccataatttattttgccttttgtcccatataactatgagatgaagatttccgagaaaacaaataggggcaccggcctagtactannnnnnnnnnnnnnnnnnnnnnnnnnnnnnnnnnnnnnnnnnncccatctaaacagggcattataaacgtttcgtgctatggtggatgggcagcaactctttgcttccacctggatcttctcttgttgcaggactaagcctagcactagcatacacgcaatcaaactgttcacaccttccatgtttcctagcttgttttccaatcagatttactcgaggatcaactaaaggaagagggctgtggttgtgcatacgattggagagtgagacacgcctatttataggtgaagcctatacagatgattatgttattttaattcacaatagttatattgatgatctgtactctgtattgtttgtttagagaccaagccacttacactagtacataatagacttttccgtgcggtcaaaatacattttttccgtgcagaggacctgcccgtctacacccaggtatctacgaaaatccatatttttgcgttcggacgggcggaccgcacgtgataattgattatcccgtgcggtcgtgttaagtagaccgtacgggataattagttatcccgtgcggtcctattatattgacctcacgagataatggataatcccagtcggctagcatg

SEQ ID NO: 19608 - DNA, 628 bp, Oryza sativa
caaagaaaagcaaacacaaaggcgagtacatctttgaacatcaaaacatccaaagctgccccttcaagaaatcaagaaaagaaacaatttaactgcaaacacatgtgtaaagcaagatctggatatcaaaacacccaaatctgcccatcttgcagtatgtacgaaacttcaaagaaacctaaattcactgctaaacccaatacttcatcaatcctctaatagcgtggtcatctaacggggggagaagaagaggcggcggcgcttactgagagcacggtaaaaaagaaccagagcatatggcctcatacctagcaggagcaacatcagacatgacatctacgggcagcaagggcgcaggacaggggatgaagggaactagggaagagttactttcgtcggactccgacgactgggcggcatcgctggcgtgtggccggccggtggactggagcctggcagcctgcctgcttttggagggatcgctggtgccgcggcgtggtcggctggccgcgcagggcgcgtgccgctggcggctgccgagccgggcgggcggcgcgcgtgtgactgcgtggaggacctgactggggcggcggggcgatggaaaaacgggcacggcggcgacgggtgg

SEQ ID NO: 19609 - DNA, 747 bp, Oryza sativa
gtacccatcaagcattgctcttgcggcttcaataagagttcggttcttcctctcaacaatgccatttttaggaggatcatagggggtggagaactcgtgcttgattccctcttcatcaaggaattcctccacttgagtgttcttgaattctccattgtcacttcgcaccttcttgatggtgagatcatagaggttttgggcttgcttggtgaagcgcttgaagacattttgagcctcactcttgtcatggagaaaatacacccaagtgaagcgggaaaaatcatcaacaatgacaaacccatacttgttacctccaatacttatgtaggccatggacccgaataaatccatatgtagaagctcaagagggcgtgttgtagtcatgatgttcttgataggatgtggattcccaacttgtttcctggcttggcaagcactacacacacgatctttatcaaatgtgacattagtgagcccgaggatgtgttccccctttagaagagttgccaaattccgtattccaacatgggttagtctacgatgccatagccaacccatggaggatttaacaatcaaacaagcttccggattcactctatccacatcgaaatcgacaagatagagatcacccttcaacttgcctttgaatacaacggagtcatcccttctaaagacggtcacatcctcatcggtaaacaagcaattgtaacccaacttacacaattgagaaacggataataaattgta

SEQ ID NO: 19610 - DNA, 1476 bp, Oryza sativa
acgtcagccctggttaatattgcgcaataaattatttaaggatttcttttatagtaataaacacagtgaatcttctaaaattcataactaattcatccgagctcggtttaatcccattcaagtctcagtaaatcaagaaaaatgtgtagaatccattaaaaatggttttgttctctgtttcagtagtcttatagcctgtttgcaatgtttgcttggtatgtcgctagattccgatccctccgacgctccggtgtacttcgagatagtcgccgaggtccctccagcagcggagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttccccccaacctcagagctcgagtatgtgtccgatggcaggttctccgaggagtaggcttcgtcagtgccgtaaagaatgcctgtggagtggtgttcccgttgcagttcaagtcaaggattagctccagtta

SEQ ID NO: 19611 - DNA, 807 bp, Oryza sativa
caaagttttccagaaaaagatcctaaatcaagcttgtcagacgagaaatctaagttgtgacttgacactgcctaggatgaatgacttcaaattaaactgatagttctatgaatgagatcatgtccagaaaattcaataaatttgaaatcaacgcgcatagaattctcctcgtcctctaatctacgtatgttggggagcacgctccggtgctttctacttgtagtatatactccaagtagaattaatcttgaccgtttattttaaagggtagattagtaatctccctaatatgcattaggggtaattttggcatgggctgattaagggtaattttggtaattttggcttgatcgcatcaggcacgacgcagccaccgcatctcaggccgatcggattttgggtacgtgatacctatctggatcggaattgctaagggcccctttgaattaaaggatctacgtaggaatttcataggatttaaatcctataggaaattttcctatttggccctttgattcaaaggattgaagctttctaaatcctatgaaattcctatggaatggcatattgcatgtgaatttggaggaaatttagcaagagctccaacctcttggaaaatttcctttgagtctatctctctcatctaattcatgcgtttttcctgcgctccaatcaaacgatcatttctgtgtttttcctgtgttttgcaatcctctgttttacacttcaaatcctgtcagaaatactgtgtttttcctattcctccattttttctaccctgcgattcaaaggggccctaaataactt

SEQ ID NO: 19612 - DNA, 607 bp, Oryza sativa
cccttcatttctgttgtggtatgtatatcaatctctacaaacatactattaggtgtagcgtcacaaacattataaaaaagatgccccctttttaactagctagggaaataagatgtgaatgtttaaagaaggggtgatatatatagaagggtaagtcgatatggaggagagccgtattgctttgtgcactgcagtactataggatcactctttaaatctcattatctctagacttcaattatttagtgcggtcagcaatgcgcgcggtggcatcaccaccagagctgcagcaaggagcaaaccggggacaaatgggaggggggatgtagaggaggccagccaggccgggtgccgcaccgagacgttgatgccttttgatgctggcgaggtcgggaggcggcatggtgaggatggatgaggcgggggactgcatagtgtgaattgcaaagggtgctacttcctgcacataaacataaaacaaaacaaaataaatagggaggcgggggactgcatagtgtgacttgcaaagggtgctacttcctgcacatgcataccaatgtcacaaaacataaaacaaaacaaaataaattggaatactgaacgaata

SEQ ID NO: 19613 - DNA, 1186 bp, Oryza sativa
ctctgaaactgtctttggttgcttccaattggttacggattccacgttactaggatcgacggcaactcctccggctgagatgacgtgaccaaggaatttcacttcggacaaccaaaattcacacttgctaaacttagcatacagttgatgttctcgtagcttctccaatgcaagacaaagatgttcttcatgctcttctttggttcgagagtagataagaatgtcatctataaagaccactacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaaaacagtggcacctttaagctgatcaaacaaatcatcaattctgggcagcggatacttattcttgatagtcacatcatttagtgcacgataatccacacacattctctgggtatggtctttcttttccacaaaaataaccggagctccccatggtgatgaactcggtctgatgtatcctttctgttgcaaatcgtccacttgcctcttgacttctgccaactcattggctgccattcgataaggtctcttatggattggagttgttcctggtaccagatctattctgaactctatatcccttttgggcggcattccaggtaaatcatctgggaacacatcggaatactcccgaactataggaatctcttccaaagttatttggttcagtcttgaccttaaagactcagatgacaatgcatgaacagttacaactcgaccatcattgctggtgagagttacttttctgttagcacagtctatcacacctttatgtctggctaaccagtccatccctaggatgacatcaaggtctttggattctaacaagataagattggccagaaatggtactcccttaatttctattctgaccgaggggctacgttgcaaagagagtgcttgatcacttggggtactaaccatcaaaggacgtctaagatcttctacttccatcccattatttcccgcaaaactcatagataagaatgaatgtgtagcgccagaatcgaaaagtactgttgcaggaactgagtta

SEQ ID NO: 19614 - DNA, 9840 bp, Oryza sativa
ttttaaaacttttttcaattaaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagattttcttttcaagactttttaaaattatttctaaaaattccatttaaacaacaatttataaattttgaattttcagggtgtgacaaacctaccccccttaaacagaatctcgtcctcgagattcggaagaactggcgaacaattgcggatgagctgactccaattcatcttctcgttcccaagttgattcttcttccgagtgattactccattggactttgcaaaaacggataactcgattcctggttcttctctcacttgtttccaggatacggattggtttctcaacataagtcaaatcttcttggacttctatctgctcaatattagcttcttcggtaggtacccttaaacactttttcaattgcgacacatggaacacattatgtactcctgccaaagattgaggtaactccaactgataagcaacctctcctcttctactgacaatcttataaggtcccacaaaacgcggtgccaattttcctttggtacgaaaacgatgaactcctcgaaaaggcgtgacacgaagatacacataatctccctcttcaaaactcaaatctctgcggcgattgtcggcataactcttatgacgagactgagccacacgcaatctttcttgaatgatctttaccttttcttctgcttcccttaggatatccgttccgaaaacctgacgttctcccgtttgatcccacaaaagcggagtgcggcacttccgaccatacagtgcttcgtacggagccatctgtagactagcttgataactgttgttgtacgaaaattctgcatagggtagattcttatcccaacttccaccgaaatctagagcacaagctctcaacatgtcttccaaaatttgattcaccctttcggtttgtccatctgtctgcggatgataagcagtactaaagttcagcttagaacccatctcttcctgaagtttcttccaaaaatttgaagtaaactgactgcctcgatcagacactatcttcttagggacgccatgcaaacacacaatccttgccatatacaattctgctaagcgacttccggaataagttgtctttaccggaatgaaatgagccactttggtaagtctgtcgactatcacccaaatagagtcatggcctgatgacgttctgggtaaaccagtaataaaatccataccaatttcttcccatttccattcaggaatcttcaaaggttgcaacaaaccggcgggtttctgatgttctgccttgactcgctgacaaacatcacatactgctacgtattctgcgatttcacgcttcatacttgcccaccaaaatctttccttaagatcctggtacatcttagtactaccaggatgaatggagtataaagtatcatgagcttctttcagaattgcatcctttaaatctttgttgtcggggacacagattctctcacccaaccatacagttccgtgctcatcgtccaagaaaccaatagcttttcctcttctcatattcttcttgatcttttgaatatcaggatcattaatttgggcttctctaacttgatcaattagagtgggcttggcttttaaggttgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatacacttgaaaacccttctttggatcaggcaaaatcaaaataggagcggatattaagcgacttttcaactcttgaaaactccgctcacattcttccgaccacttgtacttcacatctttctgaagcagtcgtgtcatgggcttagcaatcttggaaaaattctctataaacctccgataatatcctgcaaggcctaggaaactgcgaatctctgaaactgtctttggttgcttccaattggttacggattccacgttactaggatcgacggcaactcctccggctgagatgacgtgaccaaggaatttcacttcggacaaccaaaattcacacttgctaaacttagcatacagttgatgttctcgtagcttctccaatgcaagacgaagatgttcctcatgctcttctttggttcgagagtagataagaatatcatcaataaagaccaccacgaacttgtctaggtattccataaacaccttattcatcaaattcatgaagaaagcaggggcattggtaagtccaaaagacataacggtacattcgaacaacccatacctagtggtaaaagctgtcttaggtatatcttcctctttgattctcaactgatgataccctgatcgaagatctatcttggagaaaacagtggcacctttaagttgatcaaacaaatcatcaatcctgggtagtggatacttattcttaatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagcctgttgagagttacttttttgttggcacagtctatcacacctttatgtctggctaaccagtccatccctaggatgacatcaaggtctttggattttaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagcagcgacatgatttacacgagcctttgatgctggtacagcagagttattctgggtagggacaaccttcacgcgtcggggcttcggacacttgtcagcataatgtcctggatctccacagttgaaacacaccacgggcttgttgccttgctccctcttggcaggttgttgctgtgctggagctgcaacaggacgtggagcttgattacggatgttgttgccagcattgttgttgaagaactgacgctgcggacgaacaacagacgaagaacctccctgtgacatgggctggggtcctaaagtaagacgcggcttctgattatttccctgttgtgtcttgaattgagcaatccgacgtttcttctgctccatgcgattatacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgagtaagcgacctgaactccttcttcttgagagacactactcccgatggtatatgcgtctttcggaaagcagcggtgaattcaagccaagtgataggttcatcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggccttacacgaagaaattctgctaacttgttctgtggaggtgcatgattattcccttggttttgctgattctgaaattgctgcatcatcatgttcataagctgagtctgttgagcaagaacttgggccagagtgggattctctccattgttgttgttattggggttgttgggaccattcccattgctacgagtgttcaccatctggcatggacagggcacaagaagagaaaacgggggaactacttaggacagagaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagccacacacacacaagcaaacttaaaacaagcaaactaacacatcgatctaagacaacgacttaacaagtcactctagttcttccaagcatcggaggtcgattgagggctcgtcttcatcatcttgagttgctacccactcaatcttggaattgatgcgcttggattcttcttcttcatcactacttatgatgatgaccggaggatccgcttgagctggagcaacttctttctccaccacacgaacctttggcgccaattgatagcgagggacaaatagagctctcttccttgcggtaagacgaatccaggccttctgcggcggtgcttctcccttcaatgcggctaattccttctccaaacgatccaccttgtcttctagcttgcaaatcttaccacgattccgatcttcacgatcttgagctgctaacacagtctccgcacgactttcatccatagcccacaacatctcaaccaaatgtttcgtggtaacatcattctcaattccttcagtctcaaggtaactgccacggtcacttccctggggttggcgaggatggtagcgatactcagtgtcggccaattgatcactgtagcgatcacggagctctcctatggcgatccttgccacttcctgacatgcatggatgtaatttcttcctccagcttcaaacatcactgaggggacctcttcactattgctgttcaaggtgactttgactcggcacttctcttcatgacggtcatgaggaatctgggcataaaaaggggcagtcccaaatccaatgacaaaggacatcgtgcgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgaaataaattaaaatagttggaaacgaggtcacaaattttgtaattttgaataactggtttcaaaagaaagttataaaatcaacatactaaatttattttattgcagcaagattaaataaaacagtattgtaaaacttttgctggtaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaagataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccatcccggctgcacagttctatctccaaaccaggaatgtaccattccaaaccaggagctaaacaaattattaccagattaagcatcttttattatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccattgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaaccaaccattaccaggttttagttggcacattaattaattaactaatcacgattgaccatcgtgaactatcaataagccatcatgaaataatagtgaatcattagttatcccataagtgtactaatgtttctaagcagggctaagcaattatatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccggcgcacgggcggcggttcacacgaacggacggctgagattgttccgatccaaatcggacggccgagatcgatcggtccacgaccggctcacgggagaggatcccgatgacgtcaacgatgacatcaccaacgacggcggcggctcggcgaagaagacggctcgggcggcggacactcgccggcgaacggcggcaccacggcaccaacggagggcaccagcacgtagaggacaacgcggcgaacacaccggtgaccaaaacggcggcggagaaggaacggacgacgacggcgacgagaaggaacgggttccgacggctgcgaaggggcggacgaggacggcggcgacttggttagggtttagggtttagggtttagggtttagggtttagggctaccttcgggttgtcgacggcgacgaagctccggcgggttccgacggctgcgaaggggcggacgaggacggcggcgacttggcgatgacgacggcggtcttcccgagcggcggcgacagctggagcgacggcggagcacggctgaagcggcggcggcgaaggcaaagctagggcacacggcgctagggctactccggcgacgagaggcgaaggcgagggtggcgacgggtagaggagacaccgggggtccttttaaaggggctcggaggcggcggcaaaggcccacggcgacggcaacggcgaaggaaaccttcggcttggagagagggaaaaccgatccgaatcgaactcgattccaaagctttccaaagcgatttaaccaaagattccaaaggagaaaaggtagaggagatcccggagatcatttcccctctattgattcggccggagaaggaaaggaacggccggatttggaaagcggcggcgacggcagctcggcggcgcgaaactagggtttcggcccgaggaagacgacgactgacaagcgggacccacctgtcagcgacagcgagggcgcgcgcgcggctgcggactgggccggactgggccgaggagagagagaacggttttgggccgactttcggcccaaagccaaaagaagactttttaaaacctttttcaattaaaattatttcttaaatgcaattccatttattaaaaatactttcttaactcaaataaatcccagaaaaatctaggaattatagaattaagcaaagtatttaatgaaattttatctggcccaattttatattggaatttattaattaaacttagattttcttttcaagacttttaaaataaattctagaaattccatttaaacaacaatttatatattttgaattttcagggtgtgacagggaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggtagagggcctgatgagctaagcgtcaagtggttctcccaggcaaaacaaaaatcgtcggagttggggacaagactgacgaggcttacgatcagttggatgggcaaccccctttcacggctgacgattgaccctagc

SEQ ID NO: 19615 - DNA, 1338 bp, Oryza sativa
  unsure (1)..(1338): unsure at all n locations
nnnnnnnnnnnnnnnnnnnnnnnnnnnnnnnnnnnnnnnnnnnnnnnnnnnnnnnnnnnnnnnatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtaaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaattttccttaattataagtcatannnnnnnnnnnnnnnnnnnnnnnnnnnnnnnnnnnnnnnnnnnnnnnnnnnnnnnnn

SEQ ID NO: 19616 - DNA, 1157 bp, Oryza sativa
  unsure (1)..(1157): unsure at all n locations
nnnnnnnnnnnnnnnnnnnnnnnnnnnnnnnnnnnnnnnnnnnnnnnnnnnnnnnnnncattcatatattagagggtttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcaaaatagcgggaaaagatatttactcccggttggtaataccaaccgggactaaagatcatctttagtcccggttgttctcaacaaccgggagtaaatatcttttctttactcccggttgttctcaacaaccgggactaaagatatctttagtcccggttgttctcaacaaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatctcgatctctccgatctcgatctctctccgtcgcgccgcccgccacgagacgccacgccacgacgacgacgcgccacgccgacgccgcgccaagccgccgccggcacgccacgccgccgtcttcgccgccgcgcgcgcaagggtaccgagctcgaattcgccctata

SEQ ID NO: 19617 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnnnnnnnnnnaacggcctcggacttagttttcttatccaaaataaacagttctgctatattctatgcgcagtcgaccaaagaaccatgatttttttaaaatcgacctggtccaaacggtctcaaacttaatatttttttttgggcaaaataagctttattctatgctcggaagacctgaaaaccaattttttttaaatcgaccaggtccgaatggtcctggacttaatattttttttccaaaataaactatcctactttattctttacgcgatcaaccgaaaattcttgattttttaaaatcgtcccgatctatacggtcctggacttaatattttttctaaaataaaccgttatgctttattctatacgtggttttttaaatctatccggtccggacagaccgaacgtgtaccttttactacctagtagatgttcgacagttttttttaaccataacattcgatatttttagccgcatgatccaacatcaacaacggtgactgttaagtggctaacgggtccacatcaaaatacagtacaacaaacgaagatgatgtccgtaaatctgggagaaaaataggaagttacagtgagttacagcatgtaactgcatgtaattagcatatactataactagtataaatttgccttcaatccttaaaattggatatag

SEQ ID NO: 19618 - DNA, 302 bp, Oryza sativa
  unsure (1)..(302): unsure at all n locations
nnnnnnnnnnnnnnnnnnnnnnnnnnnnnnnnnnnnnnnnnnnnnnnnnnnnnnnnnagagtggagcgaaaatgatggtggcagttgttcagtttaatccaggatgaaatgtgcagatgaaagaggccgggctcgttcacgaattgatctcataacatataggataaaatagcagctgccctggatgtatctgctgtagcagcttatagtcggattggattgtaactgtttaaggttctcttctttatctcccagtttcggcagcctgtgcaacggttgtggtcttctttctctcccccccc

SEQ ID NO: 19619 - DNA, 681 bp, Oryza sativa
  unsure (1)..(681): unsure at all n locations
nnnnnnnnnnnnnnnnnnnnnnnnnnnnnnnnnnnnnnnnnnnnnnnnnnnnnnnnnnnnnntgcttaaatgatgatgcggaagagagaagagaagagagaggagaagccacccctcacgcaaggggcaacctccacacaaacttcaagaacaagagaaaattagaggagttgattggtggcaagtgtactgggactagggtattaaatgcaatacatctatataggctagggatggataattggataaaattggaggtgaccaccacatcttttataaaacttgcccttagttctgaggagacgtactacggtacatataacttcaagtcatataaaagtttcaaaaccttaccttcattatttctagctctccaagggtgagtaattaatggtacaaaaagtctatgtagaaatcatagcacatttattttcactatttaattcagatcaacccaagaagttgatgatactatatgagagaaatttaattatgaccaccttgtatatataacatagaagggcaataaccgcatcatatttcctggtccttctatataccaccccttctttcagtattcagttcactatgcatcacaaattcacttcctgtcaaatgtcaatagacataataggtaagtactgtagcaagtgaaaagcaagacagtatgtggtaagagga

SEQ ID NO: 19620 - DNA, 882 bp, Oryza sativa
tactccatcacaaagcaagatgatgtaaacttggaatctctatcttctctctcccattttgtttgttggctattgcttgctatttgctccaacttgcaatgagaaaccatgcgctgaaaaggaagggctgtatcctaaatttgatggggtatataaagagttggaaaaacttttttattgaagatggtacaatgttttttttttgttctgctgatcgaatgaaatggaatgctttaaaaacataaaataagctttatcattcttagccaattacatcaagataatataattactctaagactacttttggcattaacataactagaatgcacatacaacctattattattacataaagagaaatattatgccgcagcagactataacacaagctatttcttcctaacaccccacagcagcaacacttgggctgcaaaacaaaaaaggctgtcctaacgatgcctccgagaaagaaaatgacactcaaacgtgctgccattgccatgaccgaacctgtaaaggccaaaacatatgtttctccttcattagagagcaaatctttgactctaggcagtgcctgtaacatggaagggaaacaccattggcaggaacaaccagctaagggctgtcctaggaaaagatgatttgtagaggcatgatatattttcatatgcttataatatcttttcatattatcttttcattatgtgtcccatggagctccttatctaccgatttgcaaaataggctatattttatagatatttggttgttaaacctcgaggcattttgtggacctcagtttccgtttgaggtgtagccttatcagcctcaacctgcttcagttactttgaggcagagataatcttttgaggcagtgtt

SEQ ID NO: 19621 - DNA, 702 bp, Oryza sativa
  unsure (1)..(702): unsure at all n locations
nnnnnnnnnnnnnnnnnnnnnnnnnnnnnnnnnnnnnnttacttcagtgtactgatcaggagaaggtctcatttgcatcacatcagttgcatggccctgcctctgaatggtgggatcacttccgccttaacaggactactgatgaacctatcacttggcttgaattcaccgctgctttccgaaagacgcatataccatcgggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtataatcgcatggagcagaagaaacgtcggattgctcaattcaagacacaacagggaaataatcagaagccgcgtcttactttaggaccccagcccatgtcacagggaggttcttcgtctgttgttcgtccgcagcgtcagttcttcaacaacaatgctggcaacaacatccgtaatcaagctccacgtcctgttgcagctccagcacagcaacaacctgccaagagggagcaaggcaacaagccccgggtgtgtttca

SEQ ID NO: 19622 - DNA, 372 bp, Oryza sativa
  unsure (1)..(372): unsure at all n locations
aaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaannnnnnnnnnnnnnnnnnnnnnnnnnnnnnnnnnnnnnnnn

SEQ ID NO: 19623 - DNA, 575 bp, Oryza sativa
  unsure (1)..(575): unsure at all n locations
nnnnnnnnnnnnnnnnnnnnnnnnnnnnnnnnnnnnnnttggtggcaagtgtactgggactagggtattaaatgcaatacatctatataggctagggatggataattggataaaattggaggtgaccaccacatcttttataaaacttgcccttagttctgaggagacgtactacggtacatataacttcaagtcatataaaagtttcaaaaccttaccttcattatttctagctctccaagggtgagtaattaatggtacaaaaagtctatgtagaaatcatagcacatttattttcactatttaattcagatcaacccaagaagttgatgatactatatgagagaaatttaattatgaccaccttgtatatataacataaaagggcaataaccgcatcatatttcctggcccttctatataccaccccttctttcagtattcagttcactatgcatcacaaatccacttccttgcaaatgtcaatagacataataagtaagtactgtagcaagtgaaaaagcaagaaagtatgtggtcagaggaggaggattaaagaaatcaatagagatcga

SEQ ID NO: 19624 - DNA, 617 bp, Oryza sativa
  unsure (1)..(617): unsure at all n locations
nnnnnnnnnnnnnnnnnnnnnnnnnnnnnnnnnnnnnnnnnnnnnnnnnnnnnnnnnnnnnnnnntgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtagaaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccatgccgtttgcacgcaccggatttttcggaacgtttccaaaacaaaaacgaatccg

SEQ ID NO: 19625 - DNA, 2124 bp, Oryza sativa
  unsure (1)..(2124): unsure at all n locations
gaacgaacatgagtgttagtgaacgaatgcaaacgaaggtgaacgaacgcgaacgaacgcttaacgaatgcgaacgaacgtgaacgaacgcgaacgaaacgttaaagaaacgtgaacgaacgcgaacgaaacgtgaacgaacgcgaacgaacgcgaacgagcgtgactgaaacatgaacgagcgtgagtgttagtgaacgaacgccaacaaaggtgaacgaatgcgaacgaacgcttaacgaacgcgatcgaacgtgaacgaacgcgaacgaaacgttaaagaaacgcgaacgaaacagcgaacaaaacgtgaacgaacgtgaacgaacgcaaacgaacgtgactgaaacgtgaacgaatgcgaacgaacgtgaatgaaacgcaaacgaacgtgattgaaacgttaacgaacgtgaatgcacttgaactaaaagtgtgagaacgaacgcgagcgaaatgtgtacgaacgagataattaaactattgttgaacttagcatatatatatatgattatatatacttgaaaacgtgaaatacattatatgttcctttgcatttagactagtacattttttttgcatgttgcagagaagacgtcgctgtcgttgtccctcaagccgaagtggtagctagccctcgaaggaattcgtgcaggcaagtgatgtaaagatgtgattgttacagatataatataagattgttagatttctaatataagattattagattattagagttagcatatgtgagtgttagagattattagattattagacttagcatatttgagtgttagagatagttagagatttaatataagattattagaggtttaatatacgaaacttaattagacttagcatatgtgagtgttagagatttaatataagattattagagatgtaatattcgaaacttaattagacttagcatatatgattatctatcgtacaaatacacgacacttagacatagcatatttgagtgttagagatagttagagatttaatataagattattagaggtttaatatacgaaacttaattagacttagcatatgtgagtgttagagatttaatataagattattagagatgtaatattcaaaacatatttgattgttagagatttaatataagattattagagatgtaatattcgaaacttaattagacttagcatatatgattatctaccgtacaaatacacgacacttagacttagcatatatgattatttgagttttaatacaagattagtagagtgttaatattacgcttagcaaatatttcttctatgaacagatggctgatcacgatgaggaacatatactgtacgatacaatcgcatcgggaagcagccagtgctggaacgaagaagacgggaacgaggatccaaaccagtacttgaacaaggagggaaacgcagagagggatgcagaggggaacgaggaggggaatggggagagggatgcagaggggaacgaggaggaggctagtggaagtcatccctccgctagacagaagagggcacgcgaacaacgagatgccgcgaagaagatagagggtcggcacatcataactgaggtggacgcagacggccgacctagtgccccggcacaagcagccaagaattttgtacgccacagcggttgggttgtgagggataacgtgcctgtcagcaaggtgtactagcgcagaacaaaggcacgcgggggtgatgacagctttgtcccggaatcagagaaagagatgctgtggaccacaatgctcaagatgttcacgctccctacaggtacagagaacatagtgaaacagtggactcttaagaaaatggcagaacggttccagaccttcaagggagatctgtaccggaaatacatcctgaaggggcagacaccgaacttcgacgtattcccgaagctaagggatcactgggacaagttcgttgcttacaagacaggtcaacaagggcaggcgatgatggaaagaaacaaagaaaatgctgccaagaagaagtaccatcaccacttggggtcaagcggctatagcgtcgcgatgccgaagtgggaggagatggaggcnnnnnnnnnnnnnnnnnnnnnnnnnnnnnnnnnnnnnnn

SEQ ID NO: 19626 - DNA, 2292 bp, Oryza sativa
gaggagctatctacctatgtaatgacagtttattcgcttataaattagagtaatagattgtactctattatcgatttgttattgtgtgcctcggctgattcctggacgagggttcacgcacatgtaagcgtttggaattttggatagaaattccgggcgtgacaagttggtatcagagcccccttgaccctaggttatgccaaatggttatccatagaagccctctaaaaatattggaaaagtagaactgttctcctccccttctcttttaattaaaccgaactaatggcacatgcacttcataatctcttttaatggttctcattcaaaatttattccagtgttattagtactgtacatccattactgtactaatggctcattttaccagcaaaagttttacaatattgttttatttaatcttgctgcaataaaataaatttagcatgatgattttataactttcttttatttcttttgaaacctgttgttcaaaagtacaaaaattgtaactttgtttccaactgtttcaacttattttgcaagcttggtttattttatttacttacctatttactttgattttctaactttattcaaattaatccaaaaacttgtgctattaattggataaatgtcttaactccctcctttcacttgtctttagatgccgcgctacaagcctgagtacttgtttggtgttgagggttttgtctaggagttgcgtacgatgtcctttgtcattggatttgggactgcccctttttatgctcagattcctcatgatcgtcatgaagagaagtgccgagtcaaagtcaccttgaacagtaatagcgaagatatcccctcagtgatgttcgaagctggaggaagaaactacatccatgcatgtcaggaagtggcaaggatcgccataggagagctccgcgatcgctacagtgatcagttggccgacactgagtatcgctaccatcctcgccaaccccagggaagtgaccgtggcaactaccttgagactgaaggaattgagaatgatgctactacaagacatttggttgagatgctgtgggctatggatgaaagtcgtgcggagactgtgttagcagctcaggatcatgaagattggaatcgtggtaagatttgcaagctagaagacaaggtggatcgtttggagaaggagctagccgcgttgaagggagaagcaccgccgcagaaggccaggattcgtcttaccgcaagaaagagagctctatttgtccctcgctatcaattggcgccaaaggttcgtgtggtggagaaagaagttgccccaaccctagcagatcctccggtcatcatcataagtgatgatgatgaagaagaatccaagcgcaaccattccaagattgagtgggtagcaactcaagatgatgaagacgagccgaacgagccttcaatcgacctccgatgctcggaagaactagagtgacttgttaagtcgttgtcatagatcgttgtgttagtttgcttgttttaagtttgcttgtgtgtgtctcgcatgtgatttacatcagtggtgggatgtaagtgcatgcgtttatttgcttttgagtgttaggaagttggtgagtttagtggtgtgagagttttcagtttgtaataatgaaactcagttaagatcaataaaagttaaagtaattccctgtcctaagtagtttcccccggtttcccttcttgtgccctgtccatgccagatggtgaacactcgcagcaacgggaatggccccaacaaccccaataacaacaacaatggagagaatcccactcttgctcaagttcttgctcaacagacacagctaatgaacatgatgatgcagcaactccagaaccagcaaaaccaaggaaataaccatgcacctccccagaacaagttagcagaatttcttcgtgtgaggccgcctattttctctagtaccactaatcctgttgaagctggtgattggttgcatgccatagagaagaagttggatttgcttcagtgcactgattaggagaaggtctcatttgcatcacatcagttgcatggtcctgcctccgaatggtgggatcactttcgccttaacaggactactgctgaacctatcacttggcttgaattcaccgctgctttccggaagacgcatataccatcgggagtggtgtctctcaagaagaaggaattcaggtcgctcactcagggatctcgctctgttacggagtatttgcacgagttcaatcgtctggctcgttatgctccggaagatgtgcgcaatg

SEQ ID NO: 19627 - DNA, 1749 bp, Oryza sativa
ctcagtcggaggagttgccgttgatcctagtaatgtggaatccgtaaccaactagaaacaaccgaagacagtttcagagatctgcagtttcttaggcctcgcaggatattatcggaggtttatagagaatttttccaagattgctaagcccatgacacgactgcttcagaaagatgtgaagtacaagtggtcggaagaatgtgagcagagttttcaagagttgaagaatcgcttgatatcagctcctattttgattttacctgatccaaagaagggtttccaggtgtattgcgatgcatctaaacttgggttaggttgtgttctgatgcaggacgggaaggtggttgcctatgcatctcgtcagttacgtccgcatgaaaagaactaccctactcatgatcttgaattggccgcagtagttcatgcgttgaaaatttggcgtcattatcttttcggtactcgtacagaggtatataccgatcacaagagtttaaagtatatctttactcagccggatctgaacatgagacaaaggagatggttggaattaattaaggactatgacatgggaatctgtgtccccgataacaaagatttaaaagatgcaattctgaaagaagcccatgataccttatactccattcaccctggtagtacaaaaatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaaatgggaagaaatcggtatggattttatcactggtttacccagaacgtcatcaggccacgactctatttgggtgatagtcgatagacttaccaaagtggctcatttcatcccggtaaagacaacctattccggaagtcggttggcggaattgtatatggcaaggatcgtgtgtttgcatggcgtccctaagaaaatagtgtctgatcgaggcagtcagtttacttcaaatttttggaagaagcttcaggaagagatgggttctaaattgaactttagtactgcttatcatccgcagacagacggacaaaccgaaagggtgaatcagattttggaagatatgttgagagcttgtgctttagatttcggtggaagttgggataagaatctaccttatgcagaattttcgtacaacaacagttatcaagctagtcttcagatggctccttacgaagcactgtatggtcggaagtgccgcactccgcttttgtgggatcgaacgggagaacgtcaggttttcgggacggatatcctaagggaagcagaagaaaaggtgaaaatcattcaagaaagattgcgtgtggcccagtcgcattataagagttatgccgacaatcgccgcagagatttgagttttgaagaaggggattatgtgtatcttcgtgtcacgcctcttcgaggagttcatcgttttcacaccaaaggaaaattggcaccgcgttttgtgggaccttatatgattgtcagtagaagaggagaggttgcttatcagttggagttacctcaatctttggcaggagtccataatgtgttccatgtgtcgcaattgaagaagtgtttaagggtacctaccgaagaagctaatcttgaacagatagaagtccaagaggatctgacctatgttgagaaaccatccgtatcttggaaacaaatgagaga

SEQ ID NO: 19628 - DNA, 7749 bp, Oryza sativa
ctgagtatcgctatcatcctcgtcaaccacagggaagtgaccgtggcagctaccttgagactgaaggaattgagaatgatgctaccacaaggcatttggttgagatgctgtgggctatggatgaaagtcgtgcggagactgtgttagcagctcaagatcgtgaagaccagaatcgtggtaagatttgcaagctcgaagacaaggtggatcgtttggagaaggaattagccgcgttaaagggagaagcaccgccgcagaaggccaggattcgtctcaccgcaaggaagagagctttatttgtcccacgctatcaattggtgccaaaggttcgtgtggtggagaaagaagttgccccagctcaagcggatcctccggtcatcatcataagtgatgaagaagaagaatccaagcgcaaccattccaagattgagtgggtagcaacccaagatgatgaagacgagccgaacgagccttcaatcgacctccgatgcttggaagaactagagtgacttgttaagtagttgtcttagatcattgtgttagtttgtttgctttaagtttgcttgtgtgtggctcgcatgtgatttacatcagtggtgggatgtaattgtgtcacgtcctgataaattcatcccgaaataaaaatcattccctaaaaggaataatagaattaattaaaattcgaaaagaaattggcaaacactaaaatacgtgcaagaaaaattcaaatgtagcccggagaatttttgttaaattctccttggtctaaaaggagccctcaaattttacttgaatttttagagcaccggaaataattattaagcaaaaaaaacaattaacaaagtttattaaaaagaaaaaaacctaaaaataaccccacaatcaacttattgggccaagtcaggcccaaagtcctaccctctctcccctcggcccgcggccgaagtctccctttcctccctgtctttctctccctctccttctctccctcctcttgggccccccttcccctcggcccagctccctcctccctctctctcccgggctgcctctcccccccccctctcccctcccggcctgcccggcccaggccgcctccccctcctctcctcctgggccggccgcccggcccaacccgagcggcgccctcccgcccgtgccgcgcgcgtgcgcgcgctgacgccgccgcctgaccgcgtggggcccacgcgccaggccgagtcatcgtcctcctcccgcccggccgtcctctctccctctcccgtgaaccctagcaccattcctcccttaaatccgcgcgaatcaagcttgggattcccaaattgattggggggaattaatcccctttcctcctctctctttcccccttaatttccccgtgaatggcgcccccaatcgccgggaacggccgcgccattcccggccgccttccattgccgccggccgtggttcccgccgccgttcccgctcctcccgtggccggctctctcccccatcctataaaatgggatcctcatcccccgttctctcgttttagccccctcccgagcctccccgtggtccctagccatctccccgccgccctcctctctctcccacgccgccggccgcctccagccgcctgtgccgcctcgaccgtgcgccggccggtcgcgccgtcgcctcctccagcgtcgccgccacctcctccaccccggcctgccctccgtttcgcgcggtgaccaccggaggcgcgttcccgccatcgcccttctctttcctccgcgccggccgcctccagccgcctctccctcctcgccggagcaccgtccggccgcaccgtcttctccctcggcctcgcagccacctcctctccctcggtcagccctccgtttcgcgggggaagcaccggagacgcatcctcgccggcaaaacagtggcgttgccgccactgttccaccttcggccgccactgtcgcgtttcccgtgcaccggccgacgtcgccaccacctccctcggctccgcgacgccgccctcatccccggcatcacctcctcctcgcccgaagttcgccggaacgccgccgccgcgccaaccacccattcctcctcgtcggctcgtcgccccgctgcaccaccaccttctccaacatcgcagcagcgcgttccacgccgtcccctcctccgctcagccgctgctgcctgccatcatcgttttcctcgtcaccgttcgtcctcgccgatcgacgtcccgtcggtcgcccggctcgtcgtctcgcggcgccgcctccgtcatcgtcatcgctgcggcgtgttccacgccgtcctcgtctccgtgcagccgctgccggctgccctcgtcgcctcctcgccggttccggtcgtcgtcgtcgtcgtcctctcgtcgttcccggtttcgctcgtcgtggcgttcgtccctccgtcaagccgttctcgtccgtcgtccgcgttcgtccagtgtgccgctgcagcccccgtcgtcgtcttcgtcctcggctccgtgtcgtcaagcctagtgccggccgcgtctcgccttcgttcaaggatcgccgccgaagtcgttccctcgccgtccgtctccgccgcgcccgttcgtcgttgtcgttcccacgcctcgtcgcgtggtggtaaggtttcctcctctcgctgccccgtcctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtttagtggagtccgtttgtcggccactcgcctcggttgacacacgggatccgcttccgtcgaaccgtggaccgactctgtgtactcggtctaccgcggtcctttaggttgacatgtggggtccgcatgtcaacggcgcagccttcctgtcttttccaggctagcgcttacacatgttttataattgcaaagcttaattataataatccgcaaatctccatataacagcattaaacttcggatgatcatatcctggtcatacgagctccgaatcgacccgttcaagtctcctaatgtttgttataacctaaagaaccctgtgctttctttttatgtattgttattgcttctttataggcttgtagctttgcttgtgtgctttgcgtagcttctgtcgttccggaggttcccgaagcgtggttcgcggtcgccgccgaaggttcggaaggccgttctctctgagcaaggcaagtcacatcatccttgagcatattgaatcccagtttataaaattattttgatttaaattaatgcattatcgctttatttaaattcccgcgttatcactgtcttatttagccatgcctatttacctttgttaagacattattattgctattgttattattatcttgttcaccctaggaagataaaaccccagctagtgggtactctattcaaagttccactagtatgaatttaggtagatgcttcgctgattaattaggcaacagtaggtggttttataactttagactttgggaattttcatatcacttggatactttggaatggttggcttttgttggaattggacacacacctccccctctattcaaaacccccaaaatggttttaggctgggctcgaggtgcgtggttgggttttgttagtcgtacctcgggtactataaggattaagctcgggcctctgttgcaaagcactaccgtacttccacatgtctagtggtaaggcttagtttgtggctcagtctggttataaacaaaagtacacggattagagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcatgtggttgcacgtgaggaagatgtgtcttgtgggtaaagttgtacacctctgatcagagtataatctattcgaatagccgcgccctcggttatgggcatgccgagcaatgtacccaggtcagtgttttaattcttaaatttgctcaacaactaaaaggtggaatggttggtctgggttggcttgggacgagctgggacccagggtcgggttgccagctcggtctgaatcatcgtaggccttgggtaaggcaggttcgtggggttcacggccttgattaataatactgtgtagctctaggatcgtctttataaaatggctttgggcaactaaggtgacttttaaatgctgtttactgcaaaacttaacccctatattattaccccttgtacccccttgcattaatcatgcatctgccggtgtggcttgctgagtactgtggttgtactcattcttgctcaatctttccccccttcagtaagagaagctttggagaagtagtcttaggtggagtcctggcttataccccagttgagcgcctgtgaagatggagccgtaggcccgctagtccgctgctgtttattttttattgtcaggcctgaagcgcctttgtaataatgtaaatattatcgatataataaagatgtgctttttgtatcatgtttgtttggtgtaccccggcttttcctgggacggggattaatacactagcgttcgggaaaaggcaattttctcggtcgcgacaaattgcatgtgtttgtttgcttttgagtgttaggaagttggtgagtttagtggtgtgagagtcttcagtttgtaataatgaaactcagttaagatcaataaaagctaaagtaattctctatcctaagtagtttcccccgttttctcttcttatcctgtccataccagatggtgaacactcgcagcaatgggaatggccctaacaaccccaataacaataacaatggagagaacccaactctggcccaagttcttgctcaacagacacaactcatgaacttgatgaataaggtgtttatggaatacctagacaagtttgtggtggtctttattgatgacattcttatctactctcgaaccaaagaagagcatgaagaacatcttcgccttacattggagaagctacgagaacatcaactgtatgctaagtttagcaagtgtgaattttggttgtctgaagtgaaattccttggtcacgtcatctcagccggaggagttgccgttgatcctagtaatgtggaatccgtaaccaactggaaacaaccaaagacagtttcagagattcgcagtttcctaggcctcgcaggatattaccggaggtttatagagaatttttccaagattgctaagcccatgacacgactgcttcagaaagatgtgaagtacaagtggtcggaagaatgtgagcagagttttcaagagttgaaaagtcgcttagtatcagctcctattttgattttgcctgatccaaagaagggtttccaagtgtattgcgatgcatccaaacttgggttaggttgtgttctaatgcaagatgggaaggtggttgcctatgcatctcgtcagttatgtccgcatgagaagaactaccctactcatgatcttgagttagccgcagtagttcatgcgttgaaaatctggcgtcattatcttttcggtactcgtacggagatgtacaccgatcacaagagtttaaagtatatttttactcagccggatctgaacatgagacaacggagatggttggaattaattaaggattatgacatgggaattcattatcacccaggaaaggctaatgttgtagcagatgctcttagcaggaaaggttattgcaatgctacagaaggacgacagttgccattggcgttatgcaaggaatttgaaagattaaatttgggaattgtcaatagaggtttcgttgcagctttagaagcgaagcccactctaattgatcaagttagagaagcccaaattaatgatcctgatattcaagaaatcaagaagaatatgagaagaggaaaagctatcggtttcttggaggatgagcaaggaactgtatggttgggtgaaagaatctgtgtccccgataacaaagatttgaaagatgcaattctgaaagaagctcatgatactttatactccattcaccctggtagtaccaagatgtaccaggatctcaaggaaagattttggtgggcaagtatgaggcgtgaaatcgcagagtacgtagcagtatgtgatgtttgtcagcgagtcaaggcggaacatcagaaacccgccggtttgttgcagcctttgaagattcctgaatggaaatgggaagaaattggtatggattttattactggtttacctagaacgtcatcaggccatgactctatttgggtaatagtcgacagacttaccaaagtggctcatttcattccggtaaagacaacctattctggaagtcgattggcggaattgtatatggcaaggattgtgtgtttgcatggcgtccctaagaagatagtgtttgatcgaggcagtcaatttacttcaaatttttggaagaaacttcaggaagagatgggttctaagctgaattttagtactgcttatcatccgcagacagacggacaaaccgaaagggtaaatcagattttggaagacatgttgagagcttgtgctttagacttcggtggaagttgggataagaatctaccctatgcagaattttcatacaacaacagttatcaagctagtctacagatggctccttacgaagcgctgtatggtcggaagtgccgcactccgcttttgtgggatcaaacgggagaacggcaggttttcgggacggatatcctaagagaagcagaagaaaaggtaaagatcattcaggaaagattgcgagtggctcaatctcgtcataagagttatgccgacaatcgccgtagggatttgagttttgaagaaggagattatgtgtatcttcgtgtcacgccttttcgaggagttcatcgttttcgtaccaaaggaaaattggcaccgcgttttgtgggaccttataagattgtcagtagaagaggagaggtcgcttatcagttggagttacctcaatctttggcaggagtccataatgtgttccatgtgtcgcaattgaagaagtgtttaagggtacctaccgaagaagctaatcttgaacagatagaagtccaagaggatctgacctatgttgagaaaccaatccgtatcttggaaacaagtgagagaagaaccaggaatcgagttatccgtttttgtaaagtccaatggagtaatcactcggaagaagaatcaacttgggaacgagaagatgaattgaagtcagctcatccgcatttgttcgccagttcttccgaatctcgaggacgagattctgtttaaggggggtaggtttgtcacaccctgaaaattcaaaatatataaattgttgttcaattggaatttttagaaataattttaaaaagtcttgaaaagaaaatctaattttaattaataaattccaatataaaatgggcccagataaaatttcattaaatacattgcttaattctataattcctagatttttctgggatttatttgagctaagaaagtatttttaataaatggaattg

SEQ ID NO: 19629 - DNA, 1598 bp, Oryza sativa
gccgaaccttccttcctcgtcgccggtcgccgtgggcctttgccgccgcctccgagcccctttaaaaggacccccggtgtctcctctacccgtcgccgccttcgccttcgcctctcgtcgtcggaaaagccctagcgccgtgtgccctagctttgccgtcgccgccgccgctccagccgtgcttcgccgtcgctccagccgtcgccgtcgctcgggaagaccgccgtcgtggtcgccgtcgcgtcgccgtcctcgtccgccccttcgctgtcgccggagatcgccggagcatcgtcgccgtcgtcaagccgaagagcgccgtcgtttcaatctcgtcgccgtcgccgtccgttcctcttccgccgtcgctttggtcgccggtgagttcgccgtgccgtccgctacccgttggtgccctccgttcgtgccgtagcgccgccgtttgccggcaagcgtgcgccgcccgagccgttcgctccgccgagccgccgccgctgtcggtgacgtcaccgctaacgtcatcggggtcgtccgccgtgagccggtcgtggaccgatcgatctcggccgtccatcttggatcagttagatctcggccgtccgttcgcgtgaaccgccgcccgtgcgcccggtccaccaaaaccctagccgctgacgcaataaaccttctcttccttttcaaaattaattcattattgcgtcataattcaattttaaccaatttaagtgttttaatccggtttaatctttaaaaattcataactaattcatcttagctccgatttagttggttcaagtctctaaatttttctaaaattgagatctacacattaaaaatatccacatgtactgttcatgcttgtttatgtgctattttggtgatttggttcttttctgcttagattccgtcgtttccggagagtccgttttcgccgaagaagagtttgaagagttccaaggccagcaaggcaagtcacacagatcccaaacaaccctttgagcatgttgatcctatttaaagctattgtttcttttcaactattgcatttattttcgaatgtcattgggtggaatcaacctattctttgttatagcccttttgttcttgattactttattccttgataccttgggttattataatttgactggttgaactttatttatattggttcaactagatactagatataattgcttagccctgcttagaaacattagcacactatttggataactaatgactcactgttgtttcatgatggcttaatgatagttcacgatggtcgatcgtgattagttaattaaataatgtgccaactaaaacttgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgtgaagtggcggagataagcccacgggggtcgctggggagtccatgccttgtttataagggggtgattatgatccaggaaagtgcgctgcagtggattgtgttatg

SEQ ID NO: 19630 - DNA, 2812 bp, Oryza sativa
tgatcggctttcaatctcagcaaagatgtaaaaggctctaatcttccagataagttagatataaaccttctaacaaaatttatcttgctgatcaactcctgcaactttgtgcttgtcctccagaggttgaatgttctgaattgcattaatactcctttgaggcacctcaatccccctgtcatgaataagaaatcccaaaaactgactagccgacacaccaaaagcacattttgttgggttcatcttcaaaccaaactttcgagttctctcaaaaactttcctcaaatcggctatgtggttttcgatttcctttgatttaacaaccacatcatcaatataaacctcaactaaaccagctgatcagatcatgaaatatatataattcatggctctttgatatgtggcctccgcactcttcaagccaaaagtcattacaacctactcaaacaagccgatcgcaacaggacatctaaaagctatctgatgaatgtcttcttcggccataaaaatttgattgtaacctgcattgccatccataaaacttaaaatcttatgtcctgaagcagcatcaaccaactgatcggctattggccttgggtactcgtccttgggatctcgaaaatcaatgcacaccctaactttgccattcttcttgataactggaactatatttgaaacccattcagcatatcggcatagacgaataaaaccaacatcatacaaacgcttcacttcagccttgacagcctcaagcatatcggctttgcacctccttggtggctactggtacggccgaattccaggcttaataggaagccgatgtacaacaatcgatcggctgagtcctggcatctcataatacccccaagcaaagcaatctctgtattcttttaaaagctctatcaacttggttctaaattctgaagataaattcttactaataaatgtcggccgtggtctgcctcccggacctatgtcaatttcttccaaatcgtcagccgacatgaaaccctgtccttgcttggcatcgagatcgtctaccgtgtccttgttgtagacgtttgaaccctccacaatgccctcaaagtaataatttgggctctccatcttcaattggttgtatatcacaatcggacacctttagaaaatctccatcccaaacttttccagacaagcaatcaataccgtccatctcccaaagagctaaatcagcattagcaacattaactgacctgtcggctggtacaatttcaatcttgtcaccttgccattgaatcaagcactgatgcatggttgaaggaatacaacgattagcatgaatccaatcccttccaagcaacaggctgtaagaaccctttccatcgatgacaagaaacgttgtaggaacagttttactgccaactgtcaactccacatttaaaactcttttggtttctgatggattgccaccaaaatctttgagaaccatattggtcttaatgagatcatctggatttctgcccaacttcctgaatgtagcatatggcattaaattcacagcagctcctccatcaaccatcattttggacatcggcttcccattgacaaacccattaatatacaaaggcttgagatgccgattttctgtcactcctggcttctcaaaaattgcttgctctggtgacaaaactaacttagccaaagcctcttcaacaccatcaacctcagcttgcttagcttcaaattcggctggtagcgtaaaaaccatgttcaccgatgcagatgcaacggccttacccttgagcaaccttcttgctttatcggtttcgacttcatcggctgttgtaactgtgctcttaacgtgccactcttgcctagtctttgttttcttcagccgatgattaatctcctgtcgtacttcctgaaattgttctctgtcacgcccggaatttctatccaaaattccaaacgcttacatgtgcgtgaaccctcgtccaggaatcagccgaggcacacaataacaaattaataatagagtacaattattactctaattaataagcgaataaaatgtcattacagaggtagatagttcctctcaaccaataaggatctaagcagcggaaaataaaataaacggcgcagacggctccactccacaggcagcttgaccaaggctactcctaatcctccactccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaacaaaacagttaagtattaattaagcaatattaatccaacgctatacaacataccctgttgtataggcccaaccattctgaacaaccatcccggctgcacagttctatctccaaaccaggaatataccattccaaaccaggagctaatcaaattattaccaattatagcatcatttactatggtgagaagggtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgcataacacaatccactgcagcgcactttcctggatcataatcacccccttataaacaaggcatggactcccagcgacccccgtgggcttatctcgccac

SEQ ID NO: 19631 - DNA, 4261 bp, Oryza sativa
tgaacaacaggtttcaaaagaaataaaagaaagttataaaatcaacatgctaaatttattttattgcagcaagattaaataaaacaacattgtaaaacttttgctgataaatgagccattagtacagtaatggatgtacagtactaataacactggaataaattttgaatgagaaccattaaaagagattatgaagtgcatgtgccattagtttggtttaattaaaagagaaagggaggagaacagttctacttttccaatatttttagagggcttctatgagtaaccatttggcataacctagggtcaagggggctctgataccaacttgtcacgcccggaatttctatccaaaattccaaacgcttacttgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccaaagctacacctaatcctccacaccatcagcaacactgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttaataaaatagttaactaattaaacaatattaatccaacgctatacaacataccctgttgtataggcccaaccattctgaacaaccatcccggctgcacagttatatctccaaaccaggaatataccattccaaaccaggagctaatcaaattattaccaattatagcatcatttactatggtgagaagtgtgggactaatcacgaaagacattgttagacccgcccataactgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcacctttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgattaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcactaaataatagtgagtcataagttatcccattagtgagctaatgtttctaagcagggctaatgtcacgcccagaaattcccgaatagaatttcaagcagaatgtgcattaaaatccccgtccaggaccagccggggtacacaaacgacaatgttgacatacagatccacgtcttacaaacatcataaagtcttacataaatgtagcggaagaaaagaaagacaacaggagctaagccttgactaaactgcagcgggaacaccactccacaggcatcctcgacggcacggacgaagcctactcctctgagaaaccttcatctgacccgaactcgaactctgaggttgggaaaagtagagcaagactgagtactacccactgtactcagcaagtcataccggaataggggtatgatgcagggaatcatcaaagaagagctgaagtggttcatttgcataaagcgagcatttataaacagaaattgaaagatttaaacagttgtaaaaattaattaatactaatcatccgctgtccaacgctaacccacgttgcaacaggcccaaccatccacctaaactatccaaattaaaggattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgccaccatgacgtaccggaaagaggccgtgacaggacccttcgcataaccccctctagccaagcacaccacacctcaggtttcacccccgtccccagcgggcaacgggcagtcccctcttgtgcctaggtgaatccggaagtgacagaggccgtcgcagggcccgccccgctccatcacgcccacccttgcctggatgcgtcgactagaggaacgctacactacaagcccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaagcggtggtactaatccaacaaaccattagaaccaacagtctaaacattaatatgattttccccattgtgaactagttgaactaagcatggctaagcaattcctagtccaaactctaatcatgttataaccccaagctaacaaaggagcatggtatccaaaaagcatggctataacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatctcgaagtacaccggagcatcggaggaatcggaatctagcgacatacaaagaaaacattgcaaacaagctataagactactgaaacagagaacaaaaccatttttaatggattctacacatttttcttgatttactgagacttgaatgggcttaaacggagctcggatgaattagttatgaattttagaagattcactgggtttattactataaaagaaaaaccctaaatcatttattgcgcaatatattccagggctgacgtcagcacggaggggggtgcggcgccgacatgcggggcccaccggtcagcggctcgggagagggaggaaggggcgccggcaagcgggacccgcatggcagtgactcgggagagggcggtccacggcggatcgggtccacggaccggggaggagcggcgcaccacgtggcggccgaaccgatggcctcgatctacccaagggtagatcggacggcggcgggagctcgcggccggggcgcgcgggcacggcgcaaaccggcccggcggccatggcgcgcgacggcgcggcgcgcttgcggcagcggcgcaagacggcggccggcggcgaaggcgacggcgcagaaggcaacgcgaaggcggctgcgctaagcggcggctaggaaggggagggaacgggcggcgataaaggcggccgccggctcggctcggcatcaaagccgaccggccggccaggtctagcggcgacggcatgcggccgacgacggcggcgaccggcggcactggaggcggcggcggcggccgaaggcgacggcgcgcgactcgaagcggcggcgcggcactaagaggagaggaaggggaaaagaggggagggggtgcctcaccgagggtggccggcgcggagaagacgatggcgaacggcgacggcaagccacgggaggacgacgtcggcgggcggacgagcttcggggtgccctaaggaaggagaagagagggattagagagagggagatggaccacggcgatcggaaaccatggccgaaggcggcggtggagttggtgctcacccgagtgcgagggaacgagggctccggcgacgaacctcgacggaggaggggtggacggggtggatctcggccacgcgaacccgacggcggcgacggcgcggcctggcggcgaccctaacggcggctagcggtggccggagtagcggaaaaggcggcggcaaggggttgcacggcgcgggagcgatgggaggctcgagagagtgcggcgaaatggggaaaaagtgagaggggacgacggcgatgcttaaatagggggagaggagaccggacgtggccgggagaggcggggaatcgccggccgacgtgggggagtgggg

SEQ ID NO: 19632 - DNA, 3052 bp, Oryza sativa
tgcgggcgcgacggcgcgagcgagatcggcggaaggtgggggaaggacccgacaggtgggccccacctgtcggcgaccccgggagaggagggcggcgggcggcctggctgggcctcggcctgcggccggcccagcaaggaggagggggaaggaaaggagagaatgggccggcggcccattcgaaaaaggaggaaaaagagagaaaaagaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcttgatttcacctgcattttcttggggtcgttttaaaaaaaattttaggcttgggaggagaacttcggggtgtgacagctaagcaattatatctaatatctaattgaaccaatataaataaagctcaactagtcaaattataataacccaaggtatcaaggaataaagtaatcaagaacaaaagggctataacaaacaatatgttaattccacccaatgacattcgaaaataaatgcaatagttgaaaagaaacaatagctttaaatatgatcaacatgctcaaagggttgtttgggatctgtgtgacttgccttgctggccttggaactcttcaaaatcttctcctgcgaaaatggactctccggaaacgacggaatctaagcagaaaagagcaaaatcaccaaaacagcacataaacaagcatgaacagtacatgtagatatttttaatatgtagatctcaattttagaaaaatttagagacttgaaccaactaaatcggagctaagatgaattagttatgaatttttgaagattaaatcggattaaaacacttgttttgattttaattgaattatgacgcaataatgaattatttttgaaaaggaaaagagggtttattgcatcagcgggctagggtttcggtggaccgggcgcacggcgacggttcacgcgaacggacggccgagatcgacttgatccaaaacggacggccgagatcgaacggtccacgaccggctcacgggagagggcgacgatgacgtcagcgatgacgtcaccaccggcggcggcggctcggcggctcggacggcgcacgctggccggcgaacggcggcacttcggcacgaacggaggacaccaacgggtagagcgtgacgcgacgaactcaccggtgaccaaaggagcggcggaagaccaacggacggcgacggcgacgacgaaggatgtcgggtcccaaaactaatgattcggaaaccgacatgtttagactgtatcaagccctggatcagtagattgatacaggttcaacaatctggatcttcattgcatatatttgattaaggtttcaaaggagatattattacaaaatataagggtatttacaagcttgtggctaactattacagcagaagctatagaatgactcaactctaatgttttgctatagacttaaaccatctatctaatctatacttgagaactaagttaaaatgagattaacttatatgattgaactcccagcttcggcaagaactccaagatagactctgaaaaatgggggttgaagcaagggtgagtacaacgtactcagcaagctattatattcaataataaatgtatgaaatggtaatatttgagtagagctaggtttaattgcagaaagctgagaataaagaagtagaaatcctgaaatgtttgatatgcaacagtatttaataaagtttgaaattatgtttctaaccaagatgccatagtgagtcccaatgctcgataaccgcgagcacggctattcgaatagttttgataatattcatactgcagtagatgtacgctttacccgcaatccatgacatgctaatattcattagcttagtcatggcaaagcttttcggttactaacatcagtggtacctgttccatgaactataatccccatgcgctctgaacgtaacgttatcagtagcgagaggagttctggcgttcccgaggtttttagagagaactggttgagagacccccgtcatctcaatcaggttttcataattcacacacacagctcgcgagataatcaagatatttacctgcgcctcggtaaatatcacaattgccctgttcagcgtaagtttgcctcctgcgcgaggacttaaaaagaaccactatacagaggtaccacctttgctagataacttaatcagctaggtctatgcccatacgagaattgcggtcgtactcgtatgttcttcacatgtacttggcaatcttatgtcggttggaacagtactagccacccggaaatcaaccatttctaccgtactgttccaatctaagttcattaaattttatgcataatctaactaggcatggctaagcaaaatctagcatatctggtttgctatgttcaggttatgcatttgaaatcatgtatgactaatgcatagaacagagatatagaatatagggtatttatgctcaaaggagaggaataataacttgccttgctccaacgcaaataaatccgagatgggcaacctgattatccgatccttgaaatatcacaggttgccatccaaaatataacggactccactgaagaagaggaagatccaaattcaataaaagccatagaataacaagaaaacgacaaacggttaagagggctagggtttagggtatagcctatcttttctatagggtatagggattactgggctaatattttatgtgcagattctaaagggttggaggctaaggtggataggagattaagcaattagggtcgcttatatttgatgcatgggcttatgtggtttggaggataggaaatatactggataaataatgtggttaagtaggcatgtagctggtataggtcaaggtcgggctttgatagaacagtggctagagtttagttgttctcgagacgat

SEQ ID NO: 19633 - DNA, 6462 bp, Oryza sativa
taggatcacacagagcccgagagctaactgtgcggcgtgctatggaggtcgagggaatagtgaagctccgaccgctgtacgcatcgaggcgtggggtgccaggagcagcacttcgaccttaggtttggttttgccgggctttacaaccaacggtccgacgtcggggccagtagaccgcgaacgtccccatggaaggcgtaaagttccaaccggcggctttttagtggctaatgggtatttttggggtaaaagaaaatatttgaaaaaggcaaatataaattcaaatgatatttgaataaattcaaataaaattataaaatagcaaattaggcatcaaaataaagcatttgaatttatatgaatttaggtccaggttttactgagatcggatctatggtttaggagatatgggcttctaaagattgggatttgaattaaataaagaaaatgtgaaatagtactgtgtaagggcccacctgtcagcctttcctttcctctttcttttctctttcttcttccttcttcctcctcccgttctcttcctcttttctgttgccgagtgagttgagaggaggagaggaggggcgctggctctccggtggatggaagactgcgacgccggtggcaatacatgttcccgagcgacgcgcatccggggagggtgatagtcggcagaggaagtgagagaggaagctggaacggcgcaggcaagagctctgctccggcggcaaaagaggaggttgtggtggcttgttttaaaggggaagggaaaggggaaaggggtgaaatggattcgcctcgatgagacgaagctagtggcgcgagggcttggccgacaacgctccggtgagggagatcgactagtggtggccatggcctaacatggccaggagagagagagaaaagctcggcttgtgtgggggagaaagggacttcaccgtatatttataggcttcggaggtcggttgctcaagtcggttcgcagaggaggagggcgacgaaggcacggctgcagcgacgtgaaggaaagaatgacggcaccggttctttcctcccattggacgttggagtcggttcggcttgcagatgtcgtcagcgagttgaggtggtggctgacgtaagattgggcggcagaggaggaaggcaaggcacggcgtcggtggagtgggggcgaagagaacagcgccggcttgattccttagcggcgaggtttgcggcggcgtgcgccgtgcacggcacgcgcactgagaggaaggaggcggctgggttgtgggctgaattgggccggctcggcttagctgggccggcagcccaagaggaaggaggaaaatagaaggaaaaaggattgggccaaaaggaagaaagaacggagtttcggcccgatgacaaaaagaaagaagtctaatttgtatacttgatttgaatcactgggttttgcgaagaatttgaatttagagagaattcacaaaggagatttcctaatttatttgagtgcaatgtttagaggtggagtttgagggaatttatttggaagcactcaaataggaaaggaaattaatagtattcctcaaaatatttttgggaatgtggtaggaaaataggtggaggcaaaaggataggatttgaaccctaaaatatatggcataggtttcaaggaattgtttgaggctaaaaggaaatttaggtgacaaggatataatttattttcttagcacaagagcaattattcacaatatttgtaataatattattcttgtgccgagaaggaaatcaagccacaggaattaaattagcggctagatcaaaaggaggaatttagatatttggcgataaataagaataggtttggaatcaaaggataggtttaaaatcaaaggatgggtcgacaattgaatccaataaaattggaatcatttggtttaggttctaggacaatagtggcagaatttcttggcaccataattcataaaaatagaaaggggttttcaaactaaatttgaataaaagaattttagtcaaaagaaggtttcaaaccaaatcaagaaatacctcaatttaaccaaatatattttaaatgaaaaacacaaaagaacttaaataccagagaggttttgtgcgagttagttctaggaggtccctctaattatattgttctaagtttaggaggttattgaaaacataagaatcggcatgatgcaggattggaaaatgacacattttcaggatgttacaaaggaacggcggcaaacttcgggtcgacggctgcgacggtgctccggcggtcttcggcggcggcgaaggggcggacgaggacggcgacgacttggcaaccacgacggcggtcttcccgagcgacggcgacgtctggaacggcggcggcgcacggctggagcgacggcggcgacggcggcgctagggcacacggcgctagggcgctacggacgacgagaggcgaaggcgaaggtggcggcgggtagaggagacaccggggaagcttttaaaggggctaggaggcaacggcgaagtcccacggcgaccggcgacgagaaggaaagttcgggctcggagagagagagactgatccgaatcgacctcgaatccacgaacttccaaagcgagatagacgatgtttccaaaggagaaaaggtagaggagatctcggggatcatttcccctcttttgattcggccggagaaggaaaggagcggccggatttggaaggaaacggcggcggcggcgcgctagggttcggccgggcgacggcggctcagggaagacgaacctgacaggtagaccccacctgtcagcgagcgagggcgcgcgcgcgcggcggcggactgggccgacttgggccgaggagagagagcggttttgggccgactttcggcccaaagccaaaagggactttttaaaacctttttcaatttaaattatttcttaaatgcaattccatttattaaaaatacttccttagctcaaataaatcccagaaaaatctaggaattatagaattaagcaaagtatttaataaaattttatctggccccattttatattggaatttattaattaaaattagatcttctcttcaagacttttaaaataaattctaagaattccatttaaacaacaatttatatattttgaattttcagggtgtgacattctctatttctcatcctttgaacccttcttttctgattcttggtgaaaatacccgccggacaccattgtgttttcctatcttcaccctcatcatggtcataatcttgattcaccgggcccaacctctgatgaacaggaacccttttctgactcagccgattacctccagaataggatcggctcgaattccctgcattactgcatccagggcaatcctcaatagatggcaacctcatacccttattccagcaaaatctaaaaaattcacaatcccaatgaggatcaaaaccaccatcttcttcatgatatttatcttgttgccttccatacttcctcttgtatttgctgataatcctagccgaattcacctgaaattttctattattcccccccatcggccgtccttccagacgtatgcaccatattaacagggaaagggttgccatcaaccttcattggcttctttgaatcatcaaatttgatcttccctccctcaatggccgcctggacttgttgcctaaagaccttgcaaccattagttgagtgagaaccagaattatgccacttgcaatatcttcttttgcccaattcttcggctgatgggatcagatgaccagcaggaagttgaatttgtttcttccaaagcaatacgtcaaaaatcttgtcagccttggtgatgtcgaagtcaaacctctcctcttttccagagctctttacccattggcaaggtatgactttctcgctcttgacccattcggctgccgccacttcgaaatcatcatcctcatcatcagaatcatacatgtaaggatatacatgattgattttcttgaagttcttctttgcctcagcaaacctttgctcatgtagagtcaccttttgtgcaagatgagataaactctcaaaatcttgagccgaaaacttttctttgattggtgctatcaacccctgaaaagctaaatcggctaactgagaatctgtcaaagacaaactgtaacacctgtttctcatctccctaaacctttgaatgtaatcttgcacagactcatcatgcctttgtttaattgttattaaatcggatagtttcatctcatgaattccactgtaaaaataactatgaaactgcttctccaaatcagctcaactgttgacagaattgtatggcaaggaagaaaaccatgtgaatgctgatcctgacaaagataaaggaaacaatctaactctcaaagcttctgtagccgatgcctcaccacattgatccaagaatcggctgacatgttcataagttgaaatattatcctgccctgagaattttgagaagtctggtactttgtatcagctaggcaatggaaccctctcaaaccactcagaataaggatgccgatacaaatttccagtatcttttggcttgagcccaaactgttccctcattacatctgcaatcatatcagtccatgatgtttgctaaggtactccttgtatttgttgctgcattggctcaaactgattgaattgaggagcgtactgacgttggcgatcctgtctgctgatactgaacatgatgtgacagaggctgatattgataattcagatttcctccttgatagttctggagattcgtctgaatattatgcaccaaatgtttagggataacctgaggcataattgattgatcggcctgtacgtgatggaccaagtgttcaggaataacttggttcacaggatgctgtattggctgattgtcaggtgtccttaaccttccaacacatgctacaagttttggtgctgagttggctgaaccgtctactgcctcggctgtgcttgctgagtcggcaacggctgtgttgggtcgactattgttggattcggcagaaacattgcagcaacttgatcctgggtcagccgattgacattttgcccagcatgttgtggctactctctagtcaataatctgggattaactatctgccttggtgctgatgatgtaacttgcgcagtagctaaaactggagccgtcggccaagccggcaaagcattagatgtattctgctaatttgctataaccaaaggcctataattcggaaaaacacctcctggtagataaactggtcctgaggcttggtgctcggctatcgagctatcgacaacagtcttcaccatgttggttaagatattaactagcactccaaattgattgatcaaagcatgttgcacagcatagtcgatcctatcttggaaattattgaattgcaaaggcacttggttgccatctgcaccaaggtcttccactgtaccatcttggggaatgtcacccttgtcacctgagccagttgcagtatcttagttaccctaagatgaactcgagccgacctcatcggctgcaaccaccttcagtttgtacttttgtacgatggtccctctacgggtctcttgaaaagaatccataaacttgcccttcacgttgctcatcatctgttcaagttcatccctttgcttagctgtcagcctatctaatgtgattgggacaatattggttgagtcgacttcagctgatggattttggcacctgttttgttcacaggaggtttgaaccctgttccctgtgatggtggtggttttttagccatcgggatgaggtcgtcgaaaactcgggtcccaccgggcatgccaaaagcgtgttgatgtaaaaacacgaggcctgagagatctgcttaactccagtgcaggtccaaaatcttgccttttaggttcatgagcatgccagttgatttgatcctgcaatcaacaagaaacaaagacaaataaaccgtagttaatccataaattatagccgatcggccagccgccgatgacgtatcatttatactcgagctgatgtcatctctgtatcgatcggctgtgcgaggcaataataaagaaactagatctattcgatcggctgtagatatcaatgatatataattttcatgtcgacatatacttaaatcaagtgattgggatagatcggtcgccatgccgagacagtataaatcacttagatcgaaatatatgttaacaaggaaactataaccattcatagcatagtcaatcagatagatctagtgtgtatcggctaatactccgatactactctacattaagatattaaagcaagtaaaatatatcaaacgtaaagtctaatacacctaaaagcaataagatcttaacataaagggcagatctagcatatcaactaagcacatggaatataaagctaaatcaggtaagatcggctgaaaccccgatactactctaatc

SEQ ID NO: 19634 - DNA, 3655 bp, Oryza sativa
gattggaggttagatagcaagatgatcagagattatataagagatatgatagctgggcgacttaggtaggcaagattagagtatcataatgatggaagcactaatcccgagaacgcaagccgccataacaagtcatacctctagttgaagatcgagaccgatgcaactcaacccgaaagcaagaattcgtcgaaacaaaacgaaagtaaaagggtggcgatgcgccgagattgtatttgaacacgtgttatctaattacatggggttcggggtctatttatacccgagattacaaaatatgtccttgtcggacacgactcttatctctaacaaactctaagatccaagctttaataacatattttaacttactactacagatccaggcttcagtgacgggtcatctgtgacgggccaacgcaactcgtcaaagatgagtcatctctgacgggccgaaaaaatatcctcttcaatatatggctactagggaggacccgtcacagatgtgaggtcatctgtgacgacttgcacttgtaacccgtcacagatggctctttaactaaaaagagaccactcatctctgatgggtcattaactaacacacgtcacaggtaacgttatgtctgacgggtggtagttatgacccgtcagtgatgagtgaaaattcaaatttttaaattttgcaaaaaacctcggattgagacatgtcctatataaaagtaaagttgtagctctcgatgatatccacaactttataactaataacatttctattagagatcgtttacatccccgaagatgcattacaagtgatgagatctacttttaaaaacaaaattttgagttttttttcaaatgacatggatggatacatgccccatatcaaagtcatagaactcaaccagatctacaacattaataattgaaaatattttcatttgacaaagtttacatgttcaaaatacatgttataaagtgagatctattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaaacatagacaaaataataacattgggtgagtaatcaatatgtgctgagtaggtgagttggtaaggaagctctctatggtggttgaggtcttaagtttgaatctcacgtttagcatgcaagttatattgcgtgaaaaattgtgaatttgtaggtagtgatgtgtaactatgtataggatggctagtaaaattcaaaatatttttttgaggttttttttgttgcgtttaaaatttaaaaattgtatttcttgctttgtcatcagtgacgggtcgtaagtttcaacccgtcagagattagtcgtcagtgatggtcaggtagttatgacacgtcactgatgacttatctgtgacgggtgacaagttgttagacccgtcagagatgacttatataccggtcagagatgagttatctgtgacgggtgtttcacccgtcacaggtgattttgtcatcagtgaccactaatcactgaccaaggccaaacccatcaaaggtgagggtttgggcccgtcagagatgacctggtccggcgtagtatcaaactatttcatgtatattatatcatcaacaactacaaaatcagtatcacatgaaagtattttaaaacacaaatctaatgatataacctatataatacttggcgtagatattattagtgtacttattagtcaatagatacattttcaaaaaataagagcggagagagtatataagtaacttataagtgtactggagatacaacgaagaagcatctgtaaagttgtataccatttacaacgttttgcaaatgacactggtacaaaaatgtttcttgcggactgtccaaaaggggtttttgcgtgcggtatggctagctgcatgcacaaaacactaccacagaaagggctttcggtgccggttggcaaaccccgttaggaaccggcacctttgaggtatacgatttacaaaaaaaaaatccggctcgccgagccgatgcttcaaagcaccaaaaataaatccaaaaaaaagagaaaataatccacaatcagacaatcaacaattaagttcatgggtcaaatgttcatgtaattttcacatcagacactcaacaacaagttcatgcatcaaatgttcatcaaattttcacatcattgaatcaaacatcataaatgttcagacaatcaacagcaagtcagcacaggttctcaccggaggtggaagcaacaggacaccatcgggcaccgtaggcgaggggaggcggacagagatgccgccggatccgaagccccccaacatcgccgccaccgccgccaccgctgctgcctcccctcccgccggatctggcggaggggagggcgccaccgctgccaccgtcgccccaaggatccgccgccaccgggccaccaccaggccaccaccgcctctcctcccaccgtcaggcctccagagttggcagagggagggcgctcccaccgtctgccaccgcctcctaccctcccgccatctgccgctgttgcacctccatgccatccgccgccaccacgcctcccctcccgcccctgccggatttggcggaggggagggcgccgccatacctcccgcctctgccgggccggtaccgccgtcgtcgccgggctgcggctccacatagagagggagggaaagcgagagaggagcagtggagaaaagatcgagagaaatggagaaagctggccttatctcctctgagtgtgggccccgccgggagaagaaatatctcctccggctcggctcggctcgataataaatgtgtcggttttttaaaaaaccggcacctataaagttgtcagtttttactgaaaaactaacatggtgttgttttcttttacagaaccgacacctattatcacttaaatgtgccggtttttattattttcggaccatggaggtagcaaaggcctataggtgccggttttagcacttccggcacctataatgcagacacctatttgatgagtagtagtgaaatggtctgtgaaaattgctatttttgcatacgggtggcacacccgtatacgaaaatcggattttcgcgcacgtgaaaatggaaaatcgcaaaaaaaaattccaaaacacaaagacctaaccctagccggttgccgccaccatcgtcgctggcggatctgcctctcccgtctccactgtcggcggttccgtaccaaccatcatcgccagccgcgaatccgcgcgcgtggaggccgaatccacactgtcgctgacgtccgcgcatgttgcggagcccgtgcctaccgccatcatgctgcctgctgccggatccgcgttggaatgggaggctagggagagccgccgttggcctcccactcgagcctattgccggatccacgtgggggaggcccaaggggctaccattgtagctgtcgctcacgcccttcatcgccgcaatcgccggatctgccgccctcacggtcaccgcagtcgccgccctccttcgcagcaggcactcctgaaggtgccgccactgaatctgtgcgggggt

SEQ ID NO: 19635 - DNA, 22146 bp, Oryza sativa
aggggtatttttgcatgctggtgagttaagagccccgcatgcaaaaatacacccttattttcgcgtacggacgctttaagtggtctgtttggcaaaaattgaattttgtgtgcgggtctctgagccgtatgtgaaaatgggagttgatttttacagacacaaacatttatggaaacctattagagtatttgtccagaaaaatcatttttgcactagtgtgattattttaagggcgtatagatagtttacagcggcattaacactactacaggacatggctgttgtaacacagctatgtgctactacatacccaaaaaggtgttactgaggtccgcagtaacacaaaatataagtgatgcaactgcctatgttacgggcatatagtctagtagcacatatttagtgttccaacctataaaaaagggtgttacaacaaagcctagtagcacataactaagtgttccaacaaagtagaaaaaggtgttacaaccatatcgtagtcgcacatattagatgttacaaggcatatactagtaactgttgacggttgttatcgatcagtttcgaccatcaatattgccaaaatagaggagaactagtgatgcttgcaatgcataattacgttagaataataatattccactagtattaggtatactaacattttgcagagaatgacaataaagtgaaggagaatcgacatcaacacagacgataaatcaatcgcacgatgtcgacaatcagacttatgtatgaatgggccaagaactcagaattgacacgatgaattgggacaaaattcacaagtctgcaaagtggagcaatagaggaggccaccagccgaaattgggctagattgggccagccccaggttcggcccaacctggtggttcggccgaaccaatccttgcgccgttggatccaggttttggcgtggacgtccaggattgcatcccaatgacagttggatggcacttcggacaattccccttccacaaccgtcataactacctctatataaggagctcactctcttcacttcaacacacacctcaagcaatagctctctcatttctctcaagcttagtttagtagtatctagctagtggaataggaatagagtagaaatcaggagtccgaaagtcttcggaagagttcgggtatgactctagcagcttttctcttctcttttgtaagccttgtacttttattagaatactcttctaaatacatttatggtattgaaatactttccgagtatatgagtacctactttatattatgttcttgttatactgaatatacggctagcttatctaggagatgctttggtgcgggtataatgtttgcttatgcaattactctatgtcatgacgatgatattagagtagtatctggtagtttagacgtggtgtctagattacgggatatcattatttggggttatatattgcggatgagaggtgggccgctgatggtgacagctcagtacaggtattcctccgcgcctatatataatcctaagttaatttcctggggagggtattcctccgtatttagcccggttgtgtggttatgatgggctgtcgtaaggaactcagcagtcaggggtggcttctcgaagtaccagaagggcatcggaaagagggtattagctagtatatcagttaactaagatgtatgtatactatgtatattagaagtataggaatagattatcttcctcttttctttccacttagcttagataatatattatgaaaatgagtagttaatgcttgtgtgtcactctacccttggattatcttaactcctacttagaatatgattattacaagcaacatataaattattagtcaagtcctctctacatgatcttcccacgggataaaataaatacaatacccttggaatactctcgggtgaaatgctataatggtatatccgtgcgcttgcggataaactctgtaactataatataccaaaagtatttatgcgccattgctgggaattatatttctagtaatgtcgttaagaaataccaacagtaacaccattttttaacctcaggttgcactttggaacaccttgctataggtcccggtaacacatatcttggccactagtaacacatcaaatgcacagtacagcaaaacaataatgatttgattaccaataatgctctaattagctttttttttacattgttgccttttaattttcaggaatgtgccaaaatatttcaaaatatcctttataggcatcacatatctcaaataacacaaatcaacatggcaatttgaattgcatacgaagcaaatgttattttcatcaatccacatatcaacaataagtacaatttctaaacgattttacaaagtgtgtctatttctatattcttcataaaattatttgctgcttgatccattgttgcacctgaacgtgcatctttgctcttaagttccaactgagtatcaacttgtatgtgtaatgtgtacaataaactgtacctgcagttgatcatgatgaaaatatccctgttaagcccataaaatttacattgaattgtacatatgaaagatcaaacacggattacgccacaaaatgagttaagcgagaacggaagtatctaagacataacagttgccaatcaagctaatcattattaagtaataagaagtaaacctgtttgtaactgtgacagataatttggatagatgccatattaacatcaatatctgaaatatgtttgacaaacttaaaacttcatgttattctacttttattgaatcttacatggataagcaattaagtttgacatgtccggcaattcacaaattttgagactgcggaagtaaatgaatagaacagtgccttgtgagatctcctaaataatcacacagaattggagttcaatgcttttatttctaaaaatttggcagcacaaatattgtgatggatgagaaatgctattgttgctttgaaaaaattaaagcatgcagtccaatggataaaaggacggtgcatacagttctgcgcataaggaaaatgaatctaacacagataatacaatgaaaacttgcattggataagaatactattatgtgatttcagcaacaagaccagtatttatcttggaataagaatcaccaattgtttatccacaatgaactaataaagcatactattttttctatatgagaaatttcaacacaatatatatactgatctagtccaataatgtatgaaaaaaatcaaataaaaactttccaatgattagtatataaagatacaactcaaagttgatgcatatttttctatatatcacatttgcataaatttgcatgaagataaaattttctactttttttcggtttacctgaacctctgaacttgaatgctgaagaaatccttctaagttacaaacaaagaatactagattccttcaactacaatcccttttctgttccttgaactacaatcccttttctgttagaaacaatatacaaccatagatcatggaaataattagaagtgaagcaaatactaccataccagagaaaagttctgaaaagctatcaccattgccaattctgattgcactatgtatctaccataactataccaacttcagaaaatctcagtttttccaacagtatggatatttcaatcagaggatgcatgcagcaggctattttaagcatatattatagcccgttataagcatatattagcatgtatagcccattattgcttaccatatcatagtttcctcctgtgacattgagattagtgacaggcgtagccatgagctaatcactactaagcaataataagaagaatatcaaccatggtctgtagtaaatgccatattagcatcgactgctagagaaaaatttgacaaagttcagaatatatgttttattctagtgttattgaaccatagatcagcaatcagctaatgtgccttgtaaaatttcgtaagtagtcaaagacagagctggagttcaatgctcccattgctccaaattttggtgagtgccattgtaaatgttgggatgaataaacaatgatctaatcgctacatataaactttgaaatttcgcttcttgtctacccacttaactagcatatcattatataaactgagctggtattaatctagcaacaaaaaaacaagaaacaaaaacaatgaagaacagacaacttcaccttctgttatagctaggaatatttgtgttccccctttggttgcaaccaaaggccaaatctcgtcatacacaaaacaaaaattgctgagattagtttacgggttggagattagagagagagagagagttgaggtctgaggagtaggggaagagaaggactggtaaaggaacatagctgttgaaccgaggggagcaccgccctggtatctggcctgagggagaagccccacgtactagcacatctggccatcgcaagcggaactagtcaccaactcacctttgagctcgtcgggatgcgtgacgccgccgagcgctgctgtggggaggcgccaatgtgctgccaagatcttcgccatgggggtggagacggtggctgagagctcgatgacctggctacaggccgggagacggcggcgtgggggccggcgggtagcgacgactgggggggaggcggaggagaaaatggccattttgccatgttcaaaacacggtttcgctagaatgccattccgaaaacgtgattcgataaaataccaatatgaagcgtgcgtctaccaccactttgctattttcaccattttattcattttcgaaaagattttctctcctctactaggtgttgagacaaaattgccccttatcaacttagagaacacggtgagagaggagacagagagaaggggcggcgacgccgctattgccggccggcgcgccgcctctccgcatcatgcgcggcaacatcgtgcgcgtccgccgcggcggccttcgcatgctttactcggcgccggcgccaacgctgagaacgggatcgatcatcgacgaggccctctacatgatgaagctccgcaagaacgtcgtcgactcgatgaaggccgacctctgcacccctgtcgatgccgccacccgcgatggtggagcagaggcgaggggctagcgccggcatggtttcggcggcggcgtcgtccatgaggtcgtcgtcatcatggtcgaagtcgaccgcctccacatcggtgtcccggcggagctcctggcgcaccgccagcgtccgcaccaaccttcacctgatcttcgccttcctcaccgacgacctcagcatccgcgaccagctccgcccagcgctcctctacctctaccgcctcggcttccacgacggcctcagcttccttcgacggtgtcctcgtcgcctcactgaccccgccagtgagcctctgttctccacggcgacggcagcaagcaatgctcccacgctctgcctcaggcgccgcgggcctcgcggcgggcggccgcctccgccgcggtgctcccctgccgcaggcgcgctgccgccgccgtcggccgacagcatccgacggctggtgctaacgccggagggtcgggcgaagttggatgcgccgcttcccgaccaccgccgctctgacggcgtcctcgagagagaggaagaggggaagaaggggaaaaagagaggtgagagagtatgaccggtggggcccacgttaggggtattttggtctagggaaagcattccagtgaaaaatgatttcgaaaatacacaaaatggctaaaatggcaaagtggcggtgagcacacgttttatattggtattttagcgaaacgtgtttttgagatggcattctagcgaaaccgcttcttgaacgtggctaaatgtctattttcttgaggcggagggaccagtgtgtataggggaggggagaggatggggtggcggcgttgagcggtctggggagtggggggggagtggggactgggagtgggagggtaagagtccaagagatgagcactttaattagttggctgatgactgatgagattatcctacttgagcagagcccgccaataccaatttcaccagttccaaaatttctctcaccccgccctgtctccaaaatttcgagcttagttgtagatagatttttacaactaaaattctgtttttggaattcctaatttgattttaaggtgaaaatatatttttatttccaatatatatcttaaatggcattgttgcaaatagtagtcactgaagggagtacaagggagaaaaacgagtggcttatcgccttctcggcatggctagggcagctccaccgccgccgacgcggccttcctccgaccgcattcgcttgcctctttccctttcacttgcaaggccgcattcgcttgctgttttcccgttcacctacaaggtcgcctcagcatagacacgacatctgcaaggtcgtgatggctacagtcttcatgggcgacgagaggaacatgagatgggagtcggggagacgctgctaaactcggctgcgagttggcgccattactccctcaccaccgccgacatcctcattgcccatccgtccagtggcccatggcctccattgctcctccaaaagagttccttcgcggcccttgccatcgcctttggacttcggtgcccgacggactacgagctccatcagccatagcaacggatggttggatttgcttcctactacaccactaccataaccaatggggttacaactaaaggtctattttagtttgtgtcgagtatgtgtacgtagtcgattacagtttagggtttggagttatactaggtgttagaaatagagtaagagtcggactctatcctactatctctcttaaacagatgggcaaatctgctgtaactgcacataatgactagattgctcaccaccttcgccagtgccattgatcagggtagataaggagaacatcggtgacgatacacgcctttgatgcaacgagcgtgtgctgcacgggagcacctagtaatgaaaatattagaatgaagcacacggccgacctccaaacatacgtagtttgtcatttagatactaaactaaatgtatttttaggtctacgaacttgtcttcggtgtcatacaggtgcaagcgggctccaaccgctctttgcattgacatggcataccattgttggtttttttattttttagatctttttatttttttcattttattaatagacatttctaaaaaatatttccaaatctgaaccttttgaccacgcgcacacacagctgacctgccacgccagggtaggaggggaggtttttggggggaggggggtttcctcaaggcttagagggatggccgtaggtggcggaggacgcagtgggcggtggacttcggcgggcggtgaggcagcggcgccatcgaagccgcagggatgaaggagggcggtgggccagcgtcggcggcggggcaaagcaagcgtgcgattaggaggcggcggccggtggtggcggatccgatggcagggagccgccggagacggggaagatggcgtggcagggacatctccccatcaccaccttgagaagaaagagaggtgggaaggaggagcggggaggcggaggagcctcgctaggggacctcactggcgctgttgactccttccgaccagccgacgaggcaggcggcagcgcggtggggcagtggtggcggtggattggaatgctcgaggaagcgaggggaacgggagaagaagaggtagggttgagtgcttgcatgaatcttaaagcatatctgatggtccaaaattcgaatgatagaaggtgagattttctgtgacaagatgtgtagcaaatcaaattcattcaatcctcttttatctaagtcctaccactggcgccaaagtcttactccatatggcggtaaatcgaattcttctagtgaatttcccgcgcccaattttttctttggcgccaaatctctgcatatggcgccaaatccatcccagggcgcgcctaatctctcctgaaataactcctcccagcaccaatggtctcttcagccccttctcctcccctgactccctgagagtccatgcaaccatgcccagtttcctccacgcgcttgctctagctggcccttccactgcctgtgtccaccactcccaggcgccaacacccgcttcctatgacagcgtcgagacggagaaggggcagcgcctggcagccaacaggagggcggaggcgggggcgcggcgcggagcgccgccggctgcggagcgcggtcgcgtggagcggtgttgcttcgcagcggccgggcgcgaaagcactggctgcagcagcatggtagctggctatttggcgagcatagcataagcagcagccagcgagaggtaaataggtgagcttgccacaattgaaatctgaacaattagatttggaagttcaatgcatgatctatagaagatcttttttttttttttttttgcagccaagcagcagccagcgtcctgactccagagcaatgtttctcgatttattttggactgggaatggtttgagaatgggttcaacccattttcttgtgtttgttttgaaccgatttggattatctttggtacttgccgagtaggtttgggttttgggagtgattaatttgtttggagtggtttggtagtatgctatacagacaaattgttctgaagtgtgtcgttaaattagtctagaaaactattaggtgatgatttaatttgcctccgttttgtgcatactgtatatgtaaactttgatcatcatacctataggctgatatttatcatgtaagcatttctttcatcttatctaccgcagtcgtgtagacaatttgctgaaaatatttcaaacaatgtgcagcaagacagcaagatggtggatagatattgactagtaaaaactagcccatgaagtatgcaatactatgtcggacaatttgtttatatatacatcagaatcagaacttccttgcattatttattttacttacctgaacccatgaactgaattcctgaaaatgtttttagttacaaatgaagaacactgaggtttgactgaaaaatacaatctcagactcatcagttgtggaattagatcagtgtgttttccaattgatgtttactttggcaatttggtacatttcgatgaaatatgatgtttccattttttttagtgaatagtttggatatatttattcttcttcatactagtcatggatgtctcagtttttattggaaatttggaaactatcctttgcaattcaataggtgcaccatatacgcttcaatacaatttaaagttggtaattcctaacatgtgtatcatacattgttctttggtgcaaaccataagccaactgcaagatatatgttgaaatatttaaaataagataatgaatcactaaatctaaagcttactgattcatactgtgagatttactctgcacaagcttgaattacatgataaatagcttatttgtgatggttcagttgttacttgtgtactctgtttttttcgcacatgattataacacggatgaagaaacaagtattaagtatttaaatgttgactcagaaaaaaagtaggatctcaaatattgccatctatatataaacaattagtacaaaaatcaaagcaaaatatagtttatttccatttatcatgcccataaattgatatttttattttataaggttgaaatatgatactagacgcaaaggacatgtagaagtaattaaaaaaaaggctatgccaccaattagtggttatcatgcaactgtgcgatcctggatccattgtcttggcaacacatcctttgtaacacgtattttgtgctcctacctcacttttctagagctatattttacatcttttgaaaatgtgttacaagcagatgttgtagcacatagtatgtgttcctgtgatattgccgtgtaacacatcctagtatgtgttacagggtttgttacaatatacctgtcctgcagtagtggccaattcgcgtatgctggcttcaccgaggggagagagggagggcatcccaggaggcatttgcttactggtggggctgcctgaagtgcctaggcccagtggaagtgaaagagagggaaatttgagaaagaggtggtgtcccgctttgaaagctgtttggggatttgaccctagggtctcgccgagttgtgttggtgggaaaaaaattgcaaaatttacaatgagtagaggagttcatcataactttattaattactagaaaaaatacatgtgttgtaatgggtgaagatgttttcagtgatacaacaactattaggtgatgggcaatcgcacgggtaaagatcttttcagtgacacaatagctattaggagctgagcaataaataaaaatattagaatcgctatacattgtaatttaaaaaataatgaatatccttcattggttttagacggaagcatatttcttccttacttttcagcttagcctagtctgatacctccctccgcccgtcctgcctctcttcggcccaacccacaagtagagacgcaactcgcatagccaactgtttgtcctcaaccttcaaaaacagtccccgatcttctcatcaaatttggccgaatctcttgttctcctaaaattggttgagggcttttgatccattcgttctcctctttccctttttcataaaatcaggtaaaaaggccggggaagcttgccggtaggccatcaacaatggagcgacaaattgaagctgaattgaaagggaaaatcatggggaaaatactaaggaataagtggggaatcaatttttgcaatcaattttaggaggaaacatgtgggaaggtagatcgacgttgtgatgatgctagggtttggcctgggcagcggctagaggtgctgcgcgtgtgcaactgattggatactactaagatagattggatactactgagattggacaaaagaaccggcaaccaaagaaagggatggataaaaaaactcgcacaaaaaaattccacgtgcaaaaaaatacaaatctgacaaaaaaatcgacgacgaaaaaaaagaagacggacaaaaataaaagcaaaccggaagtgataaagacaaatattagaaaacaaactcggatgacgtaccaaaattttgacaaaaacatcttcaattttttttttaatagtagagaaaaggcctccatcccaaattatagggcgcctccttttttagaaaaatcaaacttgataacttttgactaatgatcatactaaccatatatatactaagtattatacatgttatataattagattcatattttgatgtactttctttttatgctaatttcatatttataggaaacctaatataaaataaattaatggtcacagtgtgttattgaagaccgtgtaaaaaaatataaacctaaattataatttaggatggatggagtataatttaagtactatagagagttcttcaattttgacaccattcttctcatatactagataataacccgcgctttgctgtgagatatatattagatagtaaagaaataataaaatgatttggattgtaatattatgaaaatgatttgagaatgatgatttagcacgtgtatgtttagttttagaattgaaataaattatagatataattattatatgcttgcatgttgagctctgtgtgcttaatgggtcgatgtggcatgcttgcatgtaggttttaggagagccaataaatactatgcttgaacgttgagttttatgtgtttagggcaggtgttatagaagatgtgactaccaccttcaaatttatctatatcattcactcataaactaatagataactcatgcaataaaacacctctagtacacaaataccaacgtctctaatactctcacactcttcttaaaatttgtgtggaggttacctcttgatttaggggtagctcattatctctctcctcacttctctactccaccctcatcacttaatttaatttaatgtgccattcttagggacagcatatgaagcattatactcagctttttgcaaatgattatttgaagggtgcagagcatattttacagcagtattgaattgtgctactatatataactcacagatctcgatcatgaggccatgggtcggcagtgcaattgagtacatcaggggaatttttactacgccatctcgataattatttctaaatctaaacttttttactacgccaccccgtatgacagtacgaattaatattgtcacatcacctacagtcgacatgtcagtttttgttttgctactatgctttgccactacgctcttacttaattctaaactttttcttcaaacttttaacttttccatcacatcaaaactttccaacacacacaaccaaatttttcatcacatcgttccaatttcaaccaaacttctaattttggtgtaaactaaatacaccctacaatgtggctagagtagaaataagttttgaaagttttgaaataagttttgaaagggtttattttaaaaaataaaaataaaaaaggttaaaaaaattaaaaagtcttcaaggaagtgccgcaatgttaaggaagccctattttgaaggcagtacttccttctcattattttctgcttcccttgccctattttctccctaacatgtggcccatgaacagtaacatgtggcccatgaacagtgtgtgccatctactagaaaataatgagaaggagaagaaaagatgcccaggttgccaggtgctatatttttttacactgtacgaacgtagatatttatatacatgcccacacactcacccatgcatataaacgcataaacacgtacctacctctttaattacccccgagagattacgttggaatatatagagagatgatgttaccacttatgtcttattattgattgatacgttgcctacaaataaaaaaataattgctcataaatgtaagcatatgtgtcaaggttagaacttgacaccagatgaataggtgctatcataacaaacatatataaccaactgaacttcgttcagctcgcatgcaggtgcacattattgttttggacttttgtaggaatggatttgaggaaaaattaaattgaatattttactatagattttaatttaattatgaaatttggttcatggggatattggggattgttatccaaggtataggaattagagcttaggcaacaaatttggactgaactaaaatttgaaattcaatggaatttgtaatcaggaatactggaagggaaaaaagaggaattgattgggaaattatttcggaccgaaatttcggtcgtatcaagcctcccccccaatagaaagtgctcgttcaatatatatattgaaccctggttagtatgcaaggtttacttttttatttggttgggtgagtgggatgatccaattttatgtttggtttgagccataaaggtgaatttttttatgcagttttttttagttgaaggaagtaaggtgcatgagctattgtgatcactctggtgagaataccccttcacttcatatatctcactgataaagactgccttaactcaagcaggttgggcaaactatcaaagcgaagaattctttcggatcttacgtaataaaagatacatgaaatatccaaagattagtatatcgttcataaaatgaaaaatcaaagattagccggggctgcctacggctcgggcgcccgacatcatgccgatgtcagcgcccgatttacgtacaaaactactttaaactgatgtttctcttaaattacttatccaaatcatgatctgattacaccattaaattcgttacaattaaatcttcaaaacaagaccacacatggatatattccgatgaaaaaatagcttattattgatttttttaaatgttgcacgatgttccaccaggtatatcggaattgtttcactaagtagatcgaaaatgtttcactcgttgaaattaggtgctgtttcaacttatataaaaacaatattttagcaaatagcgaaagaatgttttagttcactacaacattagatctatacatagtgaagcattatgagtacactaggtgaaacatttttcggtggaacaaaaaataaaccaaatttccttaatagggggtttccaaaatatgtgggtttttgttgcaatggaatgtttcgttcactgcaacattagatctatatatagtgaaacattgtcagtacactagatgaaacatttttgctggaacaaaaaataaaccaaattctcttaatagagagtttccaaaatatatgggtaatttgttgcaatagagttgtgtgtgaggacacgtggtgggtcaggggaggggagcgcgcgtgcatggggtaggggagcgcccgatttctcctcccccgcccgatcacctgacgggcatcattatcgagattactccggctgctcccccaaatttgatggcgaaaatcggagtgcaaataacctcatgaacattagtaattattatggatgcatataatgattaatgtgtttacacccaaatttggcacctaggagtaaaataagaaaaattgccaaagtttggaagtctgccggttttcctctgtggggccggtctgaccgccgtgtgtgggccggtctgaccggtggtgtgtggccggtctgaccggcagagtccgagtccaggtctgtttcaccgggtctcgaagtttccttgctcaggaaggcatgtttctggtttcctttggattctatcccgagttggacgtggaggagggcctgtaaagggtaagaccaacccctatataagggggtaaggccggttcattgtaaaaaccaatctacaatcaatcaatcgaatcgtttttcatattgcttttagttttctcttagtttgtccatctttgtcgatttgcgccgtaaatcgtccaccgcccctacaagagtgcgacatctctttgtaggtttgtcctgaaaaccttccgttttgcccacgagacgggtagttatctagaatcggctccgttagccagtttagttatcaaaacctatcttggtttagcttttgctagattgagatggttggtgactctagtatcaacgcaaggcgtttacgtgctgcgatcgtgcttgtcaacttgtcacaaaaagttgccaagatgatttttggcgactccactagggaaatctgctcaacgtcatctcaacttcgatatcgccatgacaaagcctccatcaaccaaggcggaggtggaaccggtcaatgtgataccagtcgcattggaggagcttgatgagggagcacgcaaagctttagatgaacatctcaaggcatatactcaagatctactaatgaaggcgtgcgctaggacccgccaaggtgtgattttcaagccgggatcattgcctaaacatactttcgacatggtaagtgctgaagaggtatcacaatctatccaacaacaaattgcgcatacgatagattcatctatggttactttaaataataagttagatgcatctatcgaaactcgttgtgaagaatttatgaggactaaatttggccctctcatggccgattttatgttcaaagataaagcctctaccagtgctagccaagcccccatagatcaaataagtagtaaaaccgatggggtgaagacgcaacaaactgacgaggggtggtcagcgcatacagccggtctgaccgggctagatggtcggttagaccgcgactttgccgccggtcagaccggtcagaccgggtattaccccggcggtcagatcggaccccaaaccggtctgaccgcgcctttggatgccggtcagttcggggcttggaccggtcagaccggcgcaatcatcccaatacagggggtagatccaatgacaaataacatgtttttataccatataccagcacccaatcctcctatatccactattggtccccaagttcaaccacatatccctaatgcttacaatgatcctactaggggatatactcccgatactaggcatggccaatataattatattgcgccgcaaccacaacctattaagccaccaaacccaccaccaaatcaaaataggcctgataatatggaggaattgattagtggtattattaaggataaatttggaattaaagctaggaatcatactaaggtttaccaaaagccatatcctgattactatgacaacataccatatcctcgtggttatagagttcccgaatttaccaagtttagtggtgaggatagtaagaccacatgagagcatgtaggtcaattcttagcgcaatgtggagaggctagtagttctgatacttttaaattgcgtttgttttctttatctttgtccggtacttcttttatatggtttacttcttttccggcaaattctattcatacttggactcaagtagaacaaagatttcatgattatttttatactggtgaaactgaacttaggctaagtgatttaacatcggttaggcaaaaacacaatgaatcagtcattgattatgttaagagatttagcgatgttagaaaccgatgttatagcttgaatataactgatagagatttggctgatcttgcttttaatggtttaattgctcctattaaagaaagattagattgccaacaatttttttatgttagtcaactcatgcaaaaggctctggctcaggaaagccgggttaaggatagcaaaaaatttgttagagcctaatgttaatttgattgattatcctgaagctagtgatagtgatgatgagggtgatcatgatatgtatgttgcggagtgatcatgaactaacaaaaataagccttttgtttgctctaatttaatgccgactcctcgtaaagatcggcaaagtaaggttaagtatagttttgacgtggccaaatgtgatatgatttttttttatcttttgcaagaaaaacaaattagattacctaaaggccatgtcataccctctcaagtagaattgaagcgtcaagcttattgtaaatggcatgattctcactctcattctactaatgattgcaatgtgtttcgacgacaggtttaatcggccatagatgaagggcgattgaaatttaccgatggttccaagatgaagcttgatcatgatcctttcccggtgaatacaattaatttcaacaataagaaggtgttgattggtcaaggagtggtcattggagagcctaggccaaagatgatggtgccaaagaatccggaggttggtgtttggaaggagaataggagcgaagtttcaagttctaaagctcctaagaggactaaggtgaccttcgatatgcttttgaataagtatgagaagcaaggtggtgagaaagctcgcaacaaaaggaaaagaccaagatcacctcctagggagcgatttggtcattcaccaagacagtcggaatcacctacatatcatcgttctcaaaacatgtcatgggggccttatccaatgctgccgtcgggttatccttttccttactacatgccatggggggcaacaccatcaatgttcaatcatatgcctccaatgcaatacaaccggggccagctcgttagcgtttatctttaccaaacaatggccagttttatgctaagaaccgggccaatgaggagaaaagggaaggaaagcgtgtcaaagtggagattaggacttcggaggtgattactatcaaagtggggtctcatgatgagccaataccttctggagatgaagttggagagtcttcaagcaataaatccaacgccgggaccagctcatcgcaggcggccggtctgactaggccctctggccggtctgaccgcagccctaaggctggtctgaccgggccatcaggccggtttgaccgtcagcccaatgtcggtatgaccggcgcttctggctggtctgactaatggtctacgtccggtctaaccgggctccagcgccggttcgacaggagatttgcaaagggtagttcaggggcttcatcgtcttcgagtaaaatcaacagagggcattatttacctcctggaacagagccgaaaccgaggtggatgcctaaggatttgacgggtaccaaaagagaaggttgcaacatctttgggcccaagaattaagagagagagaggccgaagagcaaagagatagaaggttcaatgagttgcgaccactgcctacaaagatgtggaggcataaatccatagagattgaagaaccggttgttgtgcaaaaggagaaggaagaacaatcggttgctaaggatgaatcatctccaaaggaggacatggatgtcaacatggtgtgtatgttgcctatggagttttacgctatagatgaagccgaggttgctcaattctcactaggtcctaaagatgcggtttttgagaagcctgatgagtcaaaccgtcatatgaagcctctctatttcaaaggtcatattgatgggaagccggtctctaggatgctagtggatggaggtgctgccatgaatttcatgccatactcgttgttcaagaagttggggcatggagatgatgagttgaagaagaccaacataattctcaatggcttcaatggtgaaccaacggaggcgaaggatatcttttcagtggagcttaccgtgggaaacaagacgctaccaaccgctttcttcatcgtcgatgtgcaaggtaactacaatgttattttgggtcgttgttggatccatgccatttgttgtgtgccttttaccttgcatcaatgtttaattcaatgggacggcgatgatgttgagattgttcaagcggatacatcgcccgaggttgcaatggccaatgcaacatttgagtggtgttatgggaatattcaatgcttatcgggatggatctttctagctatgattttattagtatcgccaatggcaaatttgtacctatctctgtatagccggctagtttagcacggctaggccatatcactttatgtaatgaataaagaagctaatttagagtggttgcaaaagagggtgcaagaatatcggtctacaaagaacgatattagtgaaactattgaagattttgatgaagtagagaagcttggttaagggttcacatcggccgatccgttgcaagaagttgacataggtgatgaaactaagccaaggccaacttttgtaaacaaaaacatgagagtcgattataaagctaaaataatcgagctacttaaggagtatgttgattgcttcgcatggagtatctgttgacgaaaaaatcgaacacatcggcctggaagatctgcttaactcatgtgcaggtccaaagattcatgagatgcaggcgtgccagtcagtttgatcctgcaactgacaagatatgcaaatagtaaatcaaaacagccgatcggctgacaagccgatgaagtagttccagccgatagccaataatagccgatgccgatatcagccgatagcgatagggattaagcaatcggctatatgtgcaatgtagataatgatataaaggcaatctgctgttgatgatgtaataaaataacaatataaccgagtagaaaccaattggctagaaacaagatataataatcactgatccgaaggttaaaacacacatcggctggaggtccgatgtcatgaaatccacaagattagattaaacagtgacacctttgttgtcatcggctaaatccaatttatatgtatatgcaatccttatgagccgatgcaacgtccagataactcaccggctgaaaccccgatgaaacccttattggcagtcaaaaagcaggctagagattatggttctatacatgacttagtagatcaaactcaactgatgcagcactaagtatgaaaagaaacataatatctagacgatcaaaccgttgactgagttttcagggtggtagatatctaagttaatctaatctagcaacgcgatttagccgataccggcagaaaccctaaaacgagaagcagctgatagagctaaattgatatgctaagactagattaatagagacatatgataaataggtaggcaaatatatcatccaaaccagagcaatccaagaggtcgaatgtactgatgcagccttgaacgacgccgacgtaaacgatgcaattgcctggaccgacggaacattgaacttaccccttcgccggagatcgaagacgatgcagccccgcgtcgggtgccaagttccgccggaacgtagaaacaaaagtagaagtaaaaagggtggcgatgcaccgaattgtattgatcgagagataattacatagaccccgggtgtacatatttatacccatgggttgatacaagtccttgtcggacaagaaagaaactatcctaaagataaaaggaaaagataaagtccttatcggacactaaacatactttcctaaagataaaaggaaactaacaaactatacctaattaatagataaactgccatgccgcatccttcttgaactcgaactcttctagataagcttcctttgattgatttgattccaccgagaacacgacagcatggcaacttgatgactcccatcggctgattcctccaatcggctgattccagtactctggagctgatattgactctaagccgatgatgacttcgggcttgaccaaattttcactattaacagtatcatgagatgccgggtcttaaccgtgatcttgtcgagcatcggcttccaattaaaccgggttttaggcctcataaacaaccgcctcgtcgtttcaatcctttgctatatgaccgagtcaaagaagagattgatcggttgttgaaagcggggtttattaggccatgtcattatgcggagtggatttctagcatagttccggtggagaagaaggggagtggtaagattagagtttgcatagactttagagatttgaataaagctactcccaaagatgaatatcctatgcctatagccgacatgatgattaatgatgcctcgggtcataatgtgattagctttttggatggtaatgccagctacaatcaaatctttatgacggaggaggatatgtacaagacggcttttaggtgcccgggatttgttggtatatttgagtgggttgtcataacttttggattgaagaacgccgaggcaacatatcaaagggcaacgaatttgatcttccatgatttactaggtattatcttagaaatctatattgatgatattgttgtcaaatcggatggtattgtgggacatagccgatttgaggttagcttttgagaggatgcgccggtatggtttgaagatgaacccacttaaatgtgcttttggtgtgtcggcggggaagttcttaggattcatggtgcatgaaagaggagttgagattgatcctaagcagatagaaaagattcgtgatttcaaagcgccgacatggaagtaggaagttcaaaaattactaggtaaggtgaattatttgaggagatttatatctaacctagcgggtaaaatcgatgcttttgtccctatacttcgtttgaaaaaagaagccaattttacttggggtgcaaaacaacaagaggcgtttgaaagattgaaaaggtatttatctactccacccgtggtacgagcgactaaagttggaatgccgtttcggttatatattgcttccgaagacaaagtcagtggtgccgttttggcacaagaggaagatggcaaggaatatatcattacatatttgagccgccgtcttttgtatgccgaaacgaggtatgtctttatagggagactttgtttatgcctatactgtgcttgtaccaaattgcggcattatttgttatctagtacatgcatagttgtttgtcaagctgatgttattaaacacatgttgcaaaggccaattctaagtgggagaattggcaagtgggcatacactttgattgaatatgatttggcttatgaaccattgaaatatatgagaggccaaattgtagttgattttatagtagaccatcctgtagatattgcttatgaggaagaggtttgcttagttgaagttataccttggaatatttatttttatggttcttgcaaagtaaggtcaaggcataggggtagttttgttttcacctaa

SEQ ID NO: 19636 - DNA, 2675 bp, Oryza sativa
tggaagcttttggtgattcggaattggtggtgcaacagttgccggagtttacaattgcttggacggatcactaaataggtatcttgattcatgtttcgatattattgccaattttgataattttgctattagacatattgctaggcatgataattctatagcaaatgatttggcacaacatgcatctagctataatgtgaagaagggagtatttttgatattggaagagccggtgcttgattttaaacctttgtgtgaaattggcaaaatcacaaaccaggggtggtctgactggcgttgcacggctggtctgaccggtgaccaggggcggtctgaccggccttgcatagccggtctgaccagttctggatagagcgctggggggcacgccgcaattgattcaaagccaaattaattgtaaattcggacatttgcgcccagaagacaaaagaggattggagaattcctttgattaaatatttgaaagatcctacacttaaagttgatcggaagatttgtcacgaccggaaatcacccaacgggcgttcctgacgtgcgtgtattattccttgtcccaggaggcaaggtacaccaaaagttgatacaatacagagtttaacaagcggaagcgtatataaaattattacatgggcgacgaaggcccagcacactcagagacaacgaaaaacagcggaagactagggcgacgaccacaggcgcttgacggcaggcacgagctagacaccgaagccttcatcttcagggaactcctcatctgggcttgggaaaattaagcaagactgagtacaaccaccgtactcaacaagacacacccacaaatgcagaataaatgcaagggagtacgagggaattataacataaagggttagggttgcagtaaacagcatttaaagacatttagttgctcaaggccattttgtaaacacgatcctagaactaaacagtattattaatcaaggccgtgaacccacacgaacctgccttaacccaaggcctatgatgattcagaccgaactggcaacccgaccctgggccccagctcgtcccaagccaacccaggccaaccattccacattttagttgttgagcaaattttaagaattataacactgacttgggtacattgctcggcttgcccatatccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcagacggaactgagcccctcacagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccagagtgtccaggtgatatgaaataattcccaagtctaaagttgtaaaaccacctaaggttacctaattaaattgcgaagcatctacctagaattaaactagtggtgtcttgagtagagagtccactagttgaggttttgtttgcctagggtgaacaaggtaataataataacaataacgataataatatggtcataacaaaggtgaataggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccgtttgaagtttatatgctctttaaatggatatttgcgaatttcttcatttaattttcaattaaaaatcccatttattgcgtcagccgaggggcgggcgcgcggaccgggtccacgggaggtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgaggcggcctcgccggcacggccgacgggagcggcgcgcacccgcgccccgcatggtcaccgccggcgaccaccggcgcggcggagcggcgcccgagaaagaggtgggaagggggaaacgaaggggatggtc

SEQ ID NO: 19637 - DNA, 4513 bp, Oryza sativa
  unsure (1)..(4513): unsure at all n locations
cgagagcgagcggcgagcggcggaatcggaagagcggagctcggggagcgattatatagcaacgggagggagagagggcggccgtagagagagcaaacgggcgcggagatctcggccgccattgaatatgccggcgaggtttgcgggattgattccgagcgaatccgagggagagagagaggggaaagagggggaatcgggagaggggattgcggggaataattcccccctcattaaggcgcgcggggaaggcgggatgcggcggattcggcggcggcggcggcgctagggcacgggcggcgacggacgcggcgggaggagggagatgacaggtgggccccacccgtcagcgagagtggcgggcgggcccgcctgtcagcggcgcgcgcgcgcgggggagccgatgggccgcgggagaggagagagagagggagagggaaatgggccgagccggcccaagagggaaaaaggggggggaaaagaacttcttttagggtttttctttttataaacctttttaactttgcttatttcttttcaattattatttgtgctctgaaaattccactaaaatttgtttaagcattttaggcttttaggaaatatacaaaaatcctccaagcctcatttgacttttatctttgcacattttaattgttggaggctttcacatcgaattttaattattctattgcacaattttgaggatgaattttagagtcgatttgggacgcgacaagattaagtggctaccattcaaatatacattgcttgatggagatttatatagccgaaatatagatggagtttggagaggacgtgagcgtattagggtgtgtttggttgggtggatgagtctagatgggagatggccgcccgattttttgtggtgtttggttggagggcagggtgaatggggtggcccggaattgggaatattccctcaatatgctggatgagtgcatccggccgattttgctggatgaagccatccagttttggtctaggtgacgtgtcctattctgattgggtgtggtggcttgattttctgttaagcaagctccaaatgatctttctcctaaaccgtttatctaatttatgattttattacaccgttatatttgttacaattaaatgtttaaaacaagatctcggatgattatattttgattaaaaaatatatatgacaaatgggtcaccaacttatggcttttcccatccatgctatatccctccaaccaaacaagaaattggatcaccatatccatacaaaccgaccaaaaaattggatcgccatatccaacaaaatatgtgttggatagtatagggagtgaggaatactttgaatatttgacacgttgtattgagcctcaggggggcggtatatataggattacatggggaggagataaggaatgattacagatatggaaggagtccacacaaatcaatcctattctaatatgactctaactactatatactctaacatccccccgcagtccaagcgtgagcagcgcggacacttggactaggcggacacttggactagagaagaaaccggcgagagtgctcaatatcgacgatagcccttttgtgccgtagtcgatgtagccaaagcgaagggtgcgagggagccgtggtcgatgtagctgaagtcggggaatcgaggatgtcgaggtagccgtgccgcagggcgcgcatgggacactgtagaatggtcgtggactctcgagagggtgtcatggaccaaggtgcacgaggacgagctgaagacgaacgcggtgacatgatcgtggcaatcgttgaggaagatgatgctgaagagccgatgtagtcgaaccgtgaaggacgagacatcacacagggtttgccaaaccccgggataactcaagacgaatgcgcgcgccggtgttgctaataccgtgcaggcgaggcaggggaccaccatgaatcatacgccaatgttggaggagactagcagagaagcctccaagacggttgtggcacgagaacggcgtagagggagaattgctggagcagcacgcggttgtcggagaagagcgaagtgcagtcaaggaagatacggcgacgctggcgatgaatcatgctggacgaagtagaaggcgatgtagcaggaccaacggcctggatggcaacgtcgatagccatgtagaggtagctggaccaccggcctagagcggcgacggtggcaacttggagatgcggcagtaatgctcaaagtagatgaagaagaacccgacggctagagatgaccaatgcggacgacgaggatgtcgatgcatgaacggcgatgaagacgacgagaggggtgacgctgtgacccgaaggggcgacacaggtgcggcccgatgtcgatatagcggcgagaactccaccggtagtgaggccacgctgaggagggcgcctctccgtgttccaacaaccagtggaggtggaccacgggcggcggcactgcagcccaagggggcaacgcagcggcaacccgaagattgatggcgtagacgcatgctcgataacgattggttacagaagtcgttgtagccgggcacctgaacgggtgatcaagccgaagatgcgcagggctgaacgatgaaatcgaagcagagtcgatgccgatgtcggagacacatagatgtcgacgaggcagtgggcgacgcaaactcgatctctaatcgggaaaaaaaaacagatacatgcagcagcagaacagcatcagttgcaagcttacccactcacacatggtccatagaccaagtccacgtccagcaacctctctgcccaactgtaccagcagcagcgacacatgcattccctccacaagtccatagccagccagccaacaaactctctgcaaccatcttgtctctctctcctctcccttgctaatcacgtgcaagatgactagcaaagtgacggacaaccagacaatacagggagcgagaggcaagacagacgcggatgcgtaggggctgaccggcggagggcgtcgaggccgcaagcggcgacaatggtgcagatcctggtggcgaggtgtcggcccgcgccagagacgacgggccagcggcgtcttgcctgccacgagggaggaggcaggcggagaggcggtgaagacgtgggtctatcccccgggcggcagtagaggcggatggggatgccgacgtctggtggagcttgatgaagacagcggtcgaggcggaaggacctgacaacgacggttgtgaaatcattgtcatgattaatatttatgatgaacaattggttttgtaaatgatttaatcaatgaattggttttaaaagatttgtggatgttggtgggagtgcgtgtgactaatgtgggtcaggttgtgatatttgtgctcaggaacagttgttttatctgattgtgtacaggtaacttgaggtcaaccttggtcaatggtgaggaccaggactatactcagggtggagcagaggtctagtacggtcgggataccatgtgagaaggcgactagagtcaggattcttggaggtcaacttcggtcaacggtggggatcgggactagactcagggaggagttgaggtccagacggttaaggataccgggtgatgaagttggatacgagatggcacacagtggatggacaccgtgtgggagtgatcttcgcaacgggcttcacaaggtgtacgtgcaagcgtcggtgttcacggaggagattggttgagaaattggagcataagtatatagttctacagtactctaggtactgtagcggtgttactgtattgtgcatgtatgcgaaaacgctttgtatcgagcgtccgatacaagacaaactccggacagtcgacgggacccacctttccccaatcttatcctcattccttctcatccccaacctctcgttcaacttcttctcctcggcgtctccaactctccatgctgcacacgcggccgcggcgtcatcagggggcgcaggcgccgctgccgccgccgacggcggggcttcctgtgcgggtggccagattatggcgccaccagtgatgttcgtcagcggcatcgtgtggcaggcacggtggctgtgttccgggtggcgtcgatggcgacgacagatggaagagagggaggaagcgtggggtggtgctcgtcgccggcgaggactaccatgcgcttgagcggcggccggtgcagcagttccagcggtagggtgcggtgagcaccggcaaccacgttggcggcaacggggcagcacgacggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19638 - DNA, 1867 bp, Oryza sativa
aggaaggtgtccccgtgtgggacgagaataaacaggaggagtttaacctacgagcgctgctgttcgtaaccatcaacgattggcctgcacttagcaacctatccgggcagtccaacaaggggtacaaggcttgcactcattgtatagatgaaacataaagtacgtatcttaagcactgtaggaaggttgtgtatatgggttatcgtcgattccttgcagtaaaccacccaacacggaagaaatgcaagcactttgaacatacggcggaccaccgtacgaagcctaaacatcgctgcgggaaaatagtgtttgctatggttaaagatcttaaagtagtgtttggaaaggggcctggcagccagcctatagagagcgaagatggtcacgcggcgatgtggaaaaaaaactccatattttgggagttaccctattgggaattcttggacgtccgccacgcaatcgacgtgatgcacctcactaagaacctttgcgtaaaccttcttggcttcctaggtatatatggaaagtcgaaagttacactggaagcacgtaatgatctgaagcatatggaacaacgcggcgaccttcacccggaaccacaggagaaaggcagccattacttgagtccagccagctacactcttagcaaggcagagaaggaaagtatgtttgaatgcttggagagcatcaaggtaccgtctggatactccacgaatataaagcgaataataagcacgaaggagaagaagttcacaaacctaaagtctcatgactgtcacatgttgatgacacagcttctaccagttataataaggggtatcctcccagacaatgtccgggcaacaataacaaagctatgttcttttatgaacgcaatttcgcagaaggtcatcaatcctgataggttagaagcccttcagaatgatgtggtgcaatgtcttgtaagctctgagttgatattttcaccttcatttttcaatataatgacgcatctgctttgtcacctagtgaaagagatcggtattctcgggcctgtgttcctacacaacatgtttcctttcgagaggtacatgggcgttctgaagaagtatgttcgtaaccgtgctcgtccagaggcaagcatcgccaaggggtatggaacagaggaggtcattgaattctgcgtagaatttattgaagaccttcgcccaatcggggtacctgaatcacgccatgaagggagactacggggaaaggggactctcggaaggaaagcaataatgacggtagataacaatttattccgtaaagcccatttcacggttttacaacaatcttcattggtggctccttacatcgaagagcacttggctctagttcgcgccagaaacatcggtaagtccgatgcatggattacacggcatcacattgatactttccctgcatggctgcgacaacatctcatgggtaacgagacgattaatcagcaactggccttcctggcgaggggtccatctggctcgatcacgacattccagggatatgagatcaatgggtacacattctacacaagagcccaagtcatgaagaccacgaaccagaacagtgttgttcgtatcgatgccatgggacacaatggtacaactggcacgtattacggtgccatcgaggagatatgggaacttgactatggacctctcaaggtcccattgttccggtgccaatgggttaggttgactggtggaggcgtaacgattgatgatagtgggatgacaacggttgaccttaacaaggttggatactcggacgaaccttttgtccttgccaatgatgtaacgcaagttttttacgtgaaggacatgtctagcaaaggaaagaagggcaaagg

SEQ ID NO: 19639 - DNA, 5066 bp, Oryza sativa
ccctcttcagtaagagaagctttggagaatatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcgtgtttgtatggtgtaccccggcttttcctgggacggggattaatacactagcgttcgggaaaatgcaattttcccggtcgcgacaataatgcctcaacttggtgcaagagaaatataaacataagcacaatttttccaccggagaataccttgtctctgcatccaagagcctacgacttaaataaaatatagccctttcttttccttcaagctcttgaatcaatactgagccaatcgacttatcaccagccgataggtacaatctgaaaggtatccctttttgtggagaaatttgtcacaccctgaaaattcaaaatatataaattgttgtttaattggaatttttagaaataattttgaaaagtcttgaaaagaaaatctaattttaattaataaattccaatataaaatgggcccagataaaatttcattaaatactttgcttaattctataattcctagatttttctgggatttatttgagctaagaaagtatttttaataaatggaattgcatttaagaaataatttaaattgaaaaaggttttaaaaagtctcttttggctttgggccgaaagtcggcccaaaacctctcttctctctcctcggcccaagccggcccagtccgcagccgcagccgcccacgcgcgagtgcgctgtcgctgacaggtgggtcccacctgtcgggatcttcgtcttcctcgggccgaaaccctagtttcgcgccgccgccgccgctttccaatccggccgctcctttccttctccggccgaatcaatagaggggaaacattctccgggatctcctctaccttttctcctttggaatcatcggttaaatcggtttggaaatcgagggattcgagttcgtctcggattcgtttttgccgaaccttccttcctcgtcgccggtcgccgtgggcctttgccgccgcctccgagcccctttaaaaggacccccggtgtctcctctacccgtcgccgccttcgccttcgcctctcgtcgtcggaaaagccctagcgccgtgtgccctagctttgccgtcgccgccgccgctccagccgtgcttcgccgtcgctccagccgtcgccgtcgctcgggaagaccgccgtcgtggtcgccgtcgcgtcgccgtcctcgtccgccccttcgctgtcgccggagatcgccggagcatcgtcgccgtcgtcaagccgaagagcgccgccgcttcaatctcgtcgccgtcgccgtccgttcctctttcgccgtcgctttggtcgccggtgagttcgccgtgccgtccgctacccgttggtgccctccgttcgtgccgtaacgccgccgttcgccggcaagcgtgcgccgcccgagccgttcgctccgccgatgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcgaaaataaacagcagcggactagcgggcctacggctccatcttcacaggcgctcaactggggtataagccaggactccacctaagactacttctccaaagcttctcttactgaaggggggaaagattgagcaagaatgagtacaaccacagtactcagcaagccacaccggcagatgcatgattaatgcaagggggtacaaggggtaataatataggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccatattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcccacctatggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacagggtttaggggttttgaaagaggaagagaggtgtatgtccaattccaccataaaccaacaattccatagtgtccaaatgatatgagaattcccaaagtctaaagttataaaaccacctaatattgcctaattaatcagcgaagcatctacctaaattcatactagtggaaccataaatagagtacccactagttggggttttattttcctagggtgaacaaggtaataataacaatagcaataataatgtcttaacaatgataaataggcatggctaagtaaaacagtgataacgcgggaatttaaataaagcggtaatgcattaatttaaatcaaaataattttataaactgggattcaatatgctcaaggatgatgtgacttgccttgctcagagagaacggccttccgaaccttcggcgacgaccacgaaccacgctttgggaacctccggaacgacgaaagctacacgaagcacacaagcaaagctacaagcctataaagaagcaataacaatacataaaaagaaagcacagggttctttaggttataacaaacattaagagacttgaacgggtcgattcggagctcgtatgaccaagatatgatcatccgaagtttaatgctgttatatggagatttgcggattattataattaagctttgcaattataaaacatgtgtaagcgctagcctggaaaagacaggagggctgcgccgttgacatgcggaccccacatgtcaacctaaaggaccgcggtagaccgggtacacagagacggtccacgggtcgacggaagcggaccccgtgtgtcaaccgaggcaagtggccgacaaacggactccactagacaccacacggcctgcacacgtggaaaccacgcggctaccgagcgggcacactaacacggacactacacggtcaccacccgcacgcgtgaacgactaccgataccggtacacgggtaccggggtcgacaaccgcacaacgggtacggggtgacactgaaaggacgaggacggggcagcgagaggacggatccttaccaccacgcgacgaggcgtgggaacgacaacgacgaacgggcgcggcggacggcgagggaacgacttcggcggcgatccttgaacgaaggcgagacacggccggtacgaggcttgatgacgcggaggcgaggacgaagacgaggacggggctgccgcggcttgcttgacggacgcggacgacggacgagaacggcttgacggagggacgaacgccacgacgaccgggaacgacgagaggacgacgacgacgacgatgacctggaccggcgaggaggcgatgaggacagccggcagcggctgcacggggacgaggacggcggggaacacgccgcagcgatgatgatgacggaggcggcgccgcgagacgacgagccgggcgaccgacgggacgtcgacgacgagaacgatcggagacgacaatgatggaccgcggaggggtttggatggaggggaaacgatgccgaggacgaccttgccgctgcgatgccggaggtggtagtggtgcagcaagccgacgagccggggaggaggaaggggcggccgaaagaacgccggcgacgaagaggatggagaggccggcacggcgacggcgttccggtgaaaccgaggagcagccggggtggagggcgatgcggcgacgccgagggaggagacggcgacgtcggccgacgctcaggcgaggcggcagggatggctggagatggtggagtggtggcgacaccactagtcgtcggtgaggacgcgtctccggtgatttccccgcgaaacggaggcgaagccgggaaagagggggcagctgcgacgccgggagaggtggcggcgcagccggagggtgcacgggcgaggcgggaggtgcggctggaggtggccggcacggaggaaagagaagggcgacggcggaaaggcagctccgggggtctccgcgggaaatggagggcaggccggggtggaggaggtggcggcgacgctggaggaggcaacggcgcggccggccggcgcacgggcaaggcggtaggggcggctggaggcgtccagcggcacgggagagagagggcgacggtggggaggtggctagggaccacgggagaccgcgggagggggctaaagcgatagaacggagcgagagggttgcattttataggagaggagagggagccagccacgggggaggtcggaacggcggcgataaaggcggccggcggccatggttggtggccgggaaaacgcgggcgttcccggcgattgggggcacgattcaagggggaaattggggggaattgaagaggattcaatggggatta

SEQ ID NO: 19640 - DNA, 675 bp, Oryza sativa
aggcccgggagaggagggaaagagagggaggagagggagacttcggccgcgggccgaaagagagagaggggagactttgggccaaacttggcccaaaggaaaaggaggattatttttagattttctttttattaaactttgataattgtttttgttgcttaataattatttccggtgctctgaaaattcaagtaaaatttgagggctccttttagaccaaggagaatttaacaaaaattctccgggccacatttgaatatttcttgtacgtatttttagtgtttgccaatttcttttcgaattttaattaattctattattccttttagcgaatgatttttaattcgggatgaatttatcaggacgtgacagccgagccgccgccgctgtcggtgacgtcaccgctgacgtcatcggggtcgtccgccgtgagccggtcgtggaccgatcgatctcggccgtccatcttggatcggttagatctcggccgtccgttcgcgtgaaccgccgcccgtgcgcccggtccaccaaaaccctagccgctgacgcaataaaccttctcttccttttcaaaattaattcattattgcgtcataattcaattttaaccaatttaagtgttttaatccggtttaatctttaaaaattcataactaattcatcttagctccgatt

SEQ ID NO: 19641 - DNA, 554 bp, Oryza sativa
tcagttcttcaacaacaatgctggcaataacaaccgcaatcaagctccacgtcctgttgcagctccaacacagcaacagcctgccaagagggagcaaggcagcaagcccgtggtgtgtttcaactgtggagacccggggcattatgctgacaagtgtccgaagccccgacgcgtgaaggttgtccctgcccagagcaactctaccgtaccagcatcaaaggcccgtgtcaatcatgttgctgctgcggaagctcaagatgctccagatgtgattttgggtacgtttcttgttaacttagttcctgcagcagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattaaaggagtattatttctggccaatcttatcctgttagaatccaaagaccttgatgtcatcctagggatggactggtttgccagac

SEQ ID NO: 19642 - DNA, 574 bp, Oryza sativa
caataatgaattattttgaaaagaaaagagggttatggcatcaccgggctagggtttcggtggaccgggcgcacgcagacggttcacgcgaacggacgcccgagatcgacttgatccaaaacggacggccgagatcgaacggtccacgaccggctcacgggagagggcgacgatgacgtcagcgatgacgtcaccaccggcggcggcggctcggacggcgcacgctcgccggcgaacggcggcacttcggcacgaacggaggacaccaacgggtagagcgcgacgcgacgaactcaccggtgaccaaaggagcggcggaagaccaacggacggcgacggcgacgacgaaggaacggcggcaaacttcgggtcgacggctgcgacggtgctccggcggtcttcggcggcggcgaaggggcggacgaggacggtgacgacttggcgaccacgacggcggtcttcccgagcgacggcgacgtctggaacggcggcggcgcacggctggagcgacggcggcgacggcggcgctagggcacacggcgctaggacgctacggacgacgagaggcgaaggc

SEQ ID NO: 19643 - DNA, 7831 bp, Oryza sativa
tttttcttatacgcattttagtgtttgccaatttctttcgaattttaattaattctattattccttttagaaaatgatttttatttcgggatgaatttatcaggacgtgacaaatccaccccccttacaagaatctcgtccccgagattcgaggaggctagcatgaagataggttgggcggccttctcttcttgtctgacttcttccgctccgtcttctataacaaacttgcctaacaaaacttctccactctggactgcttggctcgatctcctgttgcaggtggaatcttcttttcacctgactcgaaccagggtgcacctttcagctgacgcagactaggttgcggtagtttaatgatgcttccgttccagaacttctcacgattcatatcttcggcgtcaacctcacacaagttatcaacttcatgtcatgtgtcgtaacctgcttgtcattactaggataccatgcttgtcatcatgagaataccctgcttggcgtttccttccagcttaccaccatatgctttagactatgatatcccccttactaaggataccatgattgacaacttgccattaactgtctcatattagctttcctggtctccggtgctaggtacttctgctattcgatgcaagggtcaaccactctaactataagttatgcttcccaagagaaccaatttatcccacttgacatgctttgacgtcttcccgaatgactttgctgctggacttgttattgtctgatcgtgatcctgccagatctgaagcttcgttgttagaggtgattttaatctgacctctgtagactatcttcgaacatatcacttggttcataactgggaatagctcccacgaacaagcagctcagattcactttctttacattcagtttacttcccattattatcttcaggttgtcctcagttagcattcaacgtattcctttacacctttaaccttgatgtgttctttcccattggatcatctcccaagacatggcattacctggtaaccggtgcttgcacttttcacttcgtgtagcatctgataccgagttgaagatttcactccttgccttcatagaaacacttttacctaggtcatcttgcttacttaatgacaaggtgattgttgcggggcaattactatcaggggtcttccttgagcgatgcagagcatgtttctgtttatcaatcacctttcggcctacttctttcatgctggagaacatctttgccaatctcttttatcaatcatctttcggcttatctctaacaggtggtattctttaatgtggattgcggacgcttctggggacgatgaggtcctttggcttgctgcctttcagcgaaacctggatgtggttcgtcaaaaagctgcactgactaccttcagggaaatacattgcttgctatctgtatctatgccactagggtttaattgccgatgatcatctttagtgcttcctcgagatggggagcatccatattgttcttctgccatatcacctttgacccttttctgatacctgatagactaattaccaaccatcgactattatgttctcaaatattgatgtctcctggatcttcttaactgtttgcaggtatatccgaacttatcaatgtagaggcatggcgggtacccttatgggtttcatccaacaatccttatcttgatctgtaaaaggcgtatccaaaccctatccccaactactgtctcattggctttttaacccaacacagtttaattggttttcttttccatccacaggttggttattaactcgaggttagaatatagttcctctgacacgagaccctaggtctcctttgtcagtaaacaattatacacatgatcacatatccgcatcttccaaaagaatcctcttagaacttgtctgtattacacatttctcccttattacacgaatacaaggcactgccttaaacaaaaagggaaggtgcttatcatcggtacattgtatcctcaacatgaatcatccctaaacatagcaagctcactgtttacagacatgaatatatttattaattacatgattgctgcaaactttcgattacacaatgataagtagcgaactgaaaaccacaagcgtggctgctcattttgattctggagagatatagctggcgttgttctagtgactgcatcatccttgattggttctgtgatgatgtgataggactgcatattgccatcattcacaggagaagcttccttctgagtgctgtttgaagcggatgacggtcttctgcttggtatcgccctccagaggttgattgcccttggctcggcctggagtaggtcggggagagacacaacttcttccatcgacgacaattctttgctgaggctgtcggtgcagagaatggttggtgctaaaggtattattgctatgatttattgcagagttaggtggagcaggaggagcattggtgctgtggatgatgtcgtcaatgttgctgttggagctgactagctgatgagacaatcgtagggttgttcgttggatttctgcggtcttggtcaacaacacactgagttggcaatccttgggcacatggtttgttccttcgcacagaaaacatgtcaccttgcgagtgggacactcccctggtggatggtcttcttcatagtgagtgcagagtgtgagacacatgctagcaacgtgtccaatttctccacaacgggtgcatgcctttgatccgaagaagacatatctgaaactcttagtccaaacaaatatctctttggttgatcacttgattttcttcgccatcaatcgctaggttatttgattcataataagattatgagcttacggaaatgagaccctaggtctccctaatcagcaacaaaatgtacacaactcacagcacttgcaatcttaacatggatccttcataaacttatcaaactccttcataatctcatgtttctctgttattacatgattgacgggaacaactataaaacaaaagtatttgaacactgatataagagtattatggttgcttctgactagcgctaggcttaacaggtactgcatttgctccagtgaccacttggcgattggcatgcctgcttccttaacaggtactacagttgtaacagacaataactttcttacgctcgggttcttcatcttgtacttgatttcttggctgctgtgctggaacatccaaaggtacaatgccgatactggcctctgtcttatcaactgatggctggggctgaaattgagcattgacaccttgtggtaatgcactcgctggagttggagctgttgcaacgcgggatataggactgcttcgggatgcatggatgacaattcgctgagaagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagaaaattgaattgacaatcttttggtatatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttacgttccatttcgtcttcatcatctgaggagacttgatctgaatcttcactatcagacactctacctccattagctaaaagatgctctgtcaactgtgatacacctcggaaggtatttcttctctgacgttttgtcattcctggtggaggccattctgtgctggtaatgatcatcttacggacttcatcttcggttcgcattggtgtttttcttttctgctgaggacactcccttgcatagtgcccttgctcatcacacataaaacaaatgatacttgcttcttttgagccaacatgtggcacatcaccatgggtccttcgggatgctggcggcatgctgacttgtggtgtgagtgcttggactgcctccaactgcacttgaggttgtatttgactcaggttcagaattggcgtctgatgctgctctagtatctctataagcaatcggttctggttaatcaggtgttggaccagtgtcacacaactggtgtctggtgcttcattcattcgggagcttgaggtaccaatgtcctgacttctgaccttattgcctttctcattgtcagccatctgttgcaaaggtttggagagggagagagggaaaacaaaggggagagacagattagaaactaaggatgggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaacgaaacactagagggtggcttaggttctgcgacgggttcccaagatcttcactcctgcttcacagctggcttcactgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggagaaggagaaaaaaggaactttcgcaaatagttttatttataaaatatgtccttaggttttatccacttggcttatcctacagtcgagatggctctgataccagcttgtcgcgaccgggaaaattgcattttcccgaacgctagtgtattaatccccgtcccaggaaaagccggggtacaccatacaaacacgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcgtactgaaaaggggaaagattgagcaagaatgagtacaaccacagtactcagcaagccacaccggagatgcataattaatgcaagggagtacaaggagataataatataggggttaagttttgcagtaaacagcatttaaaagtcacttagttgcccaaagccattttataaagacgatcctagagctacacagtattattaatcaaggccgtgaccccacacgaacctgccttaacccaaggcctacgatgattcagaccgaactggcaacccgaccctgggtctcagctcgtcccaagccaacccaggccaaccattccacatttcagttgttgagcaagttttaagaatttaaacactaacttgggtacattgctaggcttgcccattaccgagggcgcggctattcgaataggtttactctgatcagaggtgtacatctttacccacaagacacgtcttcctcacgtgcaaccacgtgccacataccaccacggtatacagacggaagacgtgacatagtttccaacccatcctagccatagacaagagtaccgacccaaccccacctacggccggaacttccgggacaggtaggcaggattgagcccctagcagcaggacaccagccctgtgccatgacatctcgactaccgggccgcagctcgtgtagccttcatttgtcctagagatgtccatcgacccccgactttgtccatctccatccgtgtacttttgtttataaccagactgagccacaaactaagccttacccactagacatgtggaagtacggtagtgctttgcaacagaggcccgaagaccggtccttatatggccgaggtgccactatcaaaaccatgcaccccgagcccagcctaaaaccattttgggggattttgaatagagggggcggtgtgaatccaattccacaataaaccaacaattccaaagtgtccaggtgatgagaatatcccaaagtctagagttgtaaaaccacctaatgttacctaattaaacagcgaagcatctacctaaaatcatactagtggtaccatgagtagagtatccactagttggggttttgtttaatctagggtgaacaaggtaataataacagtaacaataataataaggtcataacaaaggtaaataggcatggctaaataaaacagtgataacgcgggaatttaaaataagcgacaatgcaataatttaaatcaaaataattttataaactgggattcaatatgtttaaggatgatgtgacttgccttgctcgctttcccaaacgacggcttcaacttccacgaaaagcggatcttccgaagctgcagcgtctacacgaccaacggaaaagaaaaggcttttactctaataaactccacataacaagcagaaacaaagcactaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatcggatttattgcgtcagccgaggggaggggtgcgcggaccgggtccacgggagtggggcccacgcggcagccacacggtccacggtggactgggtgcacccggctcacaccggccggcgccgtgggtcccacgcgtcagccgcacccgagggcgcgggcggctgacggccgggccccacgcggcagccactcggcgcgcccgagggcggccaagccagcgcggccggcgggagacggcgcgcccgcgtcccgatggtcgccgccggcgaccaccggcacggtggagcggcggccgatagaagggagggtagggggaaaggaagcgacggtccacggctcaccccggggcgacggcggcgacggaggaggcggccggagcggagggaggtggtggcgcggctcgggtcgacggggtttgtgcggcgtaccggcggtcggcgtccgaaacggagaggtggatgaggtcgatcgagtatgcggcaatgccgaaggaggtggctgccgaggtgggaggcggtccggggtgatgtcggcagcgggccggagctcggtcggcgtcggcggagagatagagagcgacgtcgcgagctcgaatccggcgagcaggaagggcagcgagaggcggaaccggacggaggaggtgcggggagggtttaaatagagccggggcgagagagggtggccgggaagggaggaaaccggcgcgggaggtcggccgccttcaatggcgccggcgagatttgcgggggcaaatccgcccgtttgaacgcgggagagagagggagaaatggggggaaagagagagggaatcccggggaataattccccccactttaatgtgcgcggggacggcgggaggcggcgggattcgcagcggcggcggcgctagggcacgggcgaggcggcgggagcggcgcgaggtaggggatgacgggtgggccccacccgtcagcgagggtggcgggcgggcccgcccgtcagcggcgcgcgcgcgggggaaggccggatgggccgcggggaggaggagagagagggagggagctgggccgagccggcccaagaggggaaaggggggggggaa

SEQ ID NO: 19644 - DNA, 10624 bp, Oryza sativa
attctccgggccacatttgaatttttcttatacgcattttagtgtttgccaatttcttttcgaattttaattaattctattattccttttagaaaatgatttttatttcgggatgaatttatcaggacgtgacaattatctatggtccaatgaatgtactgtgatatgtaaagccgatgtggttaagtatatgctatcagctccgattctaaaagatagggttggaaagtggatatttgctttgacaaagtttgaccttcggtacgaatcgccaaaggcaattaagggataggctatagccgattttattgtggatcatcgtaatgattcaatcggctcagttgatattgtaccatggactttattcttcgacggatcagtatgcactcatggttgtgatatcggcttggttataatttcaccttggggggcaaattttgagtttgcctatactattaaacctcatgtaactaacaatcaagctgaatatgaagcagttcttaaagggttacaattacttaaggaagttgaagccgatgctattgaaattatgggtgattcattgttggtgatcaatcaattggcaggagaatgattgcaagtatgaaacattgatgatttatcatgagaagtaccgaaagttaattgatgaggttcggcttgtaacctttgagacatacatctcgaaaacaaaatatcgaggctaatgacttggctcaaggtgcatcgggatataagccgatgatgaaagatattgagatagagattgctacgattaccgtcgatgattggagatacgatgtgtttcaatatttgcaaaatctgtctcagtcggtttagtagaaattgcgttataaggcgttgaaatataccttgttagatgatgagttgtactatcggacgattgatggggtgttactcaagtgtttaagtactgatcatgccaaagttgcgataggcgaggtacatgaaggaatttgtggtactcatcaatcggctcataagatgaagtggttgcttcggcgtgcaggatatttttggccaacaatgttggaaaattgcttcagatactacaaaggatgtcaagattatcagaagtttggagcaattcaaagagcaccagcatcggctatgaatcccattatcaagccatggccatttcgagggtggggtatggacatgatcggccagattaatccactttcaggtaaaggacataaatttatattggtggcaactgattattttaccaagtgggtagaagctgttcctatgaagaaggttgattcaggagatgctatccaatttgtcaaggaacacattatctaccgatttggtattccccagaccattaccactgactagggctcaatatttgtgtccgatgagtttgttcaatttgctgatagcatgggtatcaagttgttgaattcttcaccatattatgcacaagccattgggcaagctgagatatccaacaagagcttgattaagttgattaagaagtagatttccgattatcctcggcaatggcacactaggttagccgaatcattatggtcttatcggatggcttgtcatggatcgattcaagttcctccctacaagctggtttatggacatgaagcagttttaccatgggaagtcagaatcggctcaagaaggacggatttacaggatacatggacagccgatgagtactacaaccttatggccgatgagagggaagatttggtccagtcaagattacgagctcttgcaaaagttaccaaggataaggagagaattgctcggcattataacaagaaggtggtgcctaaatctttttctggatgggagcttgtttggaaattgatcttgccgataggaactcgtgatagtaaatttggcaagtggtcaccaaatcgggaaggaccgtttcagatccacaaagtggtgtccaaaggagcttatatgttgcaaggacttgatggagaggtttatggacgggcactcaatggtaaatatttgaagaaatattacccaagtgtgtgggttcattcatgatcggctaagtttgccgatatatgtacaaccgatgtgtttacatcgacttgagatggccgatatagttatatcgcccttagtcgtttttcttatcataatcggctgtgactttgccgatgtatgatggctgatatggttatatcgcccttagcagttttggtttcatttagcataatcggatgtgactttgccgatgtatgatggccgatatggttatatcgcccttagatcaaagtataattttatcaatgccttcatcattgcaaaattaggggggcacatatatatacgataacgatgttggaaaaagttcgaaattaaaaaaagtatcttagctgattacagaaattgttctaagccctattacatgtatgatcattgcgacaaatatcgctggatagacgatatagcccgttgcctaatttgttctacttcttctatggcttgagtgtcttgagcatcggttccaggaataactttgagggatttagtcatatcagcaacatttctgatagccgatttcaaccgtgatttctgttcttcaattgcctttgggagatcggttagcttcttttgctctagagccaactcggcgttgcattcttcaagttgggctatgagctcaatcttccgagcttcgagccgatcaatgttggatttatcagaccctcagacagttgatcaagcttggacttttcttcgtgcacaagctgccgattggcttggattgtggcttcgatatccttgcgctcccggcgatcggctaatctttgcttggccttctccagcttgaattggtgctgctcgaggttgacggctggagtgagggcgtcggctagctcatctgggatcagagcttgaatttcgtgaagccgagtcctgattgacccacagtcgaccaccaagttgtctaatgatgatccctctagccgatgagatatgtcgtcaagtgttctcttcacatcatcggataaaggggccaaggctttgctggttgtatcttcttctgtctcatcaagatagtccttgatatcgaatgagaacagatcggctaagacctgcaagagagaaaattgaaggcagctgaatatcaagacagattatatagccgatttgagatttttaaaaggcaaaacttaccgggatagcaggagtagctgattgctcttcctcttcgacattatgactgcctgcagccgatggagtgcggttgcttgtttctggttgcacaggaggcaaaggaggaggaggaggctaaagaaaagacaagtgttagttgaacatcggctataatcagacttaaggagataaagggaaatttaccggtggagctggcttagatatagacaatgccgatttcttcttcacagcagtcttctttctctacaaagttaagattaataagcaatcggcaatttaaatttttttatctcaagaaataagtgaggtgagtcccttactcgtgaaaagtgagctggagcagcgggagttggaggagtctgcttgggtgaagccgatggtgtcttctctggatcacccaattcggctgctgcttggttgatatcctcttcgatctcttcttcatccaaagcttgttctatggatggatctaaagcaggaaaatcatcggttggcttggatttcttcctcttgacctttttcttcggagccagagttgatgggtcaatagccgatgccttggtctttctcttctttccggcatcggctggttcccttaattgcccttgaagcagacttgaggtgttgggagcatggtagccgatgacagggggagataatccacctccatttggaataaggccaggagcatagtctatgtccctgccactgttgctctggcgaggaggagaagattctgtggtctgcaagatggaagatgaaattagttaaaatattaatcggctaatggttatgtttacaaaattgacaaaaagaagaaaaaacttacttgggggatgacatctggaaagagatctgtcatatacatagaagccgattgatcgaacaaatgcagcttccattctccccaccatctgtcaaaggaccagctcctgaatcttgctaattcaatattctcaatgctgccaagttgtggtcctgggatgttcagcagccaatccatcatcaaggctgaagagatgtcacctctacactggatcttgtcggcaaagtacaagccgattagcagttgtcccattccaaattgcctagccgaagtcattgggtgataaaactcataggagacttgaatatttctcaattgatggatgccaacagggaggatacatgggctgataacagtagtaaagacttctctagattgctgaaattttcaatgattgatgtcttcaaatctgaaatcagctggcagttcaaagtccattgagtcggcataaggaaaccaggctcgggcatccttctgaaacccgtcgtagaagctgacaaaccaatccttcagcagctcagccgatagctttgctccagcatcggctggtgtagatgcatattctccataagacatgcacctgtggtgggtttgctcttccccatcttcatttgtgatcggttccagtcttgggaattctgcttctgtcgttgatggccgattaacagctttcatggctaccaaatttagccaagtttgcaacaaccaccatgatccgcctgctccaaccaccgagccaacggctatcttagctgatgcattattcaacatttggtatagatagccgaggagaatcttgcccaaggggaattgtctctttgtttctaaggcttcggctaagaactgtcagttggttgtagggctgcagcttgatccacaaaatagaaatttgtccagccacattagcagaaaagctacatgctctcgagaggtggctcgccctttgcccatgtaagctgcaatatatcctgaccagcctccaatactttttgttttgaactcaaaggtgttcttagtgttcaagctcatgggattagccgacgaggtcacatctaagccagtgagcatgatgatgtctaacagagaaggggtcataggcccttgattgaagaggagagcattaagggcattggaccagaaataagtggcagcagctataaggggctcatccttagccgaatttcctattgtaagggctagggcttggccgatcccaatttcatcccaatgggcctgcttgatagccgatactcgtttgtaccatacaggccaacttttctcaagggaaggccaggatttaaaagtgtttttccaatgacttatgtttggattggctagtctaaaagggatcctattggtttcggctatgataaactcagtaggatcaaggttgctgattggaccaagaaagtactgatggtcatgcgacaaactggaaatcgcaacaagattggaaagatgctacaagtgcaaaagaggtagagaagaagaaaacaagatgagatgaaaaaatcgatctactgcatgggaaaagggatctagccgatggatacatacctctgcgtattcggttgatggcgcagcagacgggctggttgatggtgcagcggacgggccggcggaagtcgacatatcccgcggacggaagcttggtcggagaggagatcgcttgaaaatcgccttgcgcaccgaggggatcgccggagagagagaaaatgaggtttgcttaagcggtgaaaacggaggtgacggtgtgaaatttctcgggggtggcagttagtatttaaagcaatggagtaacggtcggaaaacggcaagcgcgagtttctctcggaaatggatatggcaaatccgaaacattaccaaatattccggacttggggggcatgtgttaacgaccaaatttggcaatctgagtatcggaggtaaagattagatcgaagcggaatccatgatgaagatcgttttggaaacaaagcaagaatcggctggagtccaaatcggctacaactagatcggctgagtccgagtcagaaagggttagccgatacagccgattttggcaatatggctcggtttacgtcgtcaggctgagttaatgtgcttcacgtggattgccacacacggataaagtcctaagaaggcaattgtatctattgattaggataattttatgtaattttcttagagataagtgtgggcaaaagtctgccgcaaggtcttatggtatcttagagtttgttagagataagagtcgtgtccgacaaggacatattttgtaatctcgggtataaatagaccccgaaccccatgtaattagataacacgtgttcaaatacaatctcggtgtatcgccacccttttactttcgttttgtttcgacgagttcttgctttcgggttgagctgcatcggtttcgatcttcaactagaggtatgacttgttatggcggcttgcgttctcgggattagtgcttccatcattatgatactctaatcttgtctatgtaagttgtcgagttatcatatatcttatataatctctgataatattgctatctaacctccaatcggctaatatctatcactagggagtagtcgattaggttagatatcgatgttggcatagattatataggatatctaccactctatgaagcttccaatagcttgattgtctagatattgtcgttcttttcatacttatggttgcatcagttgagtttgatctcataagtcatgcttagaactataatctctagcctgcttcttggttgtcgattagagtagtatcggggtttcagccgatcttacctgatttagctttatattccatgtgcttagttgatatgctagatcttttaggtgtattagactttacgtttgatatattttacttgctttaatatcttaatgtagagtagtatcggaatattagccaatacacactagatctatctgattggctatgctatgaatggttatagtttccttgttaatatatatttcgatctaagtgatttatactgtctcggcatggcgaccgatctatcccaatcacttgatttaagtatatgtcgatatgaaaattatatatcattgatatgtacagccaatcgaatagatctagttcctttattattgcctcgcacagccgatcgatacagagatgacatcggctcgagtataaatgatacgtcatcggtggctggccgatcgactatcatttatggattaactatggtttatttgtctttgtttctagttgattgcaggatcaaatcaactggcatgctcacgaacctaaaaggcaagattttggacttgcactggagttaagcagatctcccaggcctcgtgtctttacatcaacactatttcaccgtggtgtttcaaatgtggactgacttagagtagactaactcacaagatagctcttgcggctgagctttttagttgaacgtaaaatgtgacgagtcattagcacgattaattgataactattaaatattaaaaacttaaaaaatattttattattattattaaaggaaccttatatatactccatccattccaaaaaataagttacaaccaccattaaaaaaaccaaaaaataataattattattttctaatttggatcacctgataaatataatacatacacccaatagaattagatatttgagggtagaagattcaaaaatgataatttagtagagagaatgtgttagttaattattttatacatgtatgcacatcttatattatgaaacatctgaaaaaaaatatgtgtgctttatattatggaaacaaagggagtcgtaagtttttttttaaaaaaatgaacatggcctaaaaagtatgatcattaataatgaagaactagctaagccctaaagtgtttagaatgcatatggtacccaaagtcttattataatagtactccgtacaaggttatggtcatctcattatgcaaaattggttgatgatgttaacctataactacattgattggtgatggtttggcatcgatgagggtggactcgcaaacatgaagtcttcttatagtactaagtagtactacactaattaataatggagaaaattggcattatgccatcgtcaaaaacaggtttcgcctaaataccattcttcaaagtggattcgttaaattgccactctcaaccgaagtctacacgctataataccatctgggacgaaaatgccatttgtcctctacttctccaactccggtcatcacgtcttggccgtgacggtgaactcttcgaccggagcccctccgtgcgaacaccggagttgaagatgcggagcccggagggatcccggaatcgaaagagaccaggggtatttttgtctgggattgcattatagcgtgtagcctctaattgaaagtggcaatttagtgaatccccttttcataatggcatttgggcgaaacctatttttaacaatggcataatatcaattttctcgtaataatgttacacgaagaaatatatataggatggtggggtgtactagctatcaagtggagaaggggtatgtatcacgcttcttctgcatgcggtgcatcgggcagttagcacatgagcccaagtgactttggtctgtgggaccaggtcggccgagtgtgctgcatgcaacttaattgttgtgttggcctgatggatattgaaaatttgccaggacaggggagacccaacgtatgtgtagctgtggggtgcatgaattgatgtatgtatatattttctttaacaaaaactcgtaacattttattaaacaagacagttcaggagagcaaacccccgtacatcgccatagatattagctgaaatcattcaaccatccttaggttcactgaactagggaaacaatcttcctaataaacataacagcagaattggagcagatcgacaggaagctccggcgatagatggctgcatatacgaagcgcgtgactatttatatgcatgcacaagtttacattagagcaagtactaaaagttactgtaagcggattatataattattagttgaggtcttagctagtatttattaacatataggtaattaatgtacggatgaactattaatcttttatagatgatatcactggtggagaaaccatctttggtcggtcggccgaattccacgatagtactggttgcaacaaaagggtaacgggcatattaacaccaacctagtcccggttcaaatgctgtcagggcttgtcaggccccccgggatctttagtcccggttggtgttaccaaccggtactaaagaacaccaaccgggactaaagtcccacccctttatatatgtcttcttcctcctccagcccgagcaagcttcaaaatttcttagaaaaagaggagaggtcattccaaaatttatagtgaatttactttggtgattatatataaatcggaggtgcctaaaaggttagcaacttcatcctccaatgtttttttttggtcatattacatttggagctatgttttgcacacttttttgtctccaaaattttgttgtaagttgatgagagagaaaatttgtgtgggaaaagaaagaatatatagaaattttgtttatttgctaaataaggttttataaaatagttgagtaggaaaatatagtgaaagttaatcttaaataaaagaaaacaaactaaattgaaaattaaaagaatttaaaacttaaaaaataataaataagaattatttggtggaatattttataatttttgtatgaataatgatatgtcattattgtatgactgtcattattggacgaataattatttgtctacgattttttttacatttcatgtagatggatcggcaatggatgtacgctgaccggcggtccaaagagtttattgacggcgtgcattattttttgagagtggccgaagctaacaagcagaagggttttatttgttgtccatgcaataagtgtaagaatcagaaggagtattctgcatccaggactattcatttccacttgtttgagtcggggttcatgccaagctataattgttggacatcccacggagagcaaggggttaaaatggaagaagatgaagtggaagacgacaatattccagactttgctcagtacgctggatttgaaggaaatcaaacgggcgaggaggacatagatgctgattataacgacgttgcggatgttcttggtcagatgttgcaggatgccaaagaggactgcgaaagtgaaaagggggcccataaattggacaagatgttagaggaccacagaacgtcgttgtacccaggttgcgagcacgggcacaaaaagttggataccactctggagttcttgcaatggaaggcaaaaaatggtgttagtgacaaggtatttggcgatttattaaaactcgtcaagaacattcttccggagggaaacaaattgcccgagacaacgtacgaggctaagaagatagtctgccctctaggactggaagttcagaagattcatgcatgtccgaatgatcgtatcctatatcacggtgaggagtacgagaacctagaagcatgccctgtttgtaaagcactacgatacaagattaga

SEQ ID NO: 19645 - DNA, 422 bp, Oryza sativa
agatatctgttactcttatctttaatcccggttgttgttatgaaccgggagttaagatatctttactttactcccggttcttctcactaaccgggagtaaagatccgggggtatatatattcctggtgcgcccttgtcttctccaccaacacttagacgttttccatcgagatcgagtatcggcttctccttcgccgccactgcctagggcaaccccgcgccgacgccgccgtcgtctctcaccgtcgcctggcggtcctcgccgactccgccgcagacgccgccgtcgcgtctcttgggtgagagcccccgccctctctctctctctctcaatgtagctctctgtctctctctctttcgctgacgaacgccgacgacgtcgacgccaacgcacgccaccgggccgctacgttacgccgccg

SEQ ID NO: 19646 - DNA, 1269 bp, Oryza sativa
tgtctaagcatatcgtaattctttctctccgtggcgtgccaacgtactaacttcgcttcgttggggttggcaaagattctcttgaaacgatcaatgataggtagataacacacaacctttgctagaccacccctctttgacttctttccttcgtcagcacttttctttcgcttgtatcgagaagccttgcagacaggacaagcatccaagtccgcatattgcttgtggtacaatatgcagtcgtttggacaagcgtgaattctacggacctctaaccccagtggacacagaacctgctttgcttcgtatgtcgtctcgggcaatgtgttctcaacaggaagcatagccttcaaaattcctaaaagatctgtgaaactcttgtccgtccatctactacttgccttcagcttcattaggtctaaggtaactgacaacttagtgtattttgctttgcatccagcgtacagaggcgtctcggaatcactaaccaacctgctgaacttcattccatctctctcattctgggctgggtcctcaacgtcacgtaacatgtcttgcagcaaatcgtgatccacatcaaccatttcaccgccaaatggagaaggtataaacatgtcatgctcatcttcatcttcctgattatgcgcaccacttctgtctgctgctgctccacttcctgattcttgctctccatgcttcacccaacatgtatagcccttcatgaatcctcgttgtatcagatgactatgtacgtcctctccgctatcaaatatattctcattcttgcaatctgcacatggacaacacatgtaatcactgtttcttcttttctgatcctcatccgcggcgttcataaaatttattacgccctttctatactccgtagaatgacgtttacatccaacttcgatcaattgctacaaaataaaaaaaacaaattacatgcacatcttataagatcagtaatgctaaagtaagacgtgatgaaattgctcaattaatgattaatattactcacttgattgatccattttgatcacttttgggaattttctgttttccttggaaaaagacaaaaaatcgccccctacagcctcccaccaaaatagtgaacagtgagatacatttacactaggtggtggggggtatttatactgtgcgacaaatatatgtaacggccctaaaataatcaaccgtgacaggcatacaagtaatctctatcgggccttaataaaagcccgtcaaaaagagtgtcatctgtgacgggca

SEQ ID NO: 19647 - DNA, 2570 bp, Oryza sativa
cgtcacagataagtgtcatccgtgacgggttttagttttatgccgatataccatggctgtgcgaccatatctcaatcgggcgaaacttcggcccgattgagattacttccttgtgacggcccgcaaattccagtcttgttatgggccgccacaaatggaaggatttgtgtatggccttcaaacataatctttaatattttttgaaacacaataaatacgcaggcgcgcatatatatacacaagggcactcaccctatgaacaaaattaacttagtatcatattgcgttcacttcttaattttttgttaattactctctctgtttgaaaatataagggattctatgatttttgtaaatcaaattatcctatggttgaccaaaattattaataaactaatattttcgatatcaaataagcattagatatgttatgatatatgttttcatagtttacttctttgacatggtagatgtaatacgcttctctacataattgtggtcaaacttagaataatttgacttgggacaactaagatcccttttgttttaggaaggagggagtagattgtttgctagataaaattaatatataataacaagaaaaaggcttgtaaaactcggtacagattacatgcttccaacttccaagttcgaacaatttccgcaataacagcctcgcagctcctgataaaacaaacccgaagaggcttcccagctcaccaaattcatctcttaattatttaacacatacacatagatgagcttgaagtacagtatagcattacatgtttatttcacttgagtgaaattagtattactcacatacttgtgtcaattagcaggcagcatttagcatgactagcattaacctagctagctggtgtaaacttcaaactagacttgtaaactttaagtattaacctagctatttgttctttgtcagaaacttccaattgcataggcactccatcatggtgatggaggcggcggtggtggtggacatggtattttagcacagattacaattgaacccatgcattcccggcgattgggctttggacgaatcacctaaaacccgccttcctgattaaaacgcacaccacacaacacaattttagaagtagcatatgaaccttatttgttggattagcttgaaaataaactggtccaagcctacctgctaaaaatgctgcccaaaagtactatacacttgtttaaaataaatctttcgatagaaacaaaatgtaattcttcctaggaagttagaattattgaagcataaaagaaaaaattcatttcataacttgaaatgaaacatagagaaaataggctaatggcccttacagacatatatacctgcaccaagtcccagcaaagcagttggcatagcaagaaccactagaaatactagcacaatcaccaaaagaagagactgagcagatggccttagctttctcatctctttgtttcttacttccacagttgtattctagaatcctgataaaccttcaccttatctcttagtaataactggtgttgcattgcatattgctctctctcttatatgaacagtccagggatctttttggatatccaattaaaaaaggaaaataaaaattatcttatactatatgtggttaggggcctgttcactttgatgaaaaaaaaccttaccaaattttgccattgccgaaattttgtcaattgtgctaaattttggcaacttgccaaattttggcaggatttcttatatagttatcaaaatttgacagcaaactaaatatagttatttttttggcaactttaacaaaatttggtaagcttgaaaatagcataaaagtgaaggcataggagttggaacttcccgaaagcactcactatcgcatgggccctctgaggttacactttgatcattgactgatttgtcattttaccaccaaaaatctaccgtcccgttcctttaaaaaaatctactgtcctagcgcctagcgtattcatgtgattctaggcggatcttcccctagcaggacaagtggctacccaggaacttagtgaataattaccccatcaggaaatggggattgattaatccacccacccatttacctgttaacgagaaaacaatagcaccaagtgcataaacgggtgtgggtatggttttgtaggacctacacctgtaaccaacccaataaataacccttatttcatatacagtaaaatgttacttggcacaccggcattttgtcttgctttttgtggatctggggctctaggttacccatcatgtgcacttttacccgtgtgaatgtgggattgagaaagaactacacccaagtactccctccgtattctaaaagaagtcgtttaggacaatgtttaagtcaaaccttgaaaatataaatcatgaataagtctcaatttgttgagtttgaaaatataaaaattatatgaatagatttgtcttgaaaaatactttcataaaagtatacatatatcactttttaataaatatttttacagaaacaagaagccaaagttgtgttttggagaccgtgtcgctgtccaaaacg

SEQ ID NO: 19648 - DNA, 1392 bp, Oryza sativa
tccagaagaatggcatcaagcccatgaccaacacagttaaacggcgggctgcagcacagatcaatggggtgtagcccaaggctaagcttaagaagaagcagcgtgagatcacacgccggaccaagctcacgaacgcccatctgcctgagctgttccagaacctcaacacttgattgctctacgcttattcgacgtcaagtggagatatttatttctgtcctcactctacctactgcaatgctttatatacctgctacccttattgtgtatgttataaatgtaattccggcctccgggagcataatctgagacggtcagctttgtaaaacataaatcaattcaagagcttgagatggcataccttcgcctgtcaatgcgttcttcaaattttcgtactgtaatgcccaaacgcaatgtgtttcttgttttcttttcttacgtttcaatgggatcctaggtgagttttggatccataacaactgttctattggcaatcgctagtacatggcaaaatcagccacagcagtgcagctgtaatgtgcaaaaggtgagtcacaatcttcagatcggattaatggaagaaaagagaggcgcactcattatgtttatggtacctggaaatctctcgtactgcaagccgcaccatctaaaagggagctcaaatgttttctttttctcgttttcaatctgcaagttgtttcttttgaatgttgaagtatctaaaagaaagatcaaatgatttccttgtttcaatctgcaacatttcataattgaaggaatcaaatgctacggatgcaatttgtttgctggtagttctcgttcagattataagtaagacgttttgagctgaatgttattatattcaaatgttcaggatttgttaagaactattcaatttcctttttttttcttaagatgaatgaactattcaattgttgaggtctgggtatagtaatggagcatgatttaatcaatcctaatctctccattcatatgaccctatagttaccttagtggaagaatgggccgtatctaccacaacatctcatggttatatggcaatgtgtctacggccgttagatttggacttacctccaaatcggcgcccgatcctctaaagaaaatcggttggtcaaaagttacggttgaccaccagtgaaacattaagttatatatggtaaaacaaaaataatcagtcactggagcatttaaaaaatttgtgaaacacggtgaaacatgttactatcgcttatgaaatattgagtattaacggactgaaacatatgttgttgtgaagttttaattataacaaatacaacagtgctatcttgttgtgaagttttaattataacaaatacaacagtgctatcttgttgtgaagttttaattata

SEQ ID NO: 19649 - DNA, 1549 bp, Oryza sativa
ccctaataagccgttttggcttattaaaaaaaagcgaaacgatgggtgcctaaaataatagctagtagtttatttttgggctagcaatttgatttgttcaggaaccctcgtttgtaacttttaggaactctgatttgtcagataaccctccttacaaacatctatgaactgttttattgtggtcgtcccgtaagatagggtgagtgattttgcaaaatggattgtggataaaacgaatgaaagtaatttttttctctgtttatctatcaattccttctgacactggcatcttttaggttggtcttgaatccctaaaccttggaatatgtccaaaattaagtgatcttcacattgaggccccaaagatgtctctattggagctgaagggttgtggtgttctttcccaggcatcaataaattgccctcgcttgacatccttagatgcctcattctgcaggttgtgtcatccttcatatttttcttctaaacatcactgactggtgctaactagctattttgtgtcttcaggaaactaatggatgattcactgtctcaaacagcagaggcgtgcccgctaattgaaaatcttatcctgtcatcatgtgtatcaattgacctcaatggattgtcctctttgcattgccttcataagctggccttgcttgacctgtcatacacatttttgaccaacttgaagcctgtttttgacagttgcccacagttaaaggtgtgtgtggttagtttgttgtactatttaaatcatttttttagtacatgtcacatagcaaatgaaaaaccttggcccagtatgtttactatgtgattttaacatatcactgctggtctgctgcatattttagaattgttgtgttctgtaatactgtttgaaaatacttgcgatgaacttatacaatgtattgcatttatttattggggtgtctgtagcagttcattttcatgctatctttcaaaaattctttattttgaggtttattctacgagaaccattggaaatacatattttaatgaatcattgaaatggctattttctgaccttatgcactcctattggcagatcttaaaactttcggcttgcaagtatctcagtgattcatcattagatgccctatacagagagggtgctcttcctatgttggttgagctagatctgtcctactcatccattgggcagactgcaatcgaggagcttctttcatgttgtacaaatttggttaatgtgaatctgaatggatgcacaaacctgcatcagttggtgtgtgggtcagatgactgcagttctggtgacatgcctgttgatgtttgtccacctgattcagcaccagtgaggagtgaagagatcagtgaaaggtctgatcgtctgcttgaagttctgaattgtactggttgtccaaatattaagaaagtcatcatcccttcaatgacaacctatctacgcctgtctaaaatcaatcttaatctgtccacaaatgtaaaggaagtggatttgacatgctccaatctttatactttgaacctgaggtattatcat

SEQ ID NO: 19650 - DNA, 734 bp, Oryza sativa
acataagctttactcccggttggagttaccaaccgggactaaagatgtatttttagtcccggttggtaataccaaccgggagtaaagattcccatgctatccccgcctttaagtccccttttttttctctcctctttaagtctctcggtatccgcctccagcgcctcctcgatatcctcttcctcccctggcccttccccttcctccttcccctctctgctccccctttctatccccgcctcctcctcctccttcccctctctactgcggccgggcggcggcgacggaacgaggtggcggcgacggagcgaggcgactgcgcggcggcggctggtggggccgcggctgtgcggcggcggtggagcgaggccgccgcacggcggcggcggatcgaaccggccgcgcggcaggcgggcgtgcgacggcggccgatggggccgcggccggcggccggcaacaacggcagtcaacattgtttttttatttgtgattcactgtgatgtacttttgtatggacaatattgtgattcattgtacatttgtatggatctgtgatgtataagatttgtgatgttactttggtttgggtttgatttgggtatttggggtttgatttgggatatgtatcccacttgattcgagagaaaataaaaaagaaaaaaaaagaaaaggaccatctcaccgccgctacctctctttggtctcggttggtgttaccaaccgggactaaagat

SEQ ID NO: 19651 - DNA, 1372 bp, Oryza sativa
tcaagatcaataatccattatacaacaaggagttacaaagtagtcaagaatacaatcacatagaaaatgtagctaactactcaccccattttcttttatatgacgttggttaatttaaaattaaataaacatagggagtaatttgaattcagagtcgttaaaacaattgaatgtactaagaatatttatagataaagaaagaagggaaatcgtctgtcataatataatttgtgcaattgtacaagctttgtcaatagtatggattagaatcttgaagataaaataaatttgtttccacatttgcctaaaagattttcttctaatcttgtgactattcgcttgattatcttcatctcaaaagttctgatatgctaacctactaaatgaaactctaatgaacataatatgtcattctccatatatttgttcctaacacaatatatacaattgttatacttagagactaaataaatttagaagcaatcatgtgtaagcaaacacaatgtgctaaggagtaagggctttaaattgaaaatcaatttattccatacattagcccaaacatctagtttcaaaacacctattgcactaacaacacttcatctaacaaatctaacattcaaaaacatatggctccaccatttgagatctatgtatttgcaagcattgcataacatttgccataagaaagaattgcacaagaaagaatagacaagaatatttgaataaaagaccataaattctgcaatccacatggttggaaagatatttatattagcattagagtatgaacaaacttccatatattttatgatgaatataaccatagattgaacaccttatgatatgttgaaatagtccttgtagacaccaagaagtttatggtcataacaaccaaaacaaaatccatgaattaaaattagatcccattagatgcaccaagatactcaaacaagaatatttgttcaccctaggtacttgcaggagcaaagtccacaaaaaatagaaagatcagaaagaaatagaaacctatgagaggaatggatatccccttgttcttcttgaaatccttctgtcggtccgcctccttcgttgtctcctatggctgcaagatcatcatcttcttatagataaagccaggtgtgtgtggtattggttcatgcaatgtttatgacacaaaatgacaaaagaggttagcaacagatagatcatcccacatcagtttccttgagtcatctgggttgtaaaatcgtgtcttgggttgcatcattagctgccctttttttggttttagtgaaggacttcaaatacaaccctaacataattgttatttatatagtcattttaatacaccctccgtactcgtaaagga

SEQ ID NO: 19652 - DNA, 3644 bp, Oryza sativa
ccaatgttagtttaaatcagtgaaaatagagcaaaattgtgtatcccatgagttaacataaatagcgaagtgtcctaaccattgtgttgtgtggtgtgcatcttttccttcttgtgttgagcatattataattcatttttccctacgttcatgtctacaatgtttgaacatcgaaacattgagatttgtgctaacatgactctaaaaaataattggatgatctaataattatataagaaatgttcagtgtccttttcctaaagagaaaaggttgcagtagcaaccagcacatagagaaaaatccaaattcaaaacatgcaacagacatctacatttgtctagttgttcttattggaacgctccagctaatcggtcgagtggacatgcaacgtgtaaagttagtgtgtgaatcattttatttatttccttcttggttgtactaccttttctaccacacattgtaggggacgattgcacaagtcacgaatactcacattatagcttaggggacaactgcacaagtcacgaatgctcgtgcgagttagaaatatttcgttgatgcaagtgcctatccgaaaagtagatttcaagagataaaacaccatatctttaaaagcaagaatgacttcgtgatccaattaaagcagcatgttccatttgaccagatcaatagacgatgaacaactaacgaaatatattttttttgtttcatttggtcaatcacaaaaaaaaaatagtgatcatacttcaaaatattttattcaaatgttgttaataaactagtagaggttcatggagtgacgtcgcaaaataatttcattctacgcctaattgacatccatttcaaaaatatatggacaaatgtgccataggatttaatttcatctgtaactagcaatctgtaatatttttcatattgagccgatagaactttatgtaatgatatgacttgacagatcggactcgtaccagtggaacattgtgttgaaattataagcacgtaataatttaatatattcatgaacagatcaaatatacgcaacatgtcgaacatgtatcgaggttgcggaaagaccagttgctcagcaggaattactcgcggttgcaggcgtcgatgaaggcgcgcatcacgcaagcggagaggaagacgagccatcatggacgaacaaggagcagtcgcgcaaagcgcttcccaaaaaccttattgccgccttctcccagtgcaggacgtcgaaggtagaggttccggagacctactctcccgatcgccggtgcacgccggcgagcgggatggagtagtctacgaggtacggcgcagcatagagtaggaggcaaatgattgatttcgcgtgtgttgcgtgaaggcggcggctcggtttatgtagagataggtcgcttgatcagggcgtccgcacgatctccactccacgtaaccaaaccggataagtcgcgcataatttatccggacttcacgccattttcacgcaccggatttttcggaatgtttccaaaacgaaacaaaaccgaatttcccgcagcaaaacaaaactgcgaggcgagcacatgcatgtgttccccccacttctctccaccacacatgcttcaagtggctaggagggcatcctcccttttaaggaggtccccctctcctagaataagtaaggtggtactaaaatctccaagcatgccatctcatgaagtgggcttttgtgattttccaaataattaatcttcaaatgaggtaaggcccatctattaattccaacacattgttatattacaccaagcatagttgcattatcatctcaaaactccagctgttacaatcccatagttcgaaagttacaactaaaactttttaagaccatcatcagtacaaactttacaattctttagtaagatgagggatcgctttatctccaaagctcaataagtctaggaattttccggtatcattaatagaaaaatgatttttcacaacacctaggattgacttattttttcaagcggactataaaattcacgcttaaaaaacaactagaggcaccatagttctagccccgccagtggaaaaagaattttacaggcgacatcctatatgtaccgcttgtggtaacagcggaccaacgtgacacagttgataaccataaaatattctaaacccgatacgagccatccccctatcactcattcaattttatcctccccctttccctctcctcgccctatcggtggcgcggaagtaggactgtcaacgagccgagctcgaacgagctcgtctgcttaaagctcgagctcgagccaagcctataaaatattcgagctaagtaaaacaatatatatttcaaatataatctttaaaaaacaattaatttctagttcatcatattaatataagagaaaaaaagaataaaataaatatatgatgttaatataaggcatacaaataatatattttatcttctaatttattaaataacaacaaaaatcatatattactagactcgttggaagctcgagctcggctcgacaaagctcgcgagcttagggagaggctcgggctcggctcgtctagagctcgagacgagctcgaatcgagcctaggacgagccgagctcgagcagctcgcaagcctcgagcttttttgacagccctgcgcggaagcctatattggtgatgggggaggggcagtgatggctcggcgaaagagcgacggcaggcttgatggtgaccgtggcgagggcaggagctcgggaaggcaacagcaagggcgactgctcaggggctgcagatcggtggcacggccccagatccgcgggtggaccccgttgatttttatttttatccttgtcattgacatgtgggtcccacaagctgactcagttagttaacagggtcaaagatgccacgtgggacaatctgcctccaaaaccgctcggggagtcaatttgtaacagttttgggagttggagggtggttttacccggttttgcagttgggggatgcgattcagccagggtcaagagttgagggataacaaataaacttattccatccaaacagctaccgtgatcagattacgttggcccagtattaaaatttatatgggcttttcggggctgtaaatgaattaggcccaaaattagaattgacacaaaccggataagactcccatctcagcgtccgtgagctaagctacctactaatgccacgtggcggccgtcaagcgggcacctaatcctcatctcgtataaataaattcatttacccccctcgggatccgagaaatttccctcctctttccacttgtcaccgccgttcgccttcccaaccacgagacgaccctgccctcgccggagatgctgccgtcggcgaccggggacatcgccggcgacgtccactcggcgcgagagatgctccatcccatcctcctttgacttcttgccgccgcgggagcttgactggatctgagctagctggattggtgggtgggcgcgtcaagaaggggatgagctttggcgccgttgacgtcgacgatggcggcgccgcggcgacggcggcggcgagtgggggtgaggaggtgagagctatgccggccgaggtgagctgggagatgcttgacaagtcgcggttctttctgctcg

SEQ ID NO: 19653 - DNA, 10588 bp, Oryza sativa
aggtcgtgtggacccccgtcgacgtcgtcagccagcgcctgatggtccagaccgccgccgccggccccccgtaccgcggcggcgccgacgcgctccgcaggatcctccgcgccgacggcgtgcgcggcctgtaccgcggcttcggcgtctccgtcctcacctacgcgccctccagcgccgcgtggtgggcgtcctacgccacggcgcagcgcctcatctggcgcgccctcggccccgcccaccacgacagccgcgcgtccgtggtcgccgtgcagggcgccagcgccgcggcggcgggcggcgccgccgcgctggtgaccatgccgctcgacaccgtcaagacgcggctccaggtcatggacggcggcggcgcgtcgctggcgtccgaggcgcgcgcgctggtgcgggagggcgggtggggcgcctgctaccgcggcctggggccgaggtgggcgtccatgtcgctctccgcggccaccatggtcaccgcctacgagttcttgaagcggctctcgaccaaggacacctcactctgatagaggcatcgtagctgtaaccagagcaaaccagcttgtgatttgtaaactgatagtaaatcgtatgcacatgtacatatctaaagcatctgcgtttcacattgatctcctctacgacattaggatgcaaaggctagattttgttggatttttgaagctctctttgtaagttgtgacgatgatgatgaaaaagtttggtgaaacgaagaacatgtatatttgcatttgatcaaaatgttatttggtggtttatgtgattcaactggatgattgttgcatgaccaaatgctgctgtgtccatcactgttggggattgcaatgttacagttaggcgtcactactgggacagctgattgttgcaccttgagattttattttatttttttacgatgaaaaatttgatgaaacgaagaacatacatatttgcatctgataaaaaatgttgttggtggtttatgtgatacaactggaagattgtttgcatgatcaaatgctgctgtgtccatcactaattcactgttaggtcattcacaatgctcctatgtggcgttcggcctggacaaagaaaaccgaatattcggtggcacatcctcaaccagcggtgcaaagccaagaacgtgtagccaaactttgccaccctttctgtttttgggaccacactagtactccgtgccgccaagaaagagaaagggagagagatgtgtcgtcgtcgtcgtggtgctccacaccgccgagctcgtcacccaaggaaggaggacgatcgggcgccgtcctcgtcggagaagcttgtcggctcgatggggaaagcgacagagaaggagaggccacggccgaggtcgatcagtgaaaggggacggccgcggtggaggtcgatatggcccccggagctcgatccgccgctcgacccggctccacgaggaagtcgaggtccgcatcgaccgccgccgaggagctcaacgtgacggcagcccctcactctgttcttgtccgccgacaatgcccgacgccagatccggtgaggtcaaggtcgaggctgcgctcttggtcgatccgcggcaccggaggaggaggaggaggaggagtggtgtgctggcgagcgccaggccccaccgccgttgccgctccgcccgctcggctcgacgccgtctctagccggctctctgtggtggggattggggaaaactgggaaaggaagaggggagagagagagagggggaaggggaaaagtgaaaagtaaagtagtactggtgggacctactatgagtggtttgcgccgtggaactcacatgttcttagtctaagtggcatacgaggtacaccaaaactttgtaattgcaatgttacagttagacgtcactactggaaatttgggaactgaaagtgcattgtgtgtgccaaatttgtcacggtgttgcttgtaggagcaagacactgacgaaacagttgatatgtccgaaattctgggagtagaatcgttgctgccctgctggaaaggcagcttgagatattttccacatgatgaccgtaattttcgttgaaaccgaacacttctactactcctgaagtcctgatgtcttactaagtccgagtttagttccaaaatttttctttaaacttttaacttttccatcacatcaaaatttttctacacacacaaacttccaattttttcgtcacatcgttccaatttcaaccaaactttcaattttagcgtgaactaaacacaccctaaagacagcaattttttttttacactaggtaggcagagagaagaagatttgatcaggtatatatgactctgcaacttgactcaaaacagtattgtgataagataagccagctagctaccggttgaaattctaataactgagttaatcaaaccactaaacacagtatcgtcatcagaagataaggcgagaaagtaaaccctatcgctttcctgccgtgtgggcccataccgatgtgcagtctgaggcgtcgtccgagtcatcaattcatcgtatcccttccgggtttaggctggtggttggacgcatctcatcatctacttcgccgacctcgacctctcaacaatggcgatccgggaccggggagacagttggtgaacaccaacccctgccgttaccaaggcaacaaacttcgcattcctccattaatctcttcatcgatctagttcgttttgctttgtttgcggattcaaagaaaccggtcttattgctacgagtctacgactagttgaactagtgtgcataagttttttgacaatgaacaaatttgatgtttgctcgtagttggggagtaaggataagcttagctccctagataacttatttcaaattaattacagggcaaacttttgaaaaattggaaggtaaagattaaattatgtgatttaagtttcagaagcatcaatgttctttatcaaattattggaaactacagatttacaattttgtatataaaattgtagatttttcgcttaagtagccgcaaaactatgggttttttaatctccaccgtagccttaaacactatttgacaagtaggtcccacctgtaattctttaaaaaaaatgtaggattttattgcagtacatgtttttgcatgtgggatccattagtcaagtaaatctgcatgcgaaaatggagcctaaagtttgtagttttcaataacgtaagcgtataatttgtaattctcaatacaaactttaaattcgtagtatcaccatgatttatgtgaagtatatgtagctttccaaaaaaaaaaaaaaagcgccagccccgttctaggctttcccattcgtaatgttcattgcctgaaagattggtcttaggaggggacggtttgagcaaaaacaatttcttctttttttcagaagtaaaaagatatcggaacaaccaatttggagcgattcatctgggactttatccatcaaaacatacatatcatcatctactagtaggactcaaataaattgttaatcatatcaagaaaatgatgacacatttggcctgagatcccaatgcttcgtgcagctactatgcaggggtgccgtcgttggttccaatgcgctgccggctatgaacacagccggcaaaacagtttcacctcatccttctgggttttggcacacacgaaatgcaaagcttgtaaggtgagcgtaactcaattggttactccgtttatttatattcaagttttagatgtgatatggatatatccgtattgtattaactttttattagtggtagacaacttacctgtcggtaccgatgtgcctcaatcgtacttacagagatagtgggatagggtgctggttcatttaggtgagtgcttgagtgcttcgtctttgctgtctttcaaaaaaaagattatatatagattttttttcttattgaactcttactaacaacatttagattttttttataccttctgttaatttaaatcaaacggttgagctcattagtaagaaaatattagtacgtgatgaagtagtgccctttgaaaaataatgcaaagctctgtcatctaaaaacaaatgcaatgcgttgatctgcaggcaggaacggcccatcagaacaagcacttgggctacgggcttatggcccactttgcgatgaacctgttggcctgtaagctgggcccactcgtccacagataagcgcagcagcaaagccacccggacaggttggcgacgcgacggcgacggcggcggcggccatcgctggcgctggccgccgatccgatgcgatccggcacggaactcggcgagcacccgctgcttttggttggatcgatggatggatggatcggcgacgaggaaaggcgagcgcccaccccgcgcgcgggagttcccaaatattccccctcctcctcctttcttcttttgatccgccgtgatcggctatctcgggatcgccgccggcgctgccgccgtcgcgcttttccttccccccaatcgatcgatcgatcgatcaggcgtgtggattctccaagaaagagagagagagggagggagcgaaagaaaggcgaaaacgcgaggccgagtctttgttggctttcgtcttttgtcacattctcccctaacctttcgctttccggtctttcgagatgaaaacaaatttgaaattactacatccgtcccaaaataagtaacgtccgtcttattaaaaaattttatgaaaaattttaaaaaaagttagtcacacataaagtattattcatattttatcatctaatatcaataaaaatagtaatcataaaaaaaatttaaataaaataaatggttaaatgttgaacatgaatagtgtaaaactgcacttatattgggacgaagggagtactacgcaacggatgcagcccggccaggcagccagccatcgacctgtccattcgcagtcgcaggctcgcagcttaccattgcagtcactaaattcagtgttactactaccaactaattacctcctcttgtactaatccgctcttcgagttgacatgttttttttcataatgaaattcattctcacctttactaaaccaactacaatcaattattatagatttatagggtttgctccctcaaaaaaaatattataaaattaaaaactactcaaaatatcatttcggagacaaagatggataatttccaccaatagttggcgtcttggtgagacgtaaccattatttctttttagggcctattcggtttgaagaaatttcatggaatgtttgaacaaattaaactatatccttgtaaaaattatgtgaaattcctacatttcgacattttgaagaagcccttaatggcttacatgtagagcatccccaggagttacaccatctagtactccatctgaaatatggcgcatgtgagcaaaaaagggcctccaacagatatgtcatcgagccatccataaatagcgcatgccaaaatgaagatagaaatgccacatatagagcatctctctcatcgtatcatatcacaacagccacagatcccgccaccttctgaagttccgcgacctcccccccctccccctcatcggcggtcggaaggagagggaggaaaggggaggcaccgccacaccggtcaccgccaccgtctccgtctcctcctccgcgcctgccgcccgtcgcccctgcaaagaaaataatagagaatagtctgggtggaatagagaagagcctagaaaagctatagttgttcaacacatcaaattgataaaaatggttcactcatttcaaatatagcaattaaaaaatttcctattacaaatatacccatttcaaaagattatcacaataaataacaccgttaattttagtcgtcgaaaatatagcccgtaaaaaatataaatgtatgattatttggaagatattactaaaatatagaagtgtgtgacataaagaatgtatggatgaaccgttgaggtggaaagggatatgaaggagaaatcttttttggatggttattcatatggtaatgggtatatgaaggatcgaatttggatgagctgttggggatagtcttatatatagtttttgtctttatcaagcaggagcataatcttcgaattaaatccatagccgatcattataccgatcgaatttcacatatatcatcagccacaactgacgacgaacaaataggtagataatggcagagagtaactaggatgaaactggtacggatatttttttccattcagacattttttgggatcggataggtttggttggatattttcggatttgtcggagatacagacccggggtatgcgaagtgagaggaatttaccttcccatcctgccgcgtgaccctacagtctggccctacccccgcaccccgcagatcgcaggagcggctggggggcctcggggtgccacgtcatacccctcgggctctcgcaccgctttgccccgaggccctcgcccagccgccatctggcgggggagcaagcggggaggggggccaggctgaaccacctttaatgcgcgcagtgccccaactgccccctgccgcattcaacgcagtaggggcagacgtgcggcgtgctcgactggcacgcgacggtcaggaatgaccgatctgtgaccagcctgtcgccggtcacatctgactggatggacggtcgtgcccccacatcgtatctgcctccggcggagtggaggtaggtgtgacccgtcccatcggaggggtcattcgaagttctccccacgagagggcggccaccacaagtcttcacccattaattggggaatgacagggttgtcccccttgtcaggcgagggacggtgctgggccccactcaaggacaaactgtggcttagcttccaggcgaaggcacgggtcgagacccggtcaaggtagggtgggcccccatccgagagaagagtaggtagaggcggtacatgtggtattcccttgaggtataaaatgaggaccttgcccactaagaaaggggacgactctcataaaacctgagctctaggagaaaggaagcaagagcgctctccggatcttagggacctttgtaactctcagcctaaatcccatacacaggagtagggtattatgctttatagtggcccgaacctttataattttgttgtgtacacactagctagtagccttgggggcggatacgtgattttcagaggcgggccttttcccccggccaaactcacgaaagggggatcccacgatctcctgctagagaggatcactcctcgacaggattcgaaaacgaattcagatatttttttctcgaaaatagaaaccagtacagtataagggcactatccattagaatcggagaacggtcggaaactatctgggatttttttatgatttccgcaaacaatgattaatttttttaaaaaaaacacgtatttatacataaatttttcatacggagtcaaatgaaatttaactttatatcaaaattatagagctcgatgagatctataactgtgttgctaataattttattatttgagatcatttaaggctctaaatattcattataaaatatcatatatgtttttacaaaatttcatatctacaattcaagcaacatccgacggagatgcgtgctctatatcaaaattgtagaactcaatgggatctaccactatgtagtttatgacatttgtgtttgaaaatattaaaagtataaaacaaattttacaaaaattgaagatgtgaaataaaataaatagcatcttcaatctatacaacaagaacataatattccatccgtcctaaaatataagaacctaggaccggatgggacatttcctattactacgaatctgaacagcagcctatccagattcatagtactaggaaatgtcccatcctatctaagcttcttatattttgggacggatggagtaagtgatatgttaagtaagctacctccgtcacatattacttgtcgctttgactttttgtttgcaacatttgactattcgttttatttaaaaaattagtgtaaatataaaaaatgataagttatacttaaagtacttttgataataaaacaagtcacaaacaaaataaatagtaattcatattttttctgaataagacgaatgatcaaacattacaaataaaaactcaaagcgacaaataatatgggacggatgtagtatacatgaagtaggcgatcttgggactagaaagtggataatcatatttacatacggatctcttagaaaacggccatgaaaattgatttttcacatacggttatgggatcgcctacaaaattgacaatataaattttagagatattgacctaaaataacaagcgatatctcttgcttgattaacgaagctcaatttgagaggcttttatatcccggcaaatatacgttactgtattcattctgtttcatattccctctgtatctatattcgttaatattcgattctattttcgtatccaagttttcgattttgaaaaaaaaaagaatacgatagaacagtttccgtccattttgtatctgttttcatccacaggagtaactcggcttcaaatagttacccgtccaaatcctgccactagctccaaaggcaacatcggaaacgcaaaggcaaccatatgtttcagatgttcttgtttttttttccttttctttttcccctcattcttaataaagagaaagaagagatcaaaagagccatgattcgcaggcaggcaacggcggcatcatttcgcttcgttcccaagctgtcagctgccacggcgcgtagcatggacatgccatgattcgtcgattccttcttcgccctgatgatgatgatgatttctcgtgcggaagcaccagcaagccaagcaagcaagcaagaagacagagcgtgtgcatcgcctgtcaaatctctccctctcaacccctccatcgcttttggctttccttcctttttagggaaagaaacgctaatggttttctccctgtggtgtctgctgataatcctgctaggcgatgcgtcagcttttcgctttgtggtacggttgcttgccaatgtggttgagtttttgtgttaaaatttcatattactatctctatcccaaaatatattccatccgttctaaaatatagcatatattcgagatttatttttaaaatataataaatctcaaccaacaatctcttcccaatatcttcacttctaaatcaattacaaccttctcctatttaattctacatactttcttaatactatgcacgaccctagaaatgcttatagtctaggataagtagtaaggataagtagtaagaatttctagagtcagtcacagttattaagaaagtatgcataatttaacgggcaaaggttgtgattgcctgaaaagtaaaggtcggtgaggaaattgaatggtggagaattgtgattggttaggtagataatgttggtggaaaagttgttatttttaaggcaaattctgaacctaaaagttgttatatttaagaacgtagggagtaccagatacaacaatgttgaagtttgaagatcggtgtagttttatgagaaagaaacttacattagtcgtaagtttttttccccttatggtcttgattgctccaagattcatacatcttcggatagcatcatctcaagttctcaacaacaaggcctcctttgaaatggaaaattttcataaaaagattgagaaaaaaagttaatcaattcctatgaaaatttagaaaaactaaatgtttcgaaggattcctgagatgggaaactccttcctttatcgaatagatgtattgtgtgactaaaaacaaccaacacattactaaagaaatctatacaaaagaatgacccacaattattttacaaatggatttagtgagatcatgcaggtggactttgaaaagaaatttagtgagattagtgatatgtccactgattttcttctcttagagtgtggtgttttatgtgtagtgtgtgcacgcaaatgtgtatatgtcgtgtaaacgttaaaagaaatgcattggcatgcttataaaaagacctacaaattgattgtgttaacacagagtacaaagtaccaattatatagctacaattacatgtacacacctcctcaaaaccttggaaaagggaatgaaaaggaacaccatagtactattactatcggactatttttacagtgagccccctcagcttctaccaaattactagacagccctactccagctccgacaaggagcatggccgtacggacggcggcggccaatgtcgcggcggatcccaactccggtggtcccgtacaccggcagctcgtccccgtaggagccgtcgcgaccacccgccggagcaatggccgcgaggctgtcgagctcgaacaggtccgagctcgcgtcgctgctctcctcacctccgtcgtcggtgtcggcctccacctccatgaccggaattcggcggcagccggcgacggccgcggccaccgcgaccttgccgtcgatgtccaggaaccggacggtcctgctccggctcggccgcgccctcgccgtggtggtggtggtggggggggtgc

SEQ ID NO: 19654 - DNA, 3803 bp, Oryza sativa
acgacgagaagtagcccctcccggggcaatccgccgtggaacccagcgccggcgccgccctgtagctggcggccaagcgacggcttgtagcagtagtagtagtggtagctgttcgccgcctcctgcctcttcttggccgccgcactcgccgcgtttcttgtccggccgtcctcgccgccctcgtccatggagtcgcagatggcgtcgagcagcgtcgacgagaacgacggctggtcaggcgcccgccgcctcgccctccccctccccctcgccgccggcgccggcgccgcccacctcatctccatgtcgcgcatggcgcagaaacagagcagaacgcaatggcgatggcgatggcaatggcaatggcgcgcgtgattcgattcgatggtggagtggagtggagtggagagtggagtggcgggcgggcgtgcgggggtgggaggggggatcttgttgccggggggcggggggcggggcccgcgccatctcggtgtcgcgcgcgcgatcgctgtctgtccgttcttccgttccacgcctcgtgctccttccatctctccacctcgccgtctcactctcactcactcggcggccgctttatttgttagctttttgctttgtcggcgccggcacgaggatggccgtacctgtgtcccctgccgctctcacgtctcactgttgctgcttacttgcctcgccgtttttagtttttaccgccatgggcgccggcgggatgatcatgggctgctgcctaacgggttgggctgtttcggacgtgggtgatgttgggttggggctttgttctttgtgtttaggaaaaagtacaccgaagttccctcaacttgtcaccgagataaaaaaacgtcctcgaactgcaaaaccagatatcgagggtcccttaacttactaaaaccggtcgcaagtggtcccaaggcagtatttcacatggttttatcctacgtggcgctggttttgtccaccgtggcgctttgaccttggtcttcgttgctgagtcaccagcgccacgcgaagctggtgggacggagtggggcagcgatgagcggacgcgtgggcagagtggcggcacccgaagccggcggggcggtgaaaccaagcggaggacgccagcctcatcgtcgtcatctttcggcttagggaggaggcgcgggagctggagcctgaggaggggctccgctagaagccgctgctgtagaaccgggagcgcatcatctcgagctccagctccgacgccgcctcggccgcgtcagtttcgccgcgcccccactccgccgccgacgccaccttgtcgtccatcatatcgaacgttgacgcggccgcgatcatcgccttggcgctccccgacagcgactcgtctggggcggccctcctgcagccccaccgccccctgcggcggcctcggctcttgcgccgccgcttcatgacccgccgcatgacaccagcggggagcctgacgatgacgagcagcaggatcgccgctcccttcctcctcctcctcctcctcttctctctctctcttgtctgggcagggcggccagcagcggtccacttcgtcctcgacctcgccggcggcggtgagctgttctccttgccagcggtggcaggggcaggagcgagagatgacgagctcgaggaggatggagaaggcagtggagcggcaccgcccgggccgctgcttcccccgccgccggcgcccgcccgcgcgccgctcctccccccgccgcttgcacccgccgaccgtcccccgtgcagctgcttcccccgcctgcgcacgccagcaaccacctccgcctccggcactgaagccgccattgtcgtcgtctacttgtcttcatccacccccaaaccgtcgtcgcgcctagacgtgcggccgccgtgtagccacccctttcccctcgggcgctgatcgccgcgccgcgccgatgcgcccgaccatcgcccaagcggagccgacgccgccgcttgcgccccctccaattggccccctgaccttctccttccggcaccactcccttccctccctccctcctctgcccggcgccgccctgattcctcccctctgcgccgcctcccggtcgccctaccaagacgccgcgccgcgcaacctttctcctcctgcgcgcggctcctgcacgcaaccgcgccgccaccaggctctctctccctgccgccaagctctcccccttccgccggccccctcttccccaccgccgccggccatcacctgcgtcgtcggcgcccatcctttgctgcgcgcgcgtgacggcgtgcgtgaggagggaaaaaaggcagagagagaaagagaacggcgaagagaagaaaccgtgagaaagagacaaaattaaaagagaaagaaaagaaaaaggaagtgggaccccctgactcctcctccccgtgaagccataaagggagagagatgtgacgtggcaacctgacacgtggggcccacgctaactcagctgcgacgtagcataaaaccgggctcaaaaccaccgaatgacctattgtgaccggttttggtaagttaagggaccctcgatatctggttttgcggttcgaggacgtttttttatctcggtgacaagttgagggaccttctgtgtactttttccttgtgtttatttgtgggtcataatggctcagtaatgtccaatacgagttgtttgcaaatggaataagtttgatttaggtccatgatattgacgtcgggtttgaattacatccttcaacaaaaataccagatataacgtggctctcaacttgtaaaaccggtgtacctcgaggtcccaaagtagtatagtgcccggttttaactgacgtggcaagttgactccaatcaaacctggttgagttggcatggcccccacatgtcaccaagcctcctctattcctcctctctccccctctcccccactctcctctcttcccccatctctctaccagctaggaggcctacagtgggtgccgcccaactagaagaggagcaacggccatggcggagcttgtcaacgagacgcaacatctccatctccttattgaactcctcctacacaatatcggtcttccgccacccttctactccgttgcggccgctatccctctcctcgtcgggttggatgtactccaaacttgccgaactacaggaaccattcagagacttcctcatgtgtacacgggtgagcatgtccgggtaggaatacaacgcagacataggccaacaaagggaggatatggacatgtcctgtgtcacgaagaggaatcccccaagctcctcatcttcggtgtgcgctttgctcgcccgcgtgcactcgtcgagcatgcacactagcatgtttggtggtgagcgacggctcaccctccctcgggaccctcgctgaggccgccgatgccgaagcagacaacaacacccctcacgtgcctctgtcaccgacatcttcatcgccacctcgctgctaagcacatctgcctctaatgattgcatcgtttcgctggtgccgcttccctagctcccgccatagggctggattcggtgctccgaggaagctcgacttgcaccttggaggctaattagccatcgctaccaccacctagtggtcggcgggcatggaggtgcccctgtacacctctgcatccacactcaccaccgcggccatgctcccactggtggagaaaccgtctttggtcggtcgcccgaaatccacaatagtctcggttccactaaaaaccgggactaaaaatgatctttagtcccggttggtggctacagcgggtatatttgatctttagtc

SEQ ID NO: 19655 - DNA, 18181 bp, Oryza sativa
caattgggactaaagatcgatctttagtcccgggtatttgaacggggactaaagataacgatctttagtcccggattggtagtcccggtttaaaaaccgggactacaggggggttacgaaccgggactaaaaagcacttctccaccagtgtccgcatcatgatgtcctcctcctcgctcaccaccaaactcgatggcactgtctctaccctttcccctctggtcgttgcctgtctcccagcttggaaagagatggggaagtgaggggagagggaagaatagaggaacatgggttggtttgtgacatgtgggcgcatacgagtcccatgctgactcgtcgtgttgactagagttaaatcgctacgtcaatcaaaaccaggcactatactgctatggaatcttaggtacaccggtttttcaggttaagaaaaatgttgtatctggtgttgcgattttttaggatataattcaaacttgacgtcaagatgagggatctacaaggaaattattcctttgcaaatagcaatctccttggggcaagggatgcataggatatccaagcaagagtagtataactgggcttggtttatgtagaatgactggtgcagtgacgctgaacaaatggtcctgatttattttttactgtcagttacctatatttatgcaagatatgtacataaggtgtataagcataaacttacatgatatggaaatacaatactaaatgtacaacgaatttaaatgcattgtattggaatcggtctagattgataaaataattgataagtaaaaaagaacaactgacaaatacataaccatgtaaaaaagtagtaggacgatccagttgcgtaactacatctactattaatttggtcatggacaatcaaagtacgccaattaatagtcggcaatagtcctgaacaatcgaagtacatcaattaatagtcgacaaattagattcactgtacctatgatattcccttcaagcttttttttaataggaaaaagaaacgctgaaaacaatacgtgttgttctatcagaagaaatgtgatggcgacctgaggccactgctaaggggaaacaaactccaaaaacataaactgatataaacactaccagtagtaacagatatttagatttgtagccccaaaatatatcactaggggtgtgtttaattttcacaaaattagaagtttgatttaaattggaacgatgcgatggaaaagttggaagtttatatgtgtagaaaagttttgatcagggccggccctggccctatgcagccgaggcgaccgtcgggggcccatgatggtggggggcccatgatagtggggggaccaatacctaatactagtagtctagtatctgtctatggcctatctggaagcagaaacgccgaaacgagaggagttggagtgttgtcgccttatcgcccaatctgagacactattgatcttaataccgttattgatggttttgcatcaagaaatgcccgaagaagtatcttttcatgagaagcaatggatatgatggggttcttttcttcattaaggtgatgattagttccaaggtataaatatattgttgttttggttgactttatttctcgataattaccagacatattaaatttaatatatgaaagtatttattttcgttttgcaaataaaattagcgtctatatatatcataaaattttatatatatagcttatagggcccatcgcgataagttcgcctagggccctcaaaatcataggaccggctctgttttgatgtgatggaaaagttgaaagtttgaagaaaaacatttagatatgctcttgtctatatttattgtatcaggaaacgtcacaactttttatgggcggaggggtagctagctaaccgatagtgtttttattttaattgtcatataattggttgatatcaataaaactattcctacattagtatatttgtatattgtaattgtaagtttgtaaccggacagagcatctgaccgaaggcatcgatccgggcaccccacactggctgtggcagcctaacaattggtggagaatttgtgtctgaaattacgatcatgtccctgcgtgatgagacgacgatgcaaagcagcaaaggtgcaggccgccgaggaggcgacaaagcacgcaggcacgtggaccaccgcacactggagaatcagcggctgcacgatctgaatctgagatccagccaaactgtcagtctccatctcaaatctcatctcgtgatccatcgtgcgatcataattaagtacgttaatctaatctatcaatacattactccattatacatatgctcccagctggcctagctcttggccttttttatacaagtcaggtgcaaagcgcgcgctcactcagcacatatcattcatgggtagagtagtagtcaatgtctacacgtctacactgatgaacacatgacaaagtttggttttgcttttaaacacttaaaatattttgtttttttttgttgatggacacttataacataagaacaatgtttttgaactcacaaggagaaatgaaaaatagccattgctgagggagctagttcacggtcgcggcgcagtagactcgcatgagaccggtagagcggtctcggagtaggcatgctctaggtgacgaagcaagtgtgagaacaacaaagatggataaccctttagcatgtgttttgttcaagagtttggatagatcgggttagctaggttaaatccatttatcagaatgttaggtttggggatatgcaagataagcgttggaggattaccctttatcgggtgctgaagatgatgttgctggggttactcagaactgcacgatacagctctgtgttcatgaaaagaaaaggatagcatcaatatattctgcagtgctacatacaatccatctccttcttatatatactactgatcctcatattttatcccaagaaatatatacaaaatccggatgaacagggttctaagaaaaaactctgccaacttagcttgggtcttgttttgatcgcctgacacccatggatttgtttaccccattttcgacactgtgcagatcagatcccaacaaatgcatgccattcaggagtacgatctctacttaaacaaaaggaaaaaatcaggatcggagctgtattgctgtccgggtttgtctgtttctctgatgctgcgttcgatcggctcgcgtggatagaaattttcagcccattcaaaacgagagtactcactagcgcataattaattaaatattaataattataaaactgaaaaacgatctatttaaattttttaaacaacttgtacataattttttttaaaaaaatatatcatttaacaatttaaaaagcgtaatggaaaatgagaaatttgaattttggatttggagtaaagaactgggcctagtataattcgtttatagctctatgagttcaggtcagctattgggttaccgttcattcaaacctggaagacattttgatctcttcaggaaatttataatcttcctatctaatctgaattagcatcacactcaacttggttgcatttgatgcggtctttgccttctgaacagggtacacggtaagcactaggctttggctttggatggtgcccacctggcccagcccacttgtaccaccggatctaaatccaacggaccagattggattggattggattggaccagtagggtacagtacttaactgaaatgtgggggtgaaagtggttaagacagatcaccagatcctccggtccatgctggtggggcctaggaagcaggcgtgtgtatcgagctgactgagctgtgggccccatggcttagatgctattgctgcaaggtgataaacccataagcacagtcaacttcgcttaagttaagggaggctaaagcaacaagagatacgctaactcggcattttctgatgaaacccaaatatctatggcagtgtttggcaaatagaaaagggaaataatttttcatccatctttaaattctaagcatcaattattccattttcatttaatcctaaccttttattcatttcctaatcccaattccgccccccatttcccattatccaaacacacctcatataatcaaaagaaaaaaaaacatattgcctactccatctcaatttgaagctgcctactccatcttaatttggagctatgttaaaaaaaagagagatagatttgtagggagaattatccctccaaacattttttaagaagaaattatgagcatgttgagaattgaacacatgacgttagaattaaaaccacataccccttaccaccgcactatcaaatgcatctatagaaacattccatgtccatatatatccacaaaatctacgaacaaattggtaaggtctactcatagaacatttcacatttacaactttagtcattgattgttgcagtcaacatcctgccatacgggcagtgacttgaggcagggtagagatagggcttgcgcaccaacaaacctcaacactatatttgccactgcatgctcttcagttatgactggtagttcgttttggttaggatcaaaacttgtcatgaccaggaaactagggaggatatatcgtagcaggattgtgttcctatatatataagacccgtccgatctcgttaaatcatatgaaactcttacataggatcgggatattaccgaaattaaaataaatactaggatcaatatcgttccttgtttgctacgaaaatactacgatacatatcatacatatcaaagatactgacaaccttaagattgaggacagagctcttgcaacgccccctactcgtgcaatctacatcccttctggtagaggcggagccagctctcggacaagtcaggtagtcgcccaggcttgtccgcttgtgtctttactacagataaccatcaatgtctgagagaattggttgatcgtcaaaaaacggtacccccctcgttcgaaaatataagcatttttagcatagtgcaaagtcaatttttttaactttaactgttaataacaaaaaaacaaacaagatcaataatgtaaaatcgatgttactagatttatcgttaaacaagctatcataatatgcaacattttttatttaaaatattttatttttatagatatgttggtcaaataagcatctcgaagactgtgttgaattctttaaaaaatggttatattttagaacggatggagtattatggcttgtttggatcctccgagctattaaatagccctctggatccaaacaggcctatatagcgcatctgtgcttcgggatcctgctggctcatccactgccttccggcgaacttcggcaggcgacggagctacggagtagctagctagcagctgccgctctccggccggccgggcggcgacagaacacgcatgcacgtggaactataaataaagccggcgacgatctgaatctgagatccagacaatggatgaacaggcatcacctcgtctcacgtctcgtgcagatccgtcgctgagatcaatatacgttgcctagctagtggctaatatttaatttaatctagtgtctaatactccctccgtttcaaattgtttgacgccgttgactttttagcatatgtttgaccgtttgccttattcaaaaaatttaagtaattattaattctttttctatcatttgattcattgttaaatatatttttatgtaggtatataattttacatattttataaaagtttttgaataagacgaacggtcaaacatgtactaaaaagtcaacggtgtcaaacatttcgaaacggagggagtatttaatttaatcagtgattgtaatttagtcagtatgatcgatcaggcatgttatcttatctgtccggactttgtcaggtattattttggtttcctaataaaataaatgtattattggttcaggtaattcgatgatctcatcccctccgtccaggcaggagatgattatacacgcgtgcatgtctagaatatctcgccattttattatatatatttctcatccgcacgtaaaatgggcaaaatgttttttttgtgcatgtgtgatgtgaaatatgtagttgttggacatcattattgttaattaaaacgatcaaaacataaagcagaaacattttagtagttgagatgagatatttggagtcatcaaaaagagaaaaaaaaacgtgatgcatgtattggttcgataatttaactattttgattctcttatttataatcgtcgtttagcaatttgttctataatcctattattgttatcagtcttgttaatgtgatcattaaaaaaatttctaatcctctctttcatctccagttctccactggagcaaagcatataaataatatcccctgatcgggccactgtcttctgtctcaccatccgcccttcatatggtaggtagttgatcatgcatggggtaaggtgagttgaccacattcaccattagagcaagtttaatagtatagtcaactataagttccaaatcccatctatagtcaattcatatagtagttatctataaatatatactacactattaatacatggtcccacatatcatacatacatggtgtctgagagtctatgctgtagctggctgtaaatctgtagccctctcatcttctctctcctcttttatattttcgatatgagtttatagctgacttatagtagggtcatcaccacatgataatatttttcatcttgtcagtaaaaaaactaaatttgccgcgaaaccatgcattagcaatgaccttgcacttaggcttgcgatctccgaagccacccattgtgcttcttatatggcttaacttctttcttgaattttgttcggttaatcccgccctcaaagggattgagggcttatttcgcggtagtctttctccaattagacttcccaaataaaactctccaaacacccatatagctagctctataattggtttcgcaagccaaacttgttgctcactccaacaaactgttcctctactttctctactctgaatttatgacactaaggccttgttcgatcttccattttagagatagattgttgatacacgcaaaacgagaaacctcattagcatatgattaattaagtattaactattataaattaaaaaaaatagatttatttttttagcaacttttttaaaaaacacaccatttaactagttgaaagaaaaacgacgaaattgtagtttggagttgaagaatagaacagggcctaagacccatatgttagcctctaccctctcccccctctttctcctctttctccctctctccctcttctctcactggggccatcccagagctcctcccggcccactccctctccgcagcgatgatgtccgtgcgaaggtggatggtggtggaggatccttgagtgcgaggtaggggtggctgacgccgaagaaagggaggtcgtcgcccgtgctatggcagcatcattggggcgacaatgagcgggaggccacggcggtgaggaggcacgtggaggctgtggctacggagtcaagggagaggccactgtgacagagtcgagagagaggcgctctcgacggtgccggttccgccgctcaccttcccgagttgcaacctttaacattgctctcgaatggaggaagaaagtgaatatgaggtagtgggacccacagaaggtgtgtggattgtaagtggagtaagttggccaagtttgacgagttaaggagtttggccggccgaatagtttggagagtgtgatggagagactatatgaatgcgattttttttatccacaagtgctaatttttgtcttttaaagtgggatgaagatgctctaacttaaaaatacatttttgcgagacaaatcgataaagctttttttaaaaaaattttgacgaagggagtatattacttatggcacatttcaaatttaacgaaaatggagaacaaacttccgctgcgcacaaaatgtgcttctcttagttcatgaccaacaatatccctaaatgaaacccaattctaaaattgaggtttattttgtgaaaagcttactcaacaactcccctagagatgtatcaaaaaattagaatcctcttctcctcctttctcgctctccacaagtcgagagatactctcgctccaaatttccgcatggcgaaaggagtgggtgacaagtggagagatcgtgtgcgtgggaggcgatgggcagagcaattttttttcgtatctgttggtagttagggggtggttccattttttattattagaagttagtttacaccttaaaatcaaactagaaattcaaaaacataattttagagataaatttttaggtatatcttgggcatattaaatatttaggtatatcttgggcatattctttggtactccctctgtcatattttaagtgcagccatgattttccgtgcacaactttaactgtccgtcttatttatttttttaaaaaaaattaaaatcataagtgacgtaaaagtactattcatatttgggtgaatagctaattaagtccctcaagtttcaccgaaggctcaatttggtccttcacgtttcattttatccacatagctcctctaaatatttgttttggcttgacatcatacttgggcccacttaatatgccatatggctatttttaagtcaatatttctattagaaaatatcccttttgcccttaatttatatacaactatatactaaaagggagaaaaccaagatgaataaacaacattgcatatatacttcccattatttcaatatgtgcacatgaaacttaagcaattactatcgtatacacttgctagtacataatttattttcgttttacataatttactaaacattatcttaaaaaaataaagcatacaaattttctcttatatatgtgaatgatgggggtataagtgtcatttatcaagagagttgttggtttaaggataagtttgaactaaaataaaaacttgaatgagtaatatggatagactgaaacattaagaactaaactgagctttggatgaaacttggaggaccactttagctattcacccttcatattttatcatcttataataataaaaatactaattataaaaaaatttaaataaaacggacgataaaaattagacgcaaaaacttataactgcacttgaagacaggggagtaccggagtgccatttaaaattgggaaaacggaaaagtgaaatattgagctgaatttccgggcgctggggagtaggggggtcaaaagagtcatttccgcgtatttctcgcccgttcgccatctcttgtcgtgtagtaccgccgaaaaggaatttccctttccgcccctgcgctgtgcgctccactccactacttgagtcccccatccccagactccgccaccaccacctccggctccccaccccgaccagcggcgccagagcagaggcagtgaggccgagctcctcgcctcgcctcgccgtctccgcccgcgcggcgctgccgccgagccgccgccggcctcctcctcctcctccttcccggttcggatcgggcccaaggtatatgccactcgtcttctctccctcctccccgccgcttcatgagccaccggagattgccttgaggggatttcttcccgctcggatcgacggatccagtcccgtttcttccgggttcttgcggtgtagagtcgtagtcgtagtggtagtgttggtagcggcttgtttttcgagggagggatttgggggggtttggttggttcgggttcttggggagggtttagctgaacccgtgaggtttctgaggtccccgcctgaacagatctgtggtgtctccgtgtgggagcatgttttgctgcgtgcgtgcgtgcgtgcatgctagccatggattggtgctcacgccgcatgcgtgagctttggggggggggggggggttcagttgttgttggattatgtgagcgagaacgcatgatacgatgcaatgccgcggtcctttttgttgtgatgggcagcctcacagcatgcgtgctgcggcattcacatggacgtcgacaccgtgtcgattctttttgtgtctcttgttgtgttgtgaaatttttcatgaatggtgcaaggtggcggttggtcttggatgtggatgttgagctgggaggatcagttatcctacaaattgcatcttagtagtacatatgttgacatggcattactgattcaccctcctttttttgcttctgcatgtcattgccctgttaccccttaaaataggttctattatggtatacctatccagtgtgcaagaatgatatgcctttgacattgttgcgtcatctttacttggtactttagatggtaaaatggaagtgtgatggatgtaactgtgtcaatacagcggagaagatattaatcaataatcatgtacatttgttgtttttggcatcttctcatgtaaaatcttttgggtctgttcttgttatgtgcttcactttcacttttactgttttttttttaattttcaagaaacatacagcttcagtgtggtgattgataaaaatcattactctaactaattctgttttctcctcgaactgttctgttcctagagccggactgcagccatggcagatctgcaggagcccctcgttcgtccgaagaggaagaaggttttggtggactacttggtaaagttccgatggattctggtgatctttgtggtgctccccatttccgctctgatctacttcaatatctatttgggcgatgtctggtctgccatgaaatctgagaaacgtcgccagaaggaacatgatgacaatgtgcaaaaagttgtgaagcggctcaagcagaggaacccaaagaaggatggccttgtttgcacagctaggaagccctggattgctgttggcatgcgcaatgtagactacaagcgtgctaggcattttgaggttgacctttccgccttcaggaacattcttgagattgacagagagagaatggttgccaaggttgagcctcttgtcaacatgggccagataaccagagctacatgcccaatgaaccttgcccttgcagttgttgctgagcttgatgaccttactgttgggggactgatcaatgggtatggtattgaagggagctctcacctctatggtcttttctctgacactgttgtcgccgtggaagttgttcttgcagacggtcgagttgttagagccactaaggataatgagtactctgaccttttctatggcattccctggtcccagggaacacttgggtttcttgtttccgctgagatcaaactcattcccatcaaggaatacatgaggctcacatatactccagttaaagggtcactgaaggagatagcacaaggttattgtgattcgtttgcaccacgagatggtgatcctgcaaaggtcccagacttcgttgagggaatggtgtacacagaaaatgagggtgtcatgatgactggtgtttatgcttccaaagaagaggcaaagaagaagggcaataagatcaactgtgtcgggtggtggttcaagccttggttttaccaacatgctcagacagcactcaagaagggtgagtttgtggagtacattccaacaagagagtactaccaccgtcacacccggtgtctgtactgggaggggaagctgatcttgccattcggcgaccaattctggttcaggttcctcttgggctggctgatgccaccaaaggtgtctctgctcaaggccacacagggtgaatctatcaggaattactaccatgacaaccatgtgattcaagacatgctggttcccttgtacaaagttggagatgctcttgagtttgttcacaaggaaatggaggtgtgtttcacttcggatcgaatatttgatgtttaagtatcaaatatgcatttaaaacgaggcttttcaattatataactacttctagaaatgaatattccatgccataaattgttatgcttgcacatgcattctattacttatatctttgggcttgatgtaagttcacctaactattcttgtgcctgtaccaactattttagtgtactgcaatctactgctgcttacagttcactaataatttctgttattaggtttatccactgtggctgtgcccgcaccggctctacaagctccctgtgaaaaccatggtgtacccagagcctggctttgagcaccaccacaggcaaggtgacactagctatgcccagatgttcaccgatgttggtgtgtactatgctcctggtgctgtcctgaggggcgaggagttcaatggcgctctagctgtccacaggctggagcagtggctgattgagaaccacagctaccagccacagtacgctgtatctgagctcaacgagaaggacttctggaggatgtttgatgcttctcactacgagcattgccgccaaaagtatggtgccgtcggtacctttatgagcgtctactacaagtccaagaagggaaggaagactgagaaggaggtgcaggaagccgaggccgccatcctcgagccagcctacgctgatgaggcgtaatttcgttgagacctttgatggtttagtcgtccgggttttctccccattccaaatgggatttttcatctgaactatccttttgcttagaacttgatgtgcagtgtttgtagcactttgtaatcctgtcatcgtcgtccgtctgctcttggtacttctttcacccttgatcaagttgctgaacttagtcaggacttaagtggtatttaacccaagatctgaataattttgtggctactggactagttaatttcctcagctattaatttgagctgtagcatcagatgaggtgaactttagcaattgagctgctgtttctggtgtgtcattattcgtcaagaaccttttctgttcattttaatatacttgaactgatcaccagtcactatcgcactatcgatattgatcatgaaaagcaagatcttgaggaaaattgagtgatggggttggggccaaaattgtgggtcgttgcaaaggagtactgtttgatccacaagaggataagagatgatttgagggaaacaggagaacagtgttgcagacgtgaatgggatgcatgtgctaccggttatgttctgttacatagaagatggtacatgtaccaccgctttgaggctcttttcttccccttgtaattcgtggtggggttgaattgattcctgtagaaaataaacgctgctcaccctttcgtttaattctcccaccaagtggattgaacgggatttgaagagaaataataacacacatcttcctcaattctctccaatctctttcttacgacaatgccttatgagatacaatggcgttctcttttgaaacaaggggatttctgattcatgtgacgaggtctctgtatcggagtcctaaccattggtgatggaagggacaagaaataattcttcatatatataagaaaaaaagagaatataagtggttccttttctttatatatgaaattcgattatttcatttgtgttcgcgtttgagattttagttgtgacttgtgagagaggccccagtcatctccattccttaggggttccccaattacacatcaaccacagctcattccttttctccaatcataaataaactataatctctatatttttctttcatccccattctcttctttctaattaaaatagaaacggcttgaaccatactcttagtatttttaaagttctacattcaattagggaggtagagcttggatatggatttttcagaacttccgcttggaggaaatggacgcttgattgcataattgattgcatccaacaaattttagtaggccatgagtaccttttctttataggaaaagctctccttttgccattccttgaataccgtattatctctttcaccatcattttcttaacttctttctttcgccactattaagtggctattcagttctcttttgcgaccacaacctaaaaaattcctttctttcctttcttttttttttcagaatattatctttggtcaaagtcagttgaccattgcatatatttctcctaaaagaccattatgttctcatgtaactaaaaattataaggatattctacaaatcaaggaaaacatgattattaatttagtttttaatggatgagtaaacactttatgatatgaaaatttttagttagtttgcaatgtctccattcatagcttaaatgaaatatttcagatgaaaatatctcgtatatccacatatatgtattgcagaactatgaataataacaatgaaatagcaactataaattattttatgaaatatttaaaaccaaaaaatttccatgttgcttttttttaaagttaatcccaattagtttttctaaaaaaacatatttcaagtgcccaaaatttgtttccttgatatttttgtggcattcgctaaagtttcaagcgttattttgttttggaacatctttaaaagaaaaatggtcttccaaaaaaaaaggcagcctaggaggagatgtgacctcacagtcaggtgtcatcgacaagacgaagataacaaaacaaaagcgcactaccggaagaagagtaaaagagaaaaaatgacgacattaatttgagagaatatggtttcaaccgaaccacgaaaattgaaaaaagaaaaaaaattctcttctttgtatcgtgtggacaattataaccttatagcatttttgattggactccaactttaaattttaacttaagagtttagatttagagtgaaattgtgaagcagactaaacccagttttatttctgcagttcattttatgagagcattcttgctagctccacttctattttacgtgaaatcgaaacattttggctgaaaaaaagaaattgtttggctgtgggctctacctcaggagagatgtgtagcttagagctcggaggtcggcgtgccagccaaacaggaccttgaaaccaaaattattaaaatccggtgtaatacgccctctcgcaaatcccatccgttgctccgtaaacggacggccaggattcaaccacggcaaacgaagcctcgcctttatgaaacgagagaacgcaccacccatctctctccacctcctcctcctccctctttctccgcgagagagaggccgagcagcgaccgcggcggcgctctcccccctcccgccgcctccacccaccccgtgctcgccggcggggcgaagcctccggtgacaatccccgatccgatcgccgcgctcctctcctctacccccatcccctcctcctccgacgcctccgcccgcccgccgccgtacccgtaccaaccggaaagcgcagctgatccggtacgaaaccctagctgatccccgatctggtgcgcgcgcgagcgcgcgagatcttctggtgggtttgcggttggtgattggcctctctctctcttttaccctagtcgatctccccgttcgtccccttgacctcgagttcgaccgccgcgcgccgatctccaatcccgcgcgagcagcgggcgtctgtgcttccgcgcggaatcctcccgcgccggtgaccatccgtacgaaatcgcacgtccttctcatccctaggcacgcttttcggtcacctcgaatttgcgttaaccctggcttctcttgtagatctggaagctttttctatatgcctttaccatactagtaacaacagacactttgttccctcacaaaattcatagctagtgctggcttactgcaagacgtacccatattatgagattgtttccaaaaatccaaattactgtgattgcaataatgtaaataaggagccatatcagaaattttcatcgaaactgactggccatttcggacgcgaattcgagggcctatagctgcttctgccttgcaacggggaggagcatacgattgattggaaattgatgtggttgcgagaacgtaaatgagtaaccatgtgggaagtttttactgaaaatgtttgagcataagtatattttggctgcgtggtgtctcttggtggcagtcttgagcttatctgcagtagcttatcctttgaagctgaattgttgtcaatatgttaagataccagctgattaatttgttgttgtcaaaacctgctttggtccattcacaccatgtgctttaaccttttatctcataggttttactgagaaggccaaagtaaacagtgtgcattttcctgttcagctgtttctattcatcgtttgttcttattcctatcacttaccaaacatgtcaattttagatggatctcaaggatagcctctccaaatttaagcagcagcaagagaggtgccaatcatctttggccagcatagctgcatcgacctcaaaaccaaagcacagggcccaaccggttaatgctccatccgctccagcaaggccactacaacctattaagttttcaaatgatacagaaaggctacaacacatcaattcagttaggaaatctcctattggagcacagatcaaacttgtcattgaattgctgtacaaggtaaatctcactaagctacaaccttgtttcattttcctttccataatagtataaacaggaatgttcccccagttctggtatgtaatgtcttccaatgatcctgcaagtcaccatgttgattgagtttatatgccagtaaatgccaatggttctgtataatctgttaccatattagaatattatgcccttgattagtacttctttttttttttggatcaatggagcctgaattgttaacatattatatgagagtgcataagacgtttaccttttgctttgttctgttatttatcattgtttcacaccccttggtgcatgcaagatactcagccagcaaattcagatatgcaaaatttggtgccttgctgcttattctgtgttcaacaatgatgtgcatgttgatatctggttaaagatacaaggatgcattgacaataactattataagcaatatgtgaagtacacatttaatttgtattaatgctgcatacagtggtgcagccaggattatatgctcaggaagaaaatttgtaagggacaacccatacaacttgtagctacaaaagttgttaaaagtaacttatgtaatttatagaatcacagtattaaagagcactatgatgatttccgcgctggtccattttctgcattttagttatagttgtcaaaatggtttaccaatgtcttcatgaatgatagcaaaacaaatgttttgtgaacttccttataaatagcaatgctgtattgcgtattgttgttgtaactgagatgtcttcaaaatctgcagacaagacaagcttttactgcggagcaaataaatgaaacaacttatgttgatatccatgggaataagtctgtctttgacagtctgaggaacaatcctaaagtacattatgatgggagacgtttctcttacaaggtaaagaagtttgttattccagtaactactagtcttgctaacatcaatacttgtttcattggtatatttacccaattgtctatccttcctacctgaaataatattaatggctctcatcctatgttccccactaaacataattaattcagaagtattgcttaatgccttaatatcatattgcatttcgactattaatcactggtgtggcaagctaaacctgtcatgaccatggaatttgtaattgataatgaaatgtttttctttaatgcttgtttcggggaaaatgatataatgatgacaattatttatgggagaacatcagaaatgtttagtcttaagtttacataggcttcccatcttgtttgaagttgatttacttctacggtttcacgcgttaatcattgttgataaacgtgcagtccaagcatgatttgaagggaaaagatcaactacttgttttggtaagaaagtatccggagggtcttgctgtggtggaagtcaaggatgcgtacccaactgtaatggaagatttgcaggtgagccaaatttcttacattatgctttgaggcgatgtcttagatattactgttcttcaacgctcaccattttagtttttaattggatccttttttgtcctccctaagatgctgaatacttttctcctttcctcccctgagtttctggaatatcacactgagggtgtgctc

SEQ ID NO: 19656 - DNA, 11110 bp, Oryza sativa
  unsure (1)..(11110): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcactactttcaggctcacaaagtcatagtgccatcacagtaccccttgggcgaaatactccgaggcaaggaggtcactggccggcttagcaagtgggcggcagagctatctccgttcgacctgcatttcattgcacgctttgctatcaagtctcaagtgctagctgacttcgtagctgaatggacaccggcacttgccaccgaccgcgagcccaccgaacagttctaggtgatgtgctctgacggctcgtggtcgcacaggagagcaggcattgcggcagccctcttttcgccgaatggtgtgccgattcggtacgcagcaagactgcagttcgacacaaccaacaacgcgacagaatacgaagccgttctcctgggcctaagaaaggcgaaagcactgggagtccagcgcttgctaattcgaaccgattccaagttggtagcgggccatgttgacaaatccttcgaggcaaaagaagaacgaatgaagaggtatctggaggctgttcggtccatggaaaaatgcttcaccggcataacggtcgaacacttacctagaggtcagaacgaggaagcagatgccttggtgaaatccgctgcttgtggtggcccatattcgcctggcgtctttttcgaagtcctacagctcggaagtcatggcaatcgaccagcagaaactgggcgaagacccatatgactagcgaaccccatttgtgaaacaccttgaaactgactggcttctggtagacgaagcagaagcaaagcgtttgcaactcagagccacgaagtataagatggtctcgggtcagctttaccgctccggggtgcttcaacccttgcttcgttgcatatcttttgccgaaggcgaagaaatggcaaaagagatacaccaggggctatgtggtgcgcaccaggctgcaagaacagtggcctccaaagtattcagacaaggagtttattggcccactgtgttgagagtctgcgttgagcaaatcaagaagtgtgaaagttgccagcgtcatggctgaagccagaccgcaccccagtatgatctgcagcccattgcgccaatatggcccttccccagatggggtctagacatcatcgggccgttcccggtggcgcgaaacgggtataaattcgcaattgtatctgtggaatatttctctggatggattgaagccgaaccccttggggcaatcacttcggcagcagtacagaagtttgtatggaaaaacattgtttgccgtttcggagtgccaaaagagttcattcctgacaacggcaagcagtttgactccgataagttcagagaaatgtgcgaagggcttaacctggaaatcaggttcgcgtcggtcgcgcacccgcaatcaaatggggcggccgaacgtacaaatggcaagatcctagaagcactaaagaaaagacttgagggggcagcgaaaggcaaatggccagaagaattgctatcggttctctgggccctctggacgacccccacaagaccaagtttagcccgtttatgcttctttatggcgatgaggcaatgaccccagcagagctaggggctaactcaccaagggtgatgttctctgggggcgaagaggggcgcgaagtatcgctcgaactcttggaaggggtaagattcgaagcgctcgagcacatgcacaagtacgccacaagcacttcggtaacttacaacaaaaaagttcgacccacagtgctgatgcctggtcatctcatcctaaggaagaaggcgaacccagtagcggttggcaagcttgaatcaaagtgggaaggaccataccttatcaaacacaagtccaggacgggatcttttcgcctagcgacactagaaggcgaggagttcgaccattcctggaacgccgcctctctcaagcgcttctatgtctagaatgggtggcacccaaatcgccaaacttgtaaaaatgtacataccgtcatgtaagcccttcggcactatgtaagcctttcgacaaaaaaaataaaaaaaataactggatgtagggctattatccaccatggaggcccgaaccagtataaaatctctgtgtcctccgccttctttctaattttcgtgtgattgacaatttgtggaaaaaccccaaggcaaacgcctgatcagcgaaaaaggcaggagggcgaaacgaatcggccgaagcatcgctcgccgaacgttgaaaccgcaacagcttgtctcggaaaataactagccgaacgacgttacgttcgatcgacataaaagcaaaagcgtttctttcagcacagaatgctacagatcgaaaacaaacgacaaaaagctgaaaagtcagtacacctatttcgctaatatacgcaaaggggccgacatgttccgacctaacaaaagcacgaaatgtgacgatgcgaaagaatagcgaaaaggaaataaaacacatctttattaacttcgaaaaaataatcgaagaatagaaggttcacaacatgatacaattcaccttacaagtaaattacatcttcgcccccataatcactatccctccctaaggaatggtcaggcgaactaggttcgtcttcactactaatatcatacacaaccttaagaggagtagggggcgaaacacagactaaactgtaacgacgctgaaagatcgtttcctgacgtttagtcttctgatggtttcgccaaaagcgagccatatcctccaaacgtcttgaatgaacaagatcgtaatcttctaaggttcgcccggggtgcgcccgcagccagtcggcaaccttgaaaaccttgtagctgcgaccgtttatctccatttcgcgataaacaggccgaaatggacatcgcaccttcggcagacccttcaatgccacaaatttctcgttttgacttcgccagctccctgaagggggccgaatgcacgactttcggtgaaccccctagtagacagtgcagaaaaggcaaaacacagtttacatagtaagaataggcgaaggaaagggaaggtgtggcataatgcgaaatggacaagataataatacgccaaagacttcgaccatccaaaagtggctaagattgtcatacattccaaagtataccaaaggccttcttcggctacaataaggagggttaccgacggcctgccaaatatacatcatttgcctctccaggcaaatgcaaaaaagaggaaggaaaactacaaaaatctaaggaaagggcggagggcctcacacctctgggtgatcctgggcattgcctccaccctcttcgcacgctgcgtcctctccttcgccccggtctgccgcctccgccttcgccagttgctccagaaggcgcgccttggcagcggaccggccgtccttctgccaaaattgtattcgccacgcacgaagagcgggtgaaatgttctgtgcactaatctcccagtcccccttcgcataggtagggaactcggcgacatgctcgcagccgaactgttgcaaaaggcataaggtgaaggccgccgatacacgcgcacaacaatcaccgtacgcggtggcgcagttcgaaaccgatccgccagcctactgggtccactcggagaagtcgaaggctgaggcatccttggaaggaaccccccgcaccttcgtgcccatgtcggtaagggcaaggcggagcgtttggcaagccgttctcgcagattcggcggtcttcgccatctcccgcaaaaaccgctgcgactcctccacggcgctcgcttcggccctgctagccttcaggcgaagagcctccatcttcggctcagtaaggttatagtaatcaaccagcactgccgaatgggctttctccttctccagttcggccttgaggcgatcaacctcggccctagcctctttccccttatccagttcggactgaaggcgttcgacttcagctttcgcctccttgagggtttggccagggcctccacctccaagttcttgcggcttatttcgtcgtccttggcccgaagacggctcttaaaaccatcaaaacgggcccgcacggttcgctccgtcgaacagtgagccgcaagaatctagaggaaagataggagcgggcgaaaagaacaaaaggttaattgtgagacgtaaaaaaaagggggatgaagaggaaagcgaagaaggaagaaaaagcgtacccgaactgccaagcttttaatggcagaacacccctcatcgaactcatttagttcggtgaacaggctcggggtgccagcgggcaagacaaggttgctcactccctccacaaagggaacaaggtccgcccgagtctcgaaatcaccaggggcgaagtggggcgccgcaagggaatattccgaggcagatgcttcggcgcccgcacacttccctttcgccttgactaatggcgaaatagctagctcacgcagagggctcccgaaaaccctcgccacagccgacacgatccgttcagcggaggctgaagccccggccgcgatgctaccgcctgccccagcaacaccgagcggaacaaggggagcagttgaaaggtccaaactgcggccagcgggcgaagtcggagtcccgtcagaagactcgtcgtcgctgaaaatgcgggcgatgtcgacgagttctttctttttagagatcttcttcaccggacctccttcgcctccttgcccgaggagaacgcaactagagccttcgctccttccaaatccgtccgtcgaagaggggagctgttcgactccaccccggtctcgttgtgacctggacttggggtaggagtgtagccgggggtgtcgatgcggtcttcgaccgcctcgttcgcggccttatcggccacaacctcctcctcttcctcctctccttcctcctcgccgtcgcgttcttcggcatcgtcctcgtcgtcggcatcggagtccgacgaagcaggagcccttcgtttcctaggggcaagcttcacttgtccgcgcattcgcttccgtgaaggccctgcatcatcaccggaattgtgggggtttgcccgaggaggcaattcgccgttataaacccagttcgcccgcccagccgcttgtcgtgttagcagctagctatactcgacgaccgacacgtcgccgatcatcctgcgggcttcggtttcagcctggtcaagggtcaacactgcaaaagtagagtgtgaagctatgtcaaaagtcagataaggtgaaataacaaagcacagcagtatatagcaaaagaacagtcttactgttcgccccctcaggaagtatcaggttcggcaaaccgtcgacctcttcgccttgatcaaccgtgacttgccatgactgggagaggggaaagatgcgaagcatacagaattcctccaccaagtcatggcagctaatgtgggagcaaaccttgcgcagcagaacgaaccgcgcctccatagcaccgtccacggcgatcttgggtttccggttcggcgcgatcgccctacgccagcaccggagggctttcgccgggtcagaaccagcctcgaaggggatggtgtgatagaaccacctagctatccaatggcggtcccacttcgacatggcagcgttcaccggccagagatcggaccgctcgggacgaacgttaaagttcacgctcctgaacactgtcttcttcgttccggccggggtaatcaccgcttcgagttcacggtggcgaaaatatggcgccgaagagctcggcgttaggctcaaacccggaagtccggcacgcccagtcgaagatagagatccgaactagcaccgacgagctcagctgcggaagttccacatggaagaggcgaaggatctccggcaacaacacgttgcacggaaaccgtagccttgcctcaaaaaagacggcgaacaccaccgtccgattgtcgacaggttttggcactacggctttccctggggcgaaagcctgcccctcaaccaacgccccagagttgacctacttcgccagctcgacgtcgtccgcgagagaaacccccaaaaaggcggtgttgtcgtcatcgactcggccgggatccggccctttcgccgaagcagggtttggtttgcgaggggccatggtgatcggtgcgtttgcagcggcgaagtaagagaatgggcgaaacgcttgaggggtcaagagatgctgtggaagaaagaaacggaggaagagagtgcacgcggtaaaatggcaagtgtggcggtgaaaaggaaagagcggtgggaatatatagctcaccgggcgaccgttcgcctacccaccagtaataaagcgccacgtgtcgcaaaggtaggcgaaacggtaaatttccatcgtccgagcggcacagtaaaaaagtgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccatcacacacaaagacaaacgggaaacagcggaagactagggcgaccaccacaggcgcttgacggcaggcacgagctagacaccaaagccttcatcttccaggggctcctcttctgggtttgggaaaaaaattgagcaagactgagtacaaccaccgtactcaacaagacacatccacaagtgcaggataaatgcaagggagtacaagggggttataatataaagggttagggtttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagtagcaggacaccggccctgtgccatgacatctcgactaccgggccgcagctcgtgtagccttcatttgtcctagagatgtccatcgacccctgcttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattccaaattgtccaggtgatgagaatattcccaaagtctagagttgtaaaaccacctaatgttgcctaattaaccagcgaagcatctacctaaaatcatactagtggtaccatgagtagagtgtccactagttggggttttgtttagtctagggggaacaaggaaataataacaataacaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcggcgtctacacgaccaacggaaaagaaaatgcttttactctaataaactccatataacaagctggaacaaagcacaaaaatgggttcttgacttcttaaggaaaaattagagacttgaacggtccaattccgagttcaaatggccaagttatggtcatttgaagtttatatgctctttaaatgaataattgtgaatttcttcatttaaattttaattttaaaagggcttattgcgtcagccgaggggagggggcgcgcggaccgggtccacgggagtggggcccacgcggcagccttacggtccacggtggaccgggtgcacccgggctcacaccgaccggcgccgtgggtcccacgcatcagtcgcacccgcgggcgcgggcagctgacggccgagccccacgcggcagccactcggcgcgcccgagggcggccaagccagcgcagccggcgggaggcggcgcccgcgcccctatggtcgccggcggcggccataggcacggcggagcggcggccgagagaggggaagggaagggggaaaagaagcggcggtccacggctcaccctaggtcgacggcgacgacgaaaaaggcagccggagcggaggaaggcggcggcgcggctcgggtcgacggggtcgacggcgttccggcggtcggcgagcgaaacggaggggtggacgaggtcggcgaggatgcggcgaagccgaaggaggcggcgccgaggtgggaggtggtccggggcgacgacggcggcggtccggagctcgacggcgacggcggatagagagagcgacagcgcgagctcgattccggcgaggaggaatggcggcgagaggcggaaacggacggacgaggtgcggngagggtttaaatacggttgaaaggcggagagagcggtcggcggggaaggaataggcgcgggaggtccggccgccatcaatggcgccggcgatatttgcgggggcaaatccgcccgtttgaacgcgagagagagagagggaaaaatgggggaaaagggagaggggatcacggggagtgatttccccctctttatgccacgcggagacggncgggaggctggcgggattcgcggcggcggcggcgctagggcgcgggcgaggcggcgggagcggcgggaggaaggggatgacgggtgggccccacccgtcagcgagggtggcgggcgggcctgcccgtcagcggtgcgcgcgcggggagaggccggatgggccgcggggagaggagagggagggggagggagatgggccgagccggcccaagagggagagggagggaaaggggactttttagagcttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttagaggatgtattttagagtcgttttggggcgtgacaaaaagcccgcgaaggtaaagcccaatactgttcctttcggcccgggaaaagaaaatatataaaaaatatataatatatatatatatatatatatgtatatatatatatatatatatatatatgaatattccaccaatcgcaggaggtgaagcgcggcaaaataataccagccgcacaaataacaaacttcattcgcaggaataaggttggtttcggcaggagcatcggtcgaaagggggcgccgcataccataccacatggtttgcatggtctcggccgaagctccaatctcacccttgcccgtgaggggcttgttggcggatgacatgaggcccttcgaccaaatctgccgaaacccgtggcgaaaactatggaacaagaacggtgtgaggcgaagagtcgtacgagtgctttgccaggccagaggcgtctcaggcgaagagtgcaaggcgaagactatctgccgaaggaagacgacttcgccatggcaagttcgcctccccccccgagggccgaagaagcctttccggcccatcaagcctaggggctatagggccggtgattgcctgacggcccatcaggggcccatgagcccctataacattatgtacccctgtaaatgtccctttcgtaagggtaatcatgtaaattcccctgtataacctaaaccctagtagtaagaacctgtaatggggctataaatagccccctagggccatgtaacggggggatcccgagtgaaattcaaaatttaatacacttcgtttttccaaccactgttgagtaaccacgtctttcgacgtatgtggttgtcgtttcgacaacagtaccattttatcaaccggcaccacggaagcagcattggtaaggaacctcatctgtaccagattgacaaccggcacgaataaaaacgcgacacatgaaaaaaaatcgggtcgatgaatcggctaccgatcacactactagaaaaagcatttttcccgacgtggggggtctttttttcgcaagcggacatgactctttgagccaaacgaccacctacaaaaatataaatctggttgaagttcgttgtccgcctgcaaaaatctatttttgcatacggactcctgcgaaaatcgtacctacccaaaaaaaatctaagtccttatcttctcttcccaccccctccccaccactccttatcctctcaactctctctctctctccctcaacacttctctccccatgccggtccg

SEQ ID NO: 19657 - DNA, 5382 bp, Oryza sativa
gcgcggctcccctcccctcccctcccagatccggccagagggaggccgggggagggcggcggcggtgaggcgaggcgcggggcgacgacgacgacacgcggggcggcggcggcggcggtgcggctcccctcccctcccagattcggccgaagggaggccggggcagggcggcggcagcggcggcgaggcgaggcgcagggtcggcagggcgccaattttttttgttcgtccagtggattttcgtaggcgggtgattgtgctgcctgcgaaaatcatcaattttcacagtcattggtatacaggtgatccttctcccgtctgggaaaactacttttggccgcctacaaaaatgtttttttatagtagtgttactcccaataccattgccccccaatttctaaaaggaaaaggtatgaataacacacaccccatcccgcagagctatcgaggtcgatcgaattactccctaattaaacttgaaagccagacactttggttggaccgaaatttatgaaatttcatgattttcggtactttcagactgaagtttttgaaattttaacatattttgattggatttgaataaactttgactaaatttaacaaacatttgagaacatctgaaaattttggtcaatatattgatttgacagtggggtccgaaattaccgaaattgcaatcattggggtgaggtgaccccacctacaggaatcggaaccagggattagagaaagagagaatagaatcaacaaacacgtacgggtcacatccacttatctatctccattatattaagccttctgcatcttcttctgctgctgcggtggtgtggttgttgttgcgagctagacgctatagccgtcgacgctgcattgcttgtatgtcactgtcagtgactgcctcctcagactgaaactaattaaatatagactactataaaactaattatataaatgaaagttaattcgcgagacaaattttttaagcctaattaatttataattagagaatgtttactatagcatcacatagactaatcatggattaattagactcaatagattcgtctcgtgaattagtccaagattatgaatgggttttattaatagtctacgtttaatatttataattagtgtccaaacatccgatgtgatagggatctggtctaatggcgattgcccaatccaccgcacctggacggttcgttcacacgcagcttacacgatcagggccctgtgtggaagattagcccagggctaatgttgagagctaatatttagtcatgaattggtaggctaaacattagcctagggtggtatgtttggatccatgggctaattcaaggctaaaagttggagagagagtagaaaaagaggagagagaaggagaaagagaactgctttttgatggtccccacacaaaattagccccatttgcaccccttggaggagctaatgttttgaggagggttaattcacattagctcaaaattagccctactgtttagattcttgagggaatgagggctaatttgaggctaaaaggtaagggctaaacattagcccatggaatcaaacagggcccaggtctaatcggctgcttgaggtggaggtgagaggaagttggtttggggaggcggaccagtttgcctagctagacttttggggaggagacgccgagcacgaggatctatgcaccgacgtcgccagtgatgcgacccgagcagcacgagggcatcggcctcggagcacgttgaagcggccgacgatgatgcgggtccggtttcggcgccaccgcatctagatcaggtctctctgcggcggaagcagttagcatggcgggggtgatggccatccgggcgagctccacctctgctgccggccacccgggcgagctccgcctcagccaccggtcgcctgagcgcacgcgagagatagagcaagggctggggagggattgggttgagggggatggttgactggtggcctccgggaggatggtaccacgtatgcaagctcagatcaaaacggctcaaaacagtgtttagaggggttatttatccagtatgaagagttaaagagtggaaaatgtatggtatttgagtttagggggtaattcggtcgaccgcgatagttcaggagataattcatactttttccttcctaaaataaacatgattcccgaatcacaaaatcccaaaaaaaacattcacaaattacaaaatcacaagaactattggagcatggaagcgggagagaaccaccgccaacgccacgtcggggaggggaagtaaccgccgcttgggccggtgtcgtggaggataagggtggcgagcgtgcaggcgacctcgcccttttcagagtaggggttggaggcggagacttgcgcccagtgataggaggaagggatgggggattgtaactctggactataggaccgtacatataatatctggactaccatttatccagatttattgtcttaaaagaggtcatatcccctcctaggattagttttttttggatggagggagtagctaatactaaatgacaaacccacctgggaaactgttttaaacactcgggtggatctagacgtcgatccacccgagtcttgcatatcatctaaataattatgaaaaattttcaaaaaaattaacatgataggttaatatgtaatatatcatttcacaaacatgcaagttcaaattctacttctacaagttataaaaaaataacaaatttaactgtgaatatatgtatactagttagagcttaatttgctatttttttacaacttataaaagtcaaatttaaacttgcatgtttatgaagtgatatattacatattaaatctattggcaaaatttgctataggacactcaaaaaatatgtaattagtcatgatacaccacaaaaatatgaattggctataggacaccacaaaagagtggtaattagtcggaggtggcagctcggcacgggcagctacggtggaccaagaaaaggggcagtgtggccaggcgacacgtccacccgagatataaaaatctatcttcaaacctacctagctaattctttagtttgtctacttgcatggttgttgtaaagtcattgtcaatagaaagtaaaataaggtcaaaacccagctatctgccagttaaccttatactatatgcaatcggggaatgatgttgcgcattagttaacttgtctccaattgttttccaaaatcatgcgagttagccgcccttaactaacgatcacgacgttgacttcaatccacatatatatatatatatatatgtatgtatatatatatatatatgtatgtatatatatatatatatatatatgtatgtatatatatatatatatatatatgtatatatatatatatatatgtatatatatgtatgtatatattgtatatatatatatatgtatgtatatatgtatatatgtatgtatatatatatatatatgtatgtatatatgtatatatgtatgtatatatatatatatatatacatgcagtgacacttcatcgaggtatcgtactatcgtagtagtaagtacatattcttctgtttcatgaaacagagggagtacagtgtatcgttattacatcttctccttccaaaggcaaattaaatcatggcgccatcgctgctcgcgccacggctagccgtgcccttgctcctcgtactcgcggcagcggcggcggcagatggcgtcgccgacgccggcgccggcgccggcatgacgcacctccacttcttcttccacgaggtgttcacggccggcccgaacggcacgacggcgacggttgctccgccggcgcgcagcggcgacgggagctccttggggttcgtcggcgtggtggacgacatgctccgggagggcgcggacccggcgtcgcgcctcgtggggcgcgcgcagggggtcaccgccggcacgtcgctcgccgccgccgacggcgcgggcgcgatcacgacgatgctgagcctggcgttcacggaggagggcccgtacgccgggagcacgctgcaggtgttcggccgcgcggtgctgggcacggtgatggagcggccggtggtgggcggcacgggcaagttccggatggcgcggggtcacacgctcagccggcgcgtgaactcgtcggaccccgacaacctcctcgtcatcgagtacgacgcctacgtcaccacgtctcccatttagctagctagctatagcctagctaccatggatgggtagctttgatttgtgatcgatcttgtaatgtggtttttttcttgatcatattctaaataaacaaaatcgtgtgttttgtgatatctgcataaacaaattcaatgttgtatgcgtctatcttgtgaatggctactctacgatcgccggtaagcttgttagcttgcagggcatgccaagctaagatagataatttgaacaatagattaatcatctaatgactaaaacaattgatgcaacataaactaagtgaaaatgaactatataaatatatacgatattataaaagatgatggagagatatattgaaatattatatgaattaattatgtgtgatgatttaacatgcttacattttaaatctttaaactttaataaattattaaattatagataatatagtatatttgcatgatgattaaatgtaaaaattattagtgaatgatgatgtggcatctctgtatgttactaatatttaataattggtgggctatactttacactttacagtaagagagtaagagaggatatgtggggaacacaaaccaaataagagccaaactagttcccaagacgtaataccgtatttaaagtttagcaccacacaattattttttatcaacatttaaaatgagttgctaagcacccctcaaatagctaagccaacaagcacaccggccaaatagttaagatagggatcatttgccatttgccacatgagcaataatgtgggttgcacatgtacgttcagcttcatctagagattttttttttcttcagattgtagccattgcgattgacctttgctgctatccatggcattagagatctcctgtgtaatgagtaaggttgctaagcaaacaatactaaatggttatttaaattatgacaaaattgtgttaaggataattcatcacctgtaaaaccgttcacattgctagagttttctgacactgtagatgaagaaggcgaggcacttcctccgtttttcgatatctgatcatccatagaaagttcaaggggatgttctatgctaataaaccgtccgccttttcctctatgcctcaattttgcttgcttttggcgagcctcaacaaggatcctctaaataaataaatgttatataac

SEQ ID NO: 19658 - DNA, 2102 bp, Oryza sativa
  unsure (1)..(2102): unsure at all n locations
gccgcccgtcgcctcgccggtggccggtgggtttcacgcacaaggacgtcctcacggaggcggcgcgcggaccgtgtcgcgtggcgcgtaagctagaagaattttgtcccaagggtagcaatggcggtgctagcccgaaggctacagtaaagcccagggacacgtgtgagtatctcgaggtcgcccatggcggaggtagcccattggctacagtgaagcccagggggatctcgggagcccatccaaggaactcgaggacaccccaatttcctgaagcgaatctctcgctggaagatatttttcctcgtgtttccccttctggatcgcagaattggatctgggtgaggcgtggagcgacacagccaaacctagggtttccagcgcaagcggaagaaatccgatgatttggtggcttagctcgtcggatctggagagttccggagcggaagtgtgatcaccgatcatttgcccaagtcgtcatggagcggcgtccgccgattcggccggactggcaagctaacaagcgtcaggcgatggagcaaggcggaggtgactgggggatccgcgacgtccgggaggaggagggcctccggcgtccactccccaatcaaccaagggtgaatccaaatgtcaagcctcaaggtcgtcaagctgcggagatggagcgtggggctggtacgatgaagatcaagtgcttcaaatgtggccgtgaaggtcaccaccaggcaaactatactaatccccccctctgttactcttgccacaatactggacacattgcttctcattgcccgctgatttctgctaaaagatgtgttaagctctgtggatttgggatcccagggcaagggttctatagtttgcaagtagagatttctgacgcagaggtggctagagctcctgtgagaggtattttgacagtgattcagggggaagcttctgtgagtaaagtgctagctgaactgaaacacttgtttgtaggtttaacttgggattggaaaattaagcagctaaatgctaaagaatttctcaaaaaattcccttcatatgaagttaggagtcagatttcaacttgcaagagctttgactttgagacatcccagattaaagctagtgtggtggagactggtataactgaagaggctgttgatgaattagtggctgtctgggtgaaaatctatgggattccaaaaatggccagatcagaagactatatcaaatctattgtggagctggttggggagtttgaggctgtagaggttgcaagtatcaggagagatggtccagtaagggtgagagttgcctgtaaggatcctagagagctatatttctctattcatctgtacataaacaaggtgggttacatgattcgttgggaacctaaggggtacttaccttatgagaatagacagaatcctccagatgatgatgacaaagatgataaggatgatgaggggctagaggatgatatgaatctagatgacgaattcaagaatcatgacatctctagaggaagacctcttaaaggcgagggaagccaacatgagagtagagcagagctttttctgctccaccacttacaagggcaaagtcagttctgaacagggaggaagtataaaaatgatagcctctaagaaaacctctcttttgaaacaccctgacttatttgagagttgtacttctttagtgatatggggagacaaaacccaagagatgattgcagagcaggaatcncaagagttggaggcacctgaattgtcccaaaatgagactagacccgagttctcaacactgttagagtttgatgaggatcttgagagatgccaaatccctactgattctgacattgagaggctgagagaagaagaagatagggaggaggaggacagtttccaggaggtctctaacaggaagaaggggaaggctaaaaggactgaacctgcagttcttcaagaatgagcttaagacatagagagttagnctgttgttccttattccaaagagagctaagctcctgacccaaaggaaaaatttggagcaaccaggtaataattctaatccctttgcggtttttcaattattagactctgttgaattgaaaa

SEQ ID NO: 19659 - DNA, 1819 bp, Oryza sativa
  unsure (1)..(1819): unsure at all n locations
aagatctacaacttttatgttggtcatttgtaataaaacaaaattacccatattaatgactacacatatcaagtctttgcaataaacaattaaaccaaaatactccattcattacaatagataagtacaaatgcatcagtcacaaggttatgccttccgtatgatctgaacgagcatatgccacaggctcttggggatcatcgtcacagtcaatgtgaggtcttacatgaagattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaatggttcatcggcgtatcccacctttgatagatctactaaagtgaaaccttccttgtcggctttgacacagtgcgtagattcacccaacggcagcggaacaaaggaaccgtgaacttgacgtagtttagctcccagatctcctcaatgcggccgtagtatgtgtttgacccaacttgatcctggaatgcatctatacggacgccgctgttntgcactgtgcttttgtcatcntgtttgacggtgtaaaatgtgtatccatttatatcatatccttgccatgtgtctacggtctaagacggtcccatccccaacaactgtactgtgtcatttgggacatccgtggacattgtcactcgattcttgaaccatgcggtgaaccgagaattatgttcttgttaatcaatgcatcagatcgccccaagttctcatctcggattttcgctaagtgctcctcaaagtatgggccaacttctgttatatgttggagcccaacgtaatgagcctgggcgtacgacgtttgatctggcctaattcttttccttccgaatgtgccaacacctgacaaccttcccttgtgacgagacgcaagaactccgataggatcggccatcggacatgtaattgacacagaactcatagcctcgtcggtcgtgtaaccttcaatgatgctcccctcgggtttagctctgttacgaacgtacgacttcagaactcccatgtacctttcaaacggacacatttcccttagaaaagccgggccacatagttttgtttgcttcaccatatgaacagggagatgaaccattatatcaaagaaagacagtgggaaaaacatctccaggtgacagagggtattcacaatatcggtctgcaacccatctagatcttctggatctataaccttctgtccaattgcattgaagaaggagcacagacgttggatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatcctttgacaatgtgtggcaggctggaggaaggtacactctacctgtctctgcatctcgtatgggctggagttcactgcaaatattcatgtcctgtagatcaaggcgcacgttcaacccgtcctttgtcttcccgggaatattcaacatcaggccaaccaaactctcacacacattcttttctacatgcatgagatcaatgcaatgacgaacatcaagatctttccaataaggtagccgccaaaatatggattttttcttccacatacccttctcctttgtcttgctacgtttacttttcttcccaaactcat

SEQ ID NO: 19660 - DNA, 701 bp, Oryza sativa
aaaagacccttcaaacaagaagatgcacatcgtgagggatggaaagcgccgaattgtaggagttgacaacgtcgtcgatgaagaagaatacaaccataatcttcatgtaagacctcacattgactgtgacgatgatccccaagagcctgtggcatatgctcgttcagatcatacggaaggcataaccttgtgactgatgcatttgtacttatctattgtaatgaatggagtattttgttttattgttttattgcaaagacttgatatgtgtagtcattaatatggctaattttgttttattacaaatgaccaaaagaaaagttgtagatcttgatgagaggatcaactttgttgttgaccatattaccatttgaaatcatttagtatttacaattgctgtttatatttgtcatatattcaaattcaatttcaagctgttgggaaaaaagttatatagaaaaatgaccaaaataaaatttgtagatcttgaaaggctctacaactttgttgctgaccatatttccatttgaaatcatttagtatccgaatatgtattatagctaataaaatgaattattacatagcagctatatattttgcactcacaaatacaaaaacttcaaatgaaagatggaaaattagtcatcggtgacgggccttagtttacggccgatagagattaatctatctcaatcgggcgt

SEQ ID NO: 19661 - DNA, 10612 bp, Oryza sativa
actttatcggatgaagaagtgaccaaaataaaagttgtagatcttgatatgttgtacaactttgctatttatggctttcccatttgaaatcagttagtatttacaaatgctgtttacatttgtcatattgtcaaaatcaatttcaagctgttggaaacaaagttatatagacaaatgaccaaaagaaaagttgtagatcttgatgagaggatcaactttgttgttgaccatattaccatttgaaataatttagtatttacaaatgttgtttagatttgaaattttatcaaaaacaattttaagctgttggaaacaaagttatgtacacaaatgaccaagataaaagttgtagatcttggtaatctctacaattttgttgttcaccatatttcgatttgaaatcatttagtatctgaaaatatattatgactaataaaatgaattattatacagcagctatatattttgtacgcataaatataaagacttgtttggaaaaatggaaaaataatcatcggtgacgggccttagttaaagcccgatagagattaatctatctctatcgggcattatcttagggcccgtcacagatgagtcatccgtgacgggcctaaatgtcatctcaatcaggcattagtatggagcccgtcaccgatgagtcatctgtgacgggccctacggcaaagcccgatagagatgactcatcactctactataactagggtttctcagatcggatcgaaaattttttctaagtcccgctacagtttcccgcctccttagaaccctagcgccgccgccaactcctacttcgccgccgtcgtcctccctcgccgccaccgccactgagaccgccaccgccgccaccgagcccgccgccgccgccaccgagcctctacaccaactggcgtcggccttcctcatcgtcctcaccgacgcccgacgccgcccgcctgacgctgacctccaccgagcccggcgccgccgccgcgaactcctccttcgccgagcccgccgccgccgccaccgagcccgccgccgcctccaccgaccggcgacgccctccaccgagcccggtgctgccgccgcgaactcctccttcgccgagcccggcgccgccgccaccgagcccggcgccgccaccaccgagcccccccggccgacctcaggtgagtcctccatcgcgccaccctctgctacctgcatgtggtgactgatgaaatgtggatgttgggatgaatttagtgatagatgattttagttgattgatgacatgacgatgaatagatgaaatgtggtgcattaatgaatttagtgatagatgattttagtgatagatgttttttgggattgatgatatgtggtgaacgaatgattttttttgattgatgacatgttgatgaatagatggaatgtggtgcattaatgaatttagtgatagatgcatgatatgtggatgaatagatggtatgaggtgaatttatgattttaggatttgatgatatgtttaatttatttatatgtgacattcaattcattctattactgtgagatgtgcaatttagtttatttatatgcttcatttatttataagtgacattcaattcattgtaatagattgtatcactgaattgtgtatttttgttattttgaaaaaaagtagacgatgtctcagcaaggcgaaccaatgtcgacgacaactagtgggtcctcaagggcacgtactcctaggactgggaacaaaatccctaaggaacggttccgcataacagcggtggatgccgtagggttgccggcatctccaaagaaaatattgagccgatttaggtctatctgcggagtcatagggaggcagaaattcaatattctgcaagatgacatcaagctcgtgccggccgcagagaaggacattgcttggctaacgttcaaggagagcttcgattatcctgcggagcatgaggaccgtctcaggtgggctgcattcaaggttatgggcaatgcttggaagaacttcaagactaagctagttggcgagttcgtctacaacccggcgaatctagatccaagagagaaatttccttggatcacagaacaggtctgggaggaattccatacgaagaagtcgacccccgagtccagatctagtagcgaggcatatcgtttgctccagaccaagaaccagcatccacatcggcttggcactgccggatatgccggtaaggaagaggaatggcagcgtgaggatgaagaagcggaggaatcaaacacgccgctcgtgtttggcgatatcccacaccctcgggctaggaactgggccagagccaggtaccagaagaaggatgatggcacaatcttcatgccaaatccagaagatcaacgagtgtacgaagctatagtaagtgtctagtcaaactagatgttcgcattgtttccgatcatgcagtttatttaaccccactaaattgtaatgcagaaggagttggttgctgagcaacaagcctcgcaagaggcctgctctcaaagatatgaggatgacctcctcacgaaagtgttgggcaacaaggaacaccgtggacggacacggggcgttgggtcttctattccctggaagtatggatttccagactacgcgtggcagtacaagaagtggacttccaacaaggcggagaaagatgcacgccttgaagccaagatccgggcgttgataagagctgagctgacatctgaattcgacgaaaagctcgagtcgatgagggccaagattaggcaagagatccgagaagagcaacagaacccccaggctgccgccgctggtgcgcacgaagagttaggaagtcccacccaaaaacgtagcagttgcacatcaactgaggtggcggaaaatccaacatcggtcgacagcgccatcgaccacataacggtaaaagtttcatccacaatgcatgaaagacttaacgaatccatatgatatataatattctaaaaaaattgattaatctatcgcaggaaccaacgagctgcaccctcacagttagggtgatgccgaccttcacggttccagcagccgagggacttgcgtacaagccgaccccagagacaagagtgcatggagcgcaactcaggagcgactgtgcaaaagttcaagtcgactcggtgaagctggaatatgagctattcccactaaagtatccaccgaatgacgaggtcctctcactaggaaatgcccgtggtaccttcatccaatggcccaaggacctcattgagatcaggattacagtgaggccaaccactgcaccaggcggtcgtccaccaaagagacccgcctctgctccttcagtccctcctgctcctgctcaagatcgtcatgcataatcttacgatatgcagttgcagtacgacacggatttttgggaggaccgaacggaggccgacagcaaggcgattcatgaacccccaccgatgaagaagagcaggaaggcacactcttcccctcagagaattactctcgataaacccgaagcaaaggggagaggaaggggaggaaaggtgcagtcctcgcttctagctccaaggaagctagatctgggcaagggccaggaagaggctaagggcaaagaggtcaagaagaaatacgtcgctccacaggagttccaactaggcatgccattggttggagatgacgtgcttgccgcaatgggcaccgcttgcaaggaccttcacgcatactacatggagaaatctaacgccaggaagccgaataaagctaccaatatccttggagagcacgatggaaagccattccttggtccaacaaattatatcgttgtcgacttcaaggatctattcgacctctacaggctccgagcggtggacacaagcctccttaagtgctactccttgtaagtattgtcgcacaacttaatctggtaataacaatcggattaactcgctaacaagatcgtttatcctgtgtgtaggttaagttggcaatggtgtcagaagaatgcaccggaagttgccttccttgatccataagtggtcactgtcacaaatctccagaatgaccgtcaaggaatggtcaactacatctacgacaccttgtggtcccaccgagataaggagtacattatgtgcgcctataatcaatagtaagtgtgttatctaaatatacacaacagcatgaaacattccttcagtacttaattaactttcactatattaatgccgcagtacccattggatccttctggtcataacacctaagtggagtacatgtcactacctgaactctagaattgataagaacgcatatgattggaccccaattcaactagcgatagatgaagcgtgggtccaatacgtgcaaagaggaggcctcaggaagacaggacatgacacccttatccacaaaaaagacttcccggtgaaacaacaaataggtgaccagtgcggattccatgtgtgccacaatatgcgccttctgtacagagaaaaggtgaagactttggcagagtttgaggtcggtggtctcaattgtgatagactaactacattttagtacttatatatgatcgatcaattaatctggaattatgacaatgtagggcacaataaccaagtctctgcctaccagctttgaggaggttcgcgaggagatagccagcttcatcctccgcgaaataattaaccccaaaggaatgtttaggcttaaactaaaatgatgaacaatgttgaacttttatgtttaggcaatgattaacacttattatgcaactgtgatgatgtaactgtgatgcttatatttatgtatatatttcatatgtttatgttaagacttgctaaataaatatttgatccaattaactcagttttgcaggtgaaatatgataaatatttgaatggatgtgaaatatgtgaatggatgtgaaatatgagatggctgtgaatgtgtggttgtgtgaaatatattgatgtatgtgtatgtgaatgcatatgtatatgaatgggtgatgctggggggctggggatattggatatctgtgtttgtttctgtcatttctgcagcgggcatagctagcaaaggcctgaggctagccaaaaaacaaattttatttttttgtggattatagtcatctgtgacgggccatagctaaatgcccgattgagatgatagtcatctgtgatgggctctagtttaggcccgattgaggtcagtagtcatctgtgacgggctctagtttaggcccgattgaggtcagcagtcatctgtgacgggctctagtttaggcccgattgagatgagtatcatctgtgacgggctctagtttaggcccgataaaggttagtagtcatctgtgacgggcgctaattgtggcccgattgagattggtcatctgtaatgggctatagtttgactgatcgtctaggtcaaagctatcggtgacgggctttacttagggcccgattgagatagattcatccgtgacgaccgtttgcccgattgagataactcttcacattagtgacttctagcctgtgacggacgctgtgcccgattgagatgagggtatccgttctagtgataggcccagcttttataaaatggcacaaccgtaaattcttgtttggggttggaccaccttacaagtttgggcatagccacaaatttctaccaagaaaggactaacagttcagcaaaccctctagacaactctaaacatcacaggtttaggcgaactattcggcggggcggcggtcacagggcttcccgcacgcggtggcccctccctggcgacgcaagcggcggtcgcagagcttcccgcgtgcggtggccgtacctattcgaggcaagcggcggccaagtgcggcgaagggaggcgatggacgcgttgccgggggcgcagcatggcaggcggcggccgcagtccttgcatggccaaggcaggcggcgaccgcgtcgagggctagcgggagagagcacggtgctgcgggcacgctcctacggctgcatccgggtgttcctcatcctgtccctgctgctgctcgccgtcaaggtagccgcctacctccaggggtggcacctcgaggaggtggtgtcgctcttcgccatcgacggcctcttcgccgcctcctacgcctggtggatgcggctccgcctcgactacctcgcgtcgccgctgcagttcctcaccaacgcctgcgtcgtcctcttcatggtccagagcatcgaccatgaaggctagtatttctgaattttggtcaaattttgtaattgcctagtatttgtgatttttttaaagtacaaaaacatcacaagagatgctcatatttggtcgaaatgctcatcacacaagctgaaatcacaaaatagaggtaaaatcacacaaagctgaaaaaatggggcacaaatgcaataaccaccaagggtataaatgtcattttttctacaactaacaccgttaataccagctgttagaagtgggggtacactactgattcagatttaaaaagtaggagtaaaactgtaaaccctaaaaagtggaggtaaaacagcaattcgaaagtaggggcatagatgcaattgtccctatatatattgtgaaagaaagtaggagagtagtatataaataaacaatgtaatgaggtgctggggatggcagattcactcgcatcaacatgtccatttcaaaggaatatatttgtgtgaaaaatttgaaagcatttctcgaaagatcaaatgaaaccatttcttaatccaatgatcaaaccatttatgtgcagtttaattttcttcgtccattggacgtttgaagctttatatttgttagctagtgacggagtaacaaaaaattggtgactatatacatacatccttgtttgtttggacattatattgcacttgcaatcttcagaatgctgcatgttgctttctgcatcaacgtatctcacagcaagcgtaaacagttgatgaagcgccactcgaataagcatgagggggcccatctgacagtgagtgcttgccagaagctttctactcctaaccacatctagtagaatattatcttctcctttttacgccttatcctttgagagaattcctttggatggtcggtataagagatagcaagaaggcaagctaaaacaaaccagctaagcataaggtgaagggtagataaaatacaacggtgaagttaaaagagaaacagagatgaacaagcgaaggttctctacacactcccttatcttggtgactgtgctagcagttctaattgttcttgctatgccaacagctttgctggggctcagtataggtacagttgagatccttatccccacatatatattttttttcctcttcaatttcaggttagaaacaaaattttctttggccggccgtaacgtcccatgatacggcaaagacgggagatgtaaaccatttccactatcttgaaaaaaaaaagagcaaatttttcttcgagagtcgcctcatctggccttctaaaaataaacttgagttaactgacaattgttaatttaaagcatcttatatgatcgagcagataatgagcatctcatctgtagattattttgtgctcacatgaatttttccaccagggaggcgtgctttgggtgatccacatggagttcaatccacagctgccatgcaacaagatgctcaggccgtaggtcctgcgtgcaacacaaacgatccgaatgttccatctccatgcccacctccactatcacctctctcgccatgaaacctgggcaaaaacaaagctatgctcaaggccttcgcttcctttgctccagcaggggattttgagccatatatggttacactattaggtgataaagctatacgtttgtaccacgagaactatgacaagtaaacgtatagattaaccaacatctgaattgtgacgagaattcgtacgttctttcagagaatgttgtaccttgtgttatatggtgcatgtacctctatatagttgtgtttgaataaaacgaagacatgaatttggcgagccgacaggagtcatcttgttatttgttttctgtactacgaagtatgcaggctgtaccatataatttgggagaagttttaccatgtttgcgaggtacatagaggtattgagaagtttagctatgtagacaattgatcgagagaggggtaaggtatgggaatgaattattgtaaccgatagcagtggagtaaatagctaataaaaaatatgcatcgattggaattggatcagattacaccactcacaaagccaaatcgctctactccatcgtatcaccggcgtcaacaccatgcacgttcgatcaccgatataagctgcatattcgatttgtgggttttgcttgtatgccggcaccgaggaggatggcaagattggcaaggacgagcttgcagaacacgggaagctgccacgcgaggtcggacagcatgccaaacaatctaaatcttctcaaccattgtatacatgcaaataccagccgataaatagacctcaatcaggaggttgtttccaaatttatgtgcagaaagatggcaagatggttttattaaggattaaagccaggtcttgctgtccaacactaaaatattcatatttcagtttattaattgtggtttcgtccagaagtgattttatcaagatttcacgttttttggataaaatttaaatcttcaaacaatcatacaaacattcagtggtattttaatcgatttgtgtttcttatgagcaaaatgtaaatataagagaaaccatgcaaataacgtaaacagaattagagatagagataaactacctacacggtacatatctaacctacaactaacactaaagacaattctatatttttacatctcctagcaatatatttacccttctaccaacctaactacctatacctttgagatggtaccttttattatgaaccgttggatttttattatttttgaaatgcaaacaccgtacaatcccgaagtaggaatcaatcgagtctgcattctagtaacgttaaagcacaaaatttgacacttttatttcgaaatcgatgtaccacagtttgatttggcataaataatcaagaattttaaaaaccacaggactacgcgctgtgaaagtactttatctgtctaaaaaatgtccaatcctgatgattaatctagacaagcaaattcagattcatcgttagaatttgacttctttttagacaagcagtaaattttagtgatgccatcaagtgataagtcagtcagtggtcaaagtgtaaccttataaggtctacatggcactgagtgcttagagcaggtacaataacaggctattagccagctgtaaatatattttagtaagataaacgatgagagataaaagcagcgggctacagatctgtagccagctacagcgcggactccaagactcaatatgtgtatggcaggtgggaccatatattaatagtatagtaagcaactattgtatgaattggctattagattggctatagatgaattggagctagtagtgggctgtactattaaatttgctctcttataaggtctacatggtggtgagtgcttaccggaagttcctatacctgagaccctgaccaaatatagtagaagtttttccttttttatcttttgacactatgggggtgtttagattcaggggcgtaaagttttagcgtgttacatcggatattatatcgggcactaataaaaaactaattacagaatctgtcagtaaaccgcgagatgaatttattaagcctaattaatcaatcattagaaaatgattagtgtagcgccacattgtcaaatcatgaagcaattaggcttaaaagattcgtttcacaaattagtcgcaatctgtgcaattaattttttagcctatatttaatacttcatgcagatattcaaacgttcgatgtgacagagtataaaattttggggttggatctaaaccgggcctatatctatccagaaagcttcttgaagggttaatataagagagagcaagataaggctatccaagatacaaaggtgaaattaaggactggtttatttcccaaaattttttcccaaaaatattacatcgaatctttaacacatgtatgaagtattaaatatagattaaaaaaactaattgcacagttagaacggaaatcgcgagacgaatcttttgagcttaattagtccatgattagctataagtgctacagtaacccacatatgctaatgacggattaattaggctcaaaagattcgtctcgtggtttccaggtgagttttgaaattagttttttcattcgtgtccgaaaacctctttcaacatccggtcaaacatctgatatgatacctaaaaattttcttttcgcgaactaaacatgccctaagaaaaatagggatgaacaaagccaagagctagcctctgctcactctctcctcttggtgactgtgctagtggttctaattgctgttgccatgccaactacttcgctgggacatggtgcaggtaagtttgtcatggcactccccttttttatctcctttagtttcaagtgagaaaatgaatttccctcatacaaattgcttgtt

SEQ ID NO: 19662 - DNA, 11012 bp, Oryza sativa
gggcacacaaacgagcaattggatgcaaaagttatttaatcctgcacagatatgcaatgatactatttatttctacatgaataaactaatagaacatcttagatgataatcaatttgagaaaatcttaaaaaccttatgagatgattgggatggagagagtaattggcttaggggtgacaattttcatgttggagcaggggacgggtaagaatttttatctgcatctgagtggggactgggggcctcgcaaatatgcagggacggggatgggggaggggtttgacccgctggtcacccgcagggccccgggatagcctatttcaaggcccagccgacccattaagggaaggagtatataactatgccctaatttcctccacaccattcaatcgccaacttcccaccccagccaacgagccgttggagcgctgctccaggagggaatgggggattcgggtctagccagggcatgcgcacctcgcccagagctcggctgccccggcagccccgtcgccgcccctagccatcgttaattcgtcacctccccacagctgttgcaggccctctccacctctagcacgtctttcatcgtctcctttcctaacgtcgtcgccctccacctacgctcgggtagaatgcatgtgcttccttcctgcggtgccactctcctccgtcggcctctggatctggatcaccactgctaggggctatcaccgtcacggccaccgccccacctccatctccaccacccagccctgctgttcaccgcccttctccgcgcaaccgcgcctctctctgaattgctatcagaagcaatttgaggtctatttttgtgatttataattatgttggcaatgcggggccatgctcacccgccgggtcctgtgcgggggtggaggtgggtgatgtttttcactcattgcctttgtgagggtgggggcgttccagcctagttcgcccgccccgttgccacccctaaattggcttgtttacatagactcaaaaacaaaaaaaattatataagtaggagcatctactttatgttaggttctatggctaagtaggaatgatataattttttttataaaactccaactaaatcttatatgcagttactcttagagaaacatattagctttgattttgggcaaatctacaaatgagtgatgaggagaaggaatccatgcctaaatttagaaattacaattatgcaaattttcgccgactttggatgcctattttctaataggattgttgtttgaataagttatatcacttcttttggtggagttgttatttgtcttccatttcattttatggtagctaagtttcggggctttaagccaataattatgtaataattggttgtagcttttgttgaattgaaggcagactttcgtccattatcttaagaaaattgaagcgttcgagtcaaaagtcacgcctaatttaaagtctagtagtttggaattcaagaattgtgcacaaaacacatgggttgattctctacttttttttaaaaaaaagaaaacatgggttaattctagtaatgcaaaattcatttgtttggcatgcaatacttatatcttatatgttcaataaatgaataaatgaataaaaaaataattaggtatatagaaaattatatttatggaatttaaaataaagtgatgggcgaactacgggagttgaacccacacatggatgattcacaatccactaccgagatcccggcaaaggattttctcttctattttttctgatgaatggacaagtttattagataaatagttgaaagcatgcagtctgttgcgagaatcactagctgttttgtaaaggatgatgcgttgcctcttcgccagcaagtattaattctcttagcaaacaatatattaacacaaaattaacatgataaggctgagtacgagagtgcacgtttcgaacccatcttattgacgtggaaaacgaggtaagtattgttttaaaacttaaaatagattaatattatattttaaagtaactttcctatattttttttcaaaacccatcatttagcagcttagcattgcgtggaagaaaaagatagaacttgggaaagatttgttccaaacaaagcctaggtctctaagttaattgtgtcatagtagagtgatgagccaccaaccatattaaaatcttaatgctcgtgattacacacagacggatgagtgttcaataggaatttaatgaggtctaaggatttatcattggattgccaatttgccatctcttgagcgtgtgagggcgaagtactacaagcctctacatgtatataggattatacgatgaggtgaaggagagaagttaggagaaagagaatgagccacatctcgtgcaaggggcaacctccacacaatctctaagaaaagtgaaagaagatgtgagagtaaattaatattggggtttgggtattagttgtgatatattgtacactactacgaaaaccatctttcgtggtggccattttgggttttcgttagcggaatttggagacaccacaaagcaaaggcaagtgaaaaacaagatcttcgctggcggttatcgactgctagcgataattcaatttcactagtagccgtcttaagccatccgccagcaaggcagcaaagatccattttcactggcggatgtcttacaccgactgccagcgataattcatttttgctggcggcatcaaccgccagcgaaaatctattttgggccaagaaaaaaagacccaatgcagctgccctagccaccagcaaagaggaaatttgaaatacaaatcatttacacagatcaaacatcatttacacaaatcaaacatgaaatacaaatcacaacataggcatcatctggaacaacatgcacaaaaaaaatcacatctagcaatggaaccctagccaccatcggccccgtcccctcccgcgacatagccaccgccaccatcggccccgtcaccgcggtcgcggtcatcgtcgtcagctccaccgccgcccgcctgccatcggtgccgcgggggccaccaccccctccattcggctagatctgggagaaggagagggaggggagggaaggggaggcgagaagccgccagatccggcagcgtcgtcgtcgtcagctccgccgctgcccgcctgccgtcgccgccgcggcggccgctgcccctccctccggctagatctaggagagggagaggaaagggaggggaggggatgggaggagctgctagatccggcagcgtcgtcgtcagctccattgctgccgcggcggccgccaacccctctgtcacgcccagaaattcccgaataggattccaagcagaatgtgcattaaaacccccgtccaggaccggccggggtacacaaacgacaaaattgacatacagatccacgtcttacaaacatcataaagccttacataaatgcaacggaaaattaaaagataactggagctaagccatgacttggaccgcagcgggatcaccactccacaagcatccttgacggcacggacgaagcctactcctcggagaagccaccatctaacgcatactcaaactctggggtttggggaaaatagagcaagactgagtactacccactgtactcagcaagtcataccggaataggggtatgatgcagggaattatcaagggatagttatagaggttcatttgcataaagcgagcatttataaacagtagttggaagcagtaaaacaattataataattaatcaatattaatcatccactgtccaacgctataccatgttgcaacaggcccaaccatccacctatactattcaattccattagactagactagggtgaatctaatcacggtgaatctggttgaccgcccataaccgcgggcacggctattcgaatagttttactcttatcagaggtgtacaactgtacacacaagacacagccccacgatacgttttcgtgcgccgacatgccaccacgacataccggatagaggccgtgataggacccttcgcataaccccctctaaccaagcacactacacctcaggtttcacccccactcctcgcaaggcagcgagcagtcccctctcgtgcctaggtgaatccggaagccgcataggccgtcgcagggcccatccaaactccatcacgcccacccttgcctggatgcgtcagctagaggaaagctacactacaagcccagccgttgcccacgctggcttgtggtaagtacgaggaattcttccagggtttcccgcgaactggtccttaagtgccatgggcgcgactagcaaaaccatgcacccacagcccaccatttaacatattttaatgaagcgacaccaggacggtggctctaacccaacatcaacactagaacctgaagtctatccattaatatgatttcccccattgtgtgctagttgaactaagcatggctaagcaatccctagtccaatatctaatcatgttatatcccaagctaacaaaggaacatggtacaaaatagcatggctataacagtaggtaaacatcccatggtaacagtataaaacaatgcagtatttgaaggaaaacaatggagcatttccaatataggatcaacatgttcaagtgacaagcatgacttgccttgctctgctactggaggaacctcggcgactatttcaaagtacaccggagcgtcgggagagccggaatctagacgacatagaaagcaaacaatacaaacaggctacaagactactgaaacagagaacaaaaccatttttaatggattctatacatttttcttgattactgagacttgaatgggcttaaacggagctcggatgaattagatatgattttagaagattcactgtatttttactataacagaaaaaaatccttaatttatttattgcgcaataaataaatcccgggagagagagagagaggcgacgccgacatgcgggccccacatggcagtggctgcgggcgctggtccatggtggatcgggtccatggaccggggaaaaggggcggtgcaccacgtggtgcacacgtggcgcgcacgtggcggcctcatggcagccacgcgggcgacgggatcggatggccccgatctaccgctcggtagatcagacggcggatgcggctcgcggccggcgtgcacgggcacggctcaagccagcccggcggccatggcccgcggcggcgcgaggcggcgaccggccgacggcagagggcggcggcgcagcgactaagcggtgcgggagagagggagaaaggggaggaggggcctcaccgacgacgatcgacgacggcgagcgacagagggtgatggcgacggcgagacgagctccgggaccacctaagggatcaaaagggatagtaatttgcccgtgctaccgctacggtgacatttaataacataattcaagcaacctgctaacgctatagtgacatttaataacacaattcaaacaaccaaaaatatatacaagactatattgcatagttataagatcaagcaaaaattaaaaaaactatcactatataaataagtcaatctgttctgtacaatctgttgtacgcacataaataagtccaaagtaggtagttctgtacaatatataaatactgtgcaggtaataactatcactatctttgaccagtagtgaaacacatattgtttgctacagatcaataacaaggcaacatattgcatacacaccatcacagttcgatcatcatcgatccattaaagcagtcatggtcagtgcaaggctagttttctgtaactcaagacattttgatcttcagaatatgtttgcacggcctcataaataaaggagaaggcatattcacaaatcttggaatacaaaggaggtaaacgaaatttaatttgttctatgacaataatctgaaatctataacactctaagtatgacatccaacaattatacgagaaggtagtcacaacttaaaccttgaagccggaacccttcattttgcttgtcatcgtccaatgatatgaagagattccttttgcttgtcatgttatcctgcgaaggaagtgaaaaacatgtttgctccattgtacccgatgcacagagaacaattttggatcatagcaactacagttatgtttgctccaagtttatccttgtcaatgcaaacatagtgtatttacttaccaacaaacattgtttcttctttgatttcatattgacaaacagatcccttgaaagcttgctatttgaagaggatatacgcctcggtccattcttaaacagtgaataaatcgtaagggtaacatatataaaaggctataaatttgtcataattttattcttttctctctatatgattcatgaatttgaagatatgattatccattgcactatccaatactctgtgaattgcatttgacgatccaatactcatgtgttcccagttgagtaaacacatgatagttctgtatatacaggcatgttaggcctcaatgcatggtaggtctgaaattagtataacggcagaaaaaatgacaaaacattagtttgacaattagcctataaatacgacttctctaacccaacaattaagagttactacaaagcttttgttgaggtaaatatcctctgcatgaaatgactgacaagtagtacttgcattatacacataacataatttgaacataattccgttcaacagccaagatgtggaggcggcatcaggctctccttcgccgcatctcaccgcttaagcatccagcgggctggcctgctagggggatcggatgctactacgccaccgagccggagggcaggaagccaaagacggctcctttgcaggtaatttctggaatatgttatctctaggctaggctcggtgcttgctatcatggcaaatccctcccttttgagtaatgaatgcaggtcattgccgaaatacgtgtctcttaccttgagagttttggcgacgagttgtatatttgtacgaaatatcagtcaggataaagacagtgagaacagtgagaacaacggactgaacacattatttaccactgcagctcaacagcataataagaatttctcataagcaagctatcgttttgtctgaattactactttcctacacacattccatagagatgctttgattttcagtggattttaacttttttttaatcgtcccaactacacttgtgggaaataacaaacttgcattatgtaaaagtttgacaatcggaatatactgaaaggcacccattctttggggtttcaagaaatccatgtcatcagacggatatagtaagaaacatccatactgaaatttgcagtcaaggggcatggtggataggttccatttgcgtgccaaaggtggtgatggcggcaatggctgcatcagtcttcctcgctccaggtcaggatcgccaaggcaagcctgatggtttaacgactcccctgctgcacagcccatggaattgtcacatggtgctagcagtaatctttttgtgtatttttttgtggtgtaataatgcctggtcgtgatcaacattagcctagatcttagtgaaaaggagtaagatctaggctaacttccttccccatctcacagattgttaattgcttacaaaataaaattcagcagcagcacctaagtagagtaaactatcagatgccctgtttttctacataatgcataacattaaatttatttctttctgaatagtctccagatcacaatgaatgcattggaaaatatgtcggtatttaatcaatctaaatattagttggccctaacacattgacctaacttaacacttacctatgatgagatcggataacgagtgattgacgacgacctgatggctgcgcggtggagacaggacggcgagcgatccgatggcggaacgcggtcagcgcgagggtgcgccggcggcatcaatctggaggcgggaatcgacggcggcgcaatggcgaccggatggagaacggacggcgatgggatcgagaaatccggatggacaacggacggcgatggagagaggggcggcactcggcggggagagaggggcggctggggtcggcggcgacgtgaatcgcggcggggcggcgtgatggtggagatcggtggcgggctggcgttgcatgagagggagagaagagagattagggctggggaggcgtgggctgggatgggggagggggcgcagttgagaggtgcgaggtggagaggatctgagcgttggattttacacagagatgatccgaaccgttccacgaggaatgaaagaatgagtgatgagtgataagtgaaaccatttgttcaactatagggtagaagatagatgagttagagagggagagggaaaccatggatgggtagggcggcgaccgaaggcgccggccatggcgaagctcaccggcgcgtggcacgggcggggttctagcggcggattactacggaggaggggtggacgggacggctcgcacgacggcgaacgcgacgacgtcgacggtgcggctcggcacggcggctagtggcgaccggagcggcggcggcagcggcggcggcggagaggaggacgacggcgctaaggcggtggagtgcacgggagcgggcgattgcaaaaataaaaagagagaggagggaacgtgtcacgcccagaaatttaacccaaatttccagactattttgcgtattaaatccctgtccaggaccagccagggtacacaaaacgacaagtaatatacagttccaaacgtaaataaagcgtaaaatacttacaaaagaggcacttagtcctcgcaccgaaacgaaagcagcagcagcggtaaaaggcgatcctagcggggcttcagctccactccacaggcaaaactcaactggggtctgagccttggtcctctaacttcgtcttcagctcaaaagcactacacttctgaaaaaaggggaataatagcaagactgagtacaaccaccgtactcagcaagccacaccaacgatgcagatgtgcaaggggatacaaggatggtttgtggctatttgcataaaggcggttgtaaaacattttattgagcaaaaccgtaaaactgttgagtaactaaagtaacattaaatctccactgatcaacgctacaccacgttgaacaggcccaaccaacccacctgtactacagtgcattgggtcgatttattaagatgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagaccctccgcataaccctcccctaaccatccacaccacgctaaggtttcacccccacccctcaaaaggcagtgggcggtcccctcttgcgccgaggtgaatccggcaactggacaaccggacaccccggccgacccaactccatcacgcccaccctcgccaccgatgcctaggaaagggtcgagctatacttcagatcaagcagttacccactcccgcttgtggtaagcactgtaagtcttccagggtttcccgtgaaccggtccttaattgccatgggtgcgactcgcaaaaccatgcacccacagcccaccattcagtcacattttagttggataattacgaccatagaacttggccagatgtctcgagcacgcagctcaacaagatactagaatgtctaatactgcaattatcccatcgactgagctagtggtaattaagcatggctaagcatatagttctagctaggtcatcaaagtaacacaagctaggcgatttattacccacggttgacaaaggacagatatcaagtaaacatggcacaagcgagcagataggtaaaccctgatcccatgtaattagcaaaacatgcatatttatttgtaaccggtaaaacatttataaattgggatcaacatgctcaaggggaatgtgtgacttgccttgcttcttcaaaacaatcttccggactcttttcctcgcgactgcggacttccgaaacgacggattctacacgctagcacgcaaaacaaggaaaaactctaataaaaaccaaggaaacagtacataaaaagtaaacaaacatgtagagctcaattttagatgaattttgcaagttgaatggctcaattcggagtttgaatgaattagatatgaattttagaagttttgagacatttaaatgaatttctagaattattaacgaattatgacgcaattattatttatttttccaaaggaaaagagggttgctgacgtcatcaaaggggaggggcggctccggcaagcgggccccaccggtcagcggcacaagggcgccggtccaccgtggaccgggaccaccgaggcggtccaccgccggtccacgggaaccgacggtccggatcggcccaagccgatcaggctgccaggggcggcgcggctggggcacagcacggcacaaagtcggctggccaaacgacggcgcgcggcggcgcggccacccgcggcgacggccggcgacagctcccgcgggcgaaagcggcgcacgcgagagcagcggcgcggcgcggcaagggggaggcggcaaccgtctgcccggcaccaccggcaacggcgcgggcacggagcgcggagcgcggcggcagcgacccggtcggacggccaccgatggtggcagcgcgtcgcgaggacgacctggaggcggctgacgaaggggaggaaaagagagagggaggggagtgctcaccgagatgcacgacggcgaaggggcggccgacggcaaggaacggtggcggcggggctcctcaggaagacgacgcgacggagctccggcgacgggcgtcgctcgggatggggcggacgggctcggcctcgatcggcgaccgaggaaggaggagctctgtcacacccagaaattcccgaat

SEQ ID NO: 19663 - DNA, 9112 bp, Oryza sativa
ccggaataggggtatgatgcagggaattatcaaaggagagctagagtagttcatatgcataaagcgagcattaataaacagaagttgacagatttaaacagttgtaacaattaattactattaatcatctgctgtccaacgctatcccacgttgcgacaggcccaaccatccacctaaactatccaaattcaaaagattatactagggtgagactaatcacggtgaatctggttgaccgcccataaccgcgggcacggctattcgaatagttttactctgatcagaggtgtacaactgtacccacaagacatagccccacgacacgtttccgtgcgccgacatgtcaccacgacatttccaatataggatcaacatgttcaagtgacaagcatgacttgccttgctctgctgctggaggaacctcggcgactatttcgaagtacaccggagcgtcggaggaaccagaatctagcgacatacaaagcaaacattgcaaacaggctataagactactaaaacagggaacaaaaccatttttaatggattctacacatttttcttgatttactgagacttgaattggcttaaacggaactcggatgaattagttatgaattttagaagattcactgtgtttattactataacaaaaagtccttaaataatttattgcgcaataattcccagggctgacgtcatcaaggcggggcgcggcgccggcaaacgggccccaccggtcagtggctcgggagagggaggaaggggcggcctggctgggcctcggcctgcggccggcccagcagggaggagggggagaaaacggagagaatgggccggcggcccattcggaaggggaagggaaaaagaaaaagaaaaaaagaaaaggattttcctggaattaaaatattgcttgctcaattttaattggttaaaattatttctagggctctgaaaattccactaaaaatcctgttagtggatttcgacatgtagaactcaagaaaaaattccacatgccacttccgattattatttgcattgatttaaaagggtttactcttgctttgcactggtattttcttagggtcgcttataaattaaactttaggcttgggaggagaactttggggtgtgacaaacctatcccccttaaacggaatctcgaccccgagattcggaggagctggcgaagaggtgcggatgggcggctttcaactcatcttccctttcccaggttgcttcctcctctgaatggtgactccactgaactcggcaaaacctggtgaccttgtttctggttcttctttcgctggtatcaagtatacgaaccggcttctccacgtaggtcagatcctcctagagatcgatgtgctccgaaaaggcctgttcttcgggtacccttaagcacttctttaattgggacacgtggaacacgtcatggatgccgatcatattggatggaagttctagctgataagcaacttctccccttcgttccaagattttgtagggtcccacgaaacgtgctgccaacttgcctttggtttgaaaacggtgcactccccggagcggagtgacacgaagatacacgtaatcccctgcttcaaaagtgagctcccttcggcggttgtccgcgtagctcttctgtcgagactgggcaatcctcaacctttccctgataattctgactttctcttctgcttccgctaatacctctgtcccgaacagttgacgctcgcctgtctgatcccagaagagaggtgtgcggcacttccggccgtataatgcttcgaacggtgccatctgtagactggcctggtagctgttgttgtaagagaattccgcatatggcaagtttttgtcccaagctccaccaaaatcaagagcgcaagctctcaacatatcttccaagatttgattgactcgctcggtctgaccatcagtttgcgggtgataggccgtgctgaaatttaaacgggtccccaattcttcctgcagcttctgccaaaattttgaggtgaactgactccctcggtcagatacaatctttttgggtactccatgtagacacatgattctcgagaggtagagctctgccaaccttttgctcgtatacgtggtatgtactggtatgaagtgagcaaccttagtgagtcgatccacgactacccagattgaatcgtgacccgatgatgtccggggcaatcctgttataaagtccattccgatctcctcccatttccattccgggatttgaagaggttggagtaaacctgctggtctttggtgctctaccttcactcgttggcaaacatcgcagagtgcgacgaattcagctatttctctcctcatgctgacccaccaaaacttttctttgaggtcttaatacattttggtgctgcctggatgaatggagtactgggtctgatgagcctcggtgagtatcagatccttcagttccttgtcgtcaggtacacacaatctttctcccaaccagattgtgccgtgttcatcctcaaggaaatcccgagcctttccgactctcatgttctttttcagctctgctatttcggcatcattcacttgagcggctctaacttgatcgacgagcgtaggccgtgcttccagagcggctacgaacccgtgttcaacaattcccacgttgagacgctccaactcctgctgcaatttctcacacatgccctcgatgcatagggcagtgcagtaacttttcctgcttaatgcatctgccaccacattggctttacccgggtggtagtgaatgttcatgtcatagtctttgattagttccaaccatcttcgttgtcggagatttaggtccggttgggtgaagatgtatttcaaactcttatggtccgtatatacttcgcagcggttgccaatcagatagtgcctccagatcttcaaagcatgaaccactgctgccaattccaggtcatgggttggataattcccttcgtgtggacgcaactgccgcgaggcatacgcaaccactctgccctcttgcatcaggacacatccaagtccgtgacgggatgcatcgcaatagacttggaagtctttcatctggtcgggcagaatcaaaactggtgcggatactaatttcttcttgagctcctcaaaactcttatcgcactcagctgtccatttaaacttctcatctttcttaagcaactgagtcataggacgggcgatcctggagaagttttcaatgaatcggcggtaataacccgcaagtccaagaaaactccgaatctgcgacatggtcttaggtggggtccatttggtaactgactccacgttcgatggatcaactgccacaccctgagctgtaatgacatgccccagaaacttgacttccgtcaaccagaagtcacacttgctgaacttagcatatagctggtgctccttcaacttctcgagtaccagacggagatgttgctcatgttcttcttcggactttgaatagataagtatgtcgtcgatgaataccacaacaaacttgtccagaaattccatgaacactttgttcatcagattcatgaaaaatgcaggtgcgttggtaagtccgaaagacataaccgtgcactcatatagcccgtaccgagtggtgaaggccgtctttggaatatcctcttcccgaattctcaactggtggtagcctgatcgcaggtctatcttagaaaacactttagctcctttcagttgatcaaacaaatcatcgattcgcggcaaaggatatttgttcttgattgtgacttcgttgagtgcgcgataatcaacgcacatcctcttcgtcttatcctttttctccacaaaaatgaccggagcaccccaaggtgaagtacttggtcgaatgtaccctttttcagctgctcatcaacctgcttcttgacctctgctagttcgttggccgccattctgtacggtctcttgtaaattggagcggttcccggtgccaagtcaatccggaattcaatctctctcttgggtggcatggtagtgaggtcttcggggaacacttctggatactcgcagactatggggatatcttccaatttcctcaaattcttttccacggtgaccactgggatttccgcttcaatctgattcaaggagaccccttgctttggtgagtctggtgatttgtacactactgtttctcccttctcgttggtcaaggtgactgtgcgattcgcacaatcaatgactcccttgaactgggttaaccaatccatcccaagaatgacatctaggtctttggatttgagaagaatgaggttggctagaaatggtgatctttggatttctattagcactgaagggctaaaactgactgaggttgaactatttcccggggcatgaaccctcattggtgtgctaagctcttctttccttaacccatgcatcccgacaaacttctttgaaatgaacaaatgcgttgcaccagaatcaaaaagtactgttgcagggattgagttaacaggaaacgtacccagtacaacctctggtgctgcttgtgcctcctccgcagatgcgtggttgacacgagcctggataaaccttggcccggcacgcctaggcttcgggcatttgtcagcgaagtggccaagctcgccacagttgaagcaggaccctggttttgctccagtctccttcttggcttgcgcggacaggcctgactgtgccggtgccgttggtgggcgtggagctgcaccgcggttgggctgacctccatggtggttctgactgccactggcgccctggggaaaattgctagggttgaacgggcggtactggcggacgatcatggtggtaggtccaccctgctgcccgggagcgaagcgcggcctctggtgacttccctgaggtgccctgaactgagcggccttcctcttcctgtccatcttgttgcgttgatcctcctgacggattgccttgtccaccagcctttcgaaattggcgtaatctccagatatcaactggttggttagctcatcatccagacctgctaggaatttttcctgcttctcggcgtcagtacggacatcctccggtgcatatcgcgcgaggcgattgaactcatggagatactccgtcacagtcatgttaccctgatggagtgctcggaattctctcttcttttgtgccacgaccccgtctggcacctacgccttcctgaagctacgacagaactctgcccaagtgacttcagtgcctggcgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggagaaggtgggtggcctgacacgtagaaactctggcaacttggactgagggggagggggaccaaacagctgatgctgctgttcagcgtgctgcagcatccgctggtgcatctgctggtgctgctgctgcatctgctgcatcatggctgccatcatctgagtctgatgtgccatcacttgggctagcgtcggattctcgggaagtggtggcggaccattgccggaattgctgttgggatgcacaccctcagtgcgctcttcgccgttgttgccctcgcctgttgcgcggctaccattcctggtgtagaccatcttgaggaagagcatacgggggaaaagaagaaaaacagatgctcaggaactaagctttattataaaggaatttaaactgcaattgttctgatctgaattaaaacacttaaaaagcaagcaaaaatccttattaagacagccatatcataggcacatgatatcgaccgtcgactgaccccaagcaagcaacctaaacacacaaactaacaagcagaagctagcaagtcgataaactaatggaaaacgggcctaatgctcggaacggctcctgcggtcggtggagtcgaaggcgtcctcctgctcgtcaccaggtccctctgagcgactcctggagcctggcagataagtctcgccgctgcccgactctgagccactggagctactgctgctgagatcgcggctgccactgggagtagcggacaaccaacctccgttgccactggctggacccctggcggctgatgctagagcgaaggagagagcggacgcgggagctgacacgtgaacgggagctggagctggtgctggagctgcaggaactgccggagctgcgggcggaactggaggtgcgggaactgcgggcggaggtgggttcctgggcgcaagctggatgcgcacgggtgcagtcgtcttcttgcggggcgtagtgcggatccggactcctcctggcgcgggaagaccctttaactgagcattctccctcttcaggcgcgctatcgcgtccttcagagcgacgatcctcatgagcttcccatcattcaaggccttggacgccttgtgcaggtccgagtgcatcctatccaatcccctcatcacagcacacatgtgaccaaaagtagtgtcgttctcgccggctgtcggacggaaagtactgacatcatcaccgctggctcgacgagggtgaaatcggtacgccgtgtcgtggaagatgtagttgtggcgctcccgtagtctggccatcatcaggtatgctgcctcctgacaggcgtgatctgctgtgcctccggatgcctcaaccaccatattagctaggcaggtacccacgtagccgtggacctccaggcgaacacggtgaggaagctcgccactgagcggtggaacagtcgtgtactctggcgcgttggggtagcccaccaccagcgtcatacgtgccaactctgccacaaagtcaatcatgccttctccgcggtggttgggtgggtggccggccatctagagaagacaaaggagtagggtcaatgcatgctcaaatccaaatttaaataaagcaataaaagactcaaataagagaatcgaataagagcgaaattttatgcatagatcattttgcatgagagcgaataaagaagacagactcacataatgataaaataaatgggaaattagatacatactaataataacaataagagcataaataccttgcaacccatgttcctgagctaggacctaatgcatttcacccatcaaatcccaactgactgacgaataaatctcaatagttttactaaaaccctagactgacttgttttgacaaatctcacttaaacgagcgaccaagatttttccccttgaaccacaagaacagatcccaattttcccagaacaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaattccccgtccaggaccggccggggtacacaaacgacaatgttgacattcaggtccacgtcttacaaacatcataaaagtcttacataaatgcagcggaaaaacggaagacaacaggagctaagccttgactagaactgcagcgggaacaccactccacaggcatcctcgacggcacggacgaagcctactcctcagagaaaccttcatctgacccatactcgtgctctggggttgggaaaaatagagcaagactgagtactacccactgtactcagcaagtcacaccggaataggggtatgatgtagggaattatcaaaggagagctagagtggttcatttgcataaagcgagcattaataaacagaagttgacagatttaaacagttgtaacaattaattactattaatcatccgctgtccaacgctatcccacgttgtgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgctaagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccaacagtctaaacattaataggattttccccattgtgcactagttgaactaagcatggctaagcaatccctagtccaatctctagtcatgttataacccccaagctgacaaagggacatggtacaacaatagcatggctatgaccattgggaaacaacccaatagtaccataataaaaccatccaatatttgaagaaaaacaataaagcatttgcaatataggttcaacatgttcaagtgacaagcatgacttgccttgctctgttgttggaggaacctcggcgactatttcgaagtacaccggagcgtcggaggaaccggaatctagcgacatacaaagcaaacattgcaacggcgcgggtcggcgtcgaccgaagcggcggcgcgacgcggctggagtcggcggcggcggcggagagaggtggttcgcgtggctacggcgctacggaggtggaggggggaaatggagcggtggccgagcttgcccggccggtggcaaagctggcggtggcggcggagcagtgtggcggcgaccctagtgaccggaaacggcggccggagttcgcccaaatgtggccgcgcgcgggaaccgcgtggg

SEQ ID NO: 19664 - DNA, 10733 bp, Oryza sativa
ccgattttcgcggggagagtggggggaaaggtggaggaggtgaaggggatcgttttcacgcactcatggggcggggtggggcgcgggagccgcggcgtcgtggggcgaatccggcggccatggcggcggttggggcgacgggaggttggggaagaagatgacaggtggggcctcgggtcccacctgtcggggagagagagaggggaaaacgggcgagggaggtaaagcagacttgagggagagagagagccgagcgggccgagggagaaggccggcccgagagggagagaaaagggggattgggctgaaaggggcccaaagagaggaaggaggattttatttgtttttctttttttattttaattgatgtaatgatctttgtgctattaaaactatttctcgagctccgaaaattcacggaaaattccggagagtacattagggcacaaagaatattacaaaatattcccgaccaatgatttttaaaggaaaatttcaaattctcccattattttacttgattaaattgatttaacttttatttaatttctagaaaatgtattattaaatgattttaaaacccgaacgaaaatcggggcgttacagaacggtggtgctttatatagacccacgagggtcgatcgtggccaggagaccgcgatttcgttggcggagtggggagaggtggggaggagagagaggcgggattcaaaaattgaatcccggccgtctcgagcgcgggcgcgggcgggagagagggggagtgggcgcgggggacgcgggcgcgagggcgacgtggcccggaagtcacgggagcggggcgcggcggcggttgcggggcacggcggcgccggctggaggtgggagacgggcccgacaggtgggccccagggctcgggcggctggctgggccgtggccttcggccagcctagcggggagggggagagaagagagaatgggccggcggcccattcgaaagagaagaagggaaaaagaaaaaaaagaaggaaatgaattttcctgggattaaatattgcttgtgctcaattttaattggttaaaattatttctagagctctaaaaattccactaaaaatctatgaccagaccactaaaaattatttctcgtaagggtctggtcataaagatttgagagaacttttaaaattctgaccattaataatttctcaaatacttagttttaatacaaaggaaatcaaatttggcttgaaaagttctatatatcacgatatcatcaattcgttagatatatttcataaacttttctaaaacaaaattgttattcggaagggtcaattgcatatttgccactggattgaacaggtatcgtggatctgcaactaaaaaaactataattgtaaatttgccataaaaaacagtttgaacataatgtaactgacactgaactcaagcttagactaacaccgttatatggctggttttcatgaaaattaggacaagaatgcccttcctcaataaaacaccatttaaggcaacaagcaagaacatagtcaacaagcatcattttccttgtacagaatctagagtgagcgcagccaatttacaaatggtgttgatctgaggatgatattaatgaagacgaacttttcctgtataaaatctagagtgagcagccaattcacaaatgaaaagaaaaaaaaaggatgacaagtaccttttgctagctataggtcctccctgacatgtctttgcaaagtggccaccatagccaccatgccgcttgaagcagtcgacgctgacagccgtcgcagcggcgtgccgcggcctgacgccgcccgacggagacgcccactacagctgttgccccaggccgccgcaagtgctgcagtagacgtcgacacccgctgcagtcgcgcgctgcaaacctgacgccgcccgctgcagccatcgcccaaagccgccacttgccttgcctaatcgccgaaataaatctgcacctcttctattggcatctaatactctaaagtaacatattgttggttgatttgctcctgatttgaaagaaggatgagaggatctgaggtttagggtttgtcgtgggagaggagaggaggagttcgagtggatgtttctgatgtggtagacttcgggaagaacagggataaggttgaatctggcatgggcaacatggtattatcgcgttgcctttttttaaaattcaatttcatgaattttttttatctgtgaattggaacggcgatggcatacggaatctgcgcacactgttttcagtggtaaatttgtaattcgtgactttataatggttatttagagttaaggggtgaaagtagtggcaaatatgcaattctccctattcggaaacttataactttctatgaatcatgccatatatgtcaaatatctagataaacatataaaaatgcatcttgtttaatctagtaaacaaaaaacaaaatttacactgatttataccaaaattgcagtttttcgtattgtgcaagtttagcatattcattgttcaagtttagtcgattgatgggtaagaaaaaaaatcaagtgactgataaataccaacaatttctattgatacacactcgttgcccttgataaaataactcttgataatagaaacgtgtatacttatgtgtttgcatgtgttatctcctgtggggggataccactcagagtgacctcgagcttatcggcggcagctacgacaatgacggatgacctcgatcagtgacgagtgatcgaagccgatcagcggccgcatctactacggcggcggcatcctcatcagcgagtggcaacgactacaacattatcgactgcaacgagatgaactcggcgggcgtagatgacaagcacatctgtggcggcacgtgttggaattaatagataggccttagccaattcaaagattaattctttagaaaatcataaaagcccacttcataggatggtagacatggggactttagtaccactttatctatttcaggagatagatacctcattataaggtgggatgctctcctagccacttgaggcatatgacgtagagagaacaggggggcatagcccttttgcagttttgttttgctgcgggaaattcggatttgtttgttttggaaacactccgaataatccggtgcgtgaaacggcatggagtctggataagttacgcatgacttgtccggttctcggttttgtagctttgttttgctgtggaaaatttggatttgtttgttttggaaacactccgaataatccggtgcatgaaatggcatggagtccggataagttacgcgtgacttatccggttctcgattatgcggagcggagatcgtgcaggcgtcctgatcaagcatcctgatatctctatataagttgagtcgccacctccacgtaacatacgtaaaatcaatctagggtttgcctcctcctcctctgtactgcgccttcgcttgtagtctactccatcccactcgtcagcgtgcaccggtgatcgggagaataggtttccggaacattcgcctttaacgtcctgcagtgggagaaggcggcaaataaggtttttggaacgtcgcacgactgctccctgttcgaccacaacggctcgtcttcctcttcgctcgcgtgctgcgcatcgtcgtcaacccccgcaatcgcgagtacttcctgctgtgcaactggttttccggtaccctcggtacgtattcagcatgttgtgcatattcgatctgttcatattttattatcagtttacatgtgtagatcttatgatacatttatgttagtttacatatgcagtgtcaggatttatttatgaaataaattaaatcattatctgcttataaaccctcgccgtagatgatggagtggtcggcgagccaccgatcgaattcgtctacaagctcgggccttggccggcagcccagtgagctcatcaaccctatgcgaaggcacgacgagctcatcagccccatccaaaggcagtgctggcttagccacctctccacagttcatagaccggtgttgaatgcacgatttgcgccaaggctgtctaaccgggtgaaccagccatttggagttcattttttttaaaaaaaagaaaatgctgggacatttcattctcgaaggacaatttcatcaatgggaattgagcatctgaaattggttacttttgatattggtacggtaagaactgataatgatgggttgctatcatgtggtgttgatcttgtttaaattggggctgaaccaaatcaattcatgtgcaagctacaattcaccaaccgataaatatggttcacacaatcaatctctcatcttgtcatgtactttaagaataactagtaatcgtgcacatacaaggtacgttcttcacaatacatattctaagatagccatatgtcagcctcgatcctccttttttttttcaaagtccccgagtccctccaaattgctgaagccaaaagtccaatgcagtgcagatacaagttcagcccgccactttgttgcattctaactgcgatgcccatagcacctgattgttacaatagctggtgagaaaggaaaatgattgaggccgagtatagtttcaaactttttcttcaaactttcaacttttctatcacatcaaaactttcctacacacataaactttcaacttttccatcacaccgttccaatttcaaccaaacttccaattttggcgtgagctaaacacaccctgaattatacctcaccatcggcatctagctaaaaaatcacaatcaacaggtcgttattagtggatgacattcacgtttgcacaatttaatttctgaatttaaattattctccactggacatgaaaatgtccagactatatatcaaaaagtgccaacttaagttgtgatcactatttgctcctaaaatttgtgaaaatagaataattccaattataagatgtaaatgaataagtagagcatgctcacctttcctagaaaacaaagagcccatgcgatacctcaagccctcaacatgcagaagaaagaatagaaataacagtgaacggatcttctaacttttgtaaaaggatcttctaacttttgtaaaagggaaatgctattgtcttgcaaaaccaatgaacagtgtaaaatgttagcaaatattattaattcagtaagctgcaagctgaaccagaggaatggaatgtgctgatcataataccctgctttgcgctaaatctagtgtatccatagctttatgctgatgtaaagttaatctactgaatcattttatcaagcatttgttgaatacaataatcaagtggaacttcgctcctcattccaatgagcatggatatttatcagtggatgagactctactaatgtttatgcaatttaatttctaaagtttaattgcagctcataggttccctaaattcgtgcgtatttatagaatcaggttaggaagcaaactatagacataccttttgcttgctctaccacttcaaaattgtagtttcttttcctttcccacattacaaaccagatattacccaaaaaaaaaaagaaacccatgccaaaaaaaatacagggacattagttgagattaactgcataaaaaaatcaagattagaatataaaaaacattaagactattttaagtttcaccacgttgctcatggataccatgtttttatctacataaatctttgacaaagttgtaaaagtacgacatgtgtttttcagtaaccataaggtattacaaggtcatgtactaagacactgaataattctaggaaagccgaattatgtaaagatgaaagttaccccacacagccatctatttttattcaagaaacagtttcaatgtatcttcagcatttcagcaatcaacaaaggtccttgttggactcaaaatccttgtcatcagtcattagcgtaggcaaaaaatcttgatgaaaataatgccctgagatgctgagaaaaaaaaataaagttggctgttgcagatgtaatttcctaagaatcatatacatgttcatcaggtattttagttgatgcattgacacatggaacatctattactcaccaagatatatgcatatacggcctgaaaagtagtagagcaaaagattagtttaggattctcctaaatatatggtttttctcttcaagaagttgggtattctctagggatcaaagacaaatgttatatatttctcagtaactacttacaagaatagtaggatggcttcatagtgattagtggtaatcatctggattacaagcaaatttaaatcctccagtgatctcaaaacatcacattacctccaaacaacgaaaaataataatagaaccagccaaaattttcctcctataataggctttgatttgacaacttttgccgctgcaaaattaagtcatttggaagctgaaattatataagtctgctagattaaagattttccgtaaaacacgaatccttgttgtgtactttacgcaatccttgttgtaaaatgggatctaaaatctaagaaaccacctgagtgtgatgtgataatacctgaggtgcagtactcaacttctcatatgtaagcataattttatctgctcctaaccaagagatgagcagactaaaacaagataattatactgctgacaccagccacgctgtcggctgaacatgacatgaaatcagcattagtaaagttcggaagaaagaatggatgcaaatcaattgataggggctgcacagtttcaatagacatacctcaagtcctcaacatacagcgctggtatatattatctcgactcacttagccccaaaacatgcttcctcgtttaacctctcctatccttagctttggtaaattgaccatgttgttctagacaaatggccctccaataattgttttattccgtagcaattatggtactaaactatgtgccatgttagaagtctaaacctggacatcacatttgtctggtgacaatgtacttgaaattgtaaccttgaatgtttacttaaagaaaaatgaagttacatactgcgattttttttggcagagatagttgttttgctgcgaactttaggaccaagaataatatccatatccaatcaaagaatatattttttttgcctatcttgttgagcgacaaatcaacttcttctagattactaaaagcatgaacgcacctgatgtggattgagaagagacaagggcacaacaattgtgaagatatagaagaccatctgcgcgaaaaaacaaattggagcagcatcaccaattaaaacaacaagcatgactattagatcagcacacagccatggtacctgagctgcctcgtcctgctctccacctcggaaatccctattttgcgaacaaaagaacagaatgggagcacctcacgtcctcaccaacacggcatctctgaaattgtgcaaggaaactactgatgagagatcgattgttgcttcagatttaatttaatttggcacatgatccttctatggcagcgcttgccagtatttcctctcgagtagctcatgtgtttcgctcgtcagcatgtaattcaggtcatccaaccatatgatcatgcaattaaatcatgcagacatgaaacaatgcattatgaactaagggacataaagaaattcagtcttatgaaacaaagacattaatggtgatgtgaaacaacaaaaaccttgccttactcaagctctaagatggtctctgaagaaggcatcatcacctgcacgtagtatcttcaggatctcgattagggtctccgtgggctgaaattgaagctccctgggagagtaaataaataatttacttccatagtagtcacattttgaagatttcatttgcaacagcagcatcatacatttgcttccatagtaaataaataatttacagcaaccgttgttagaaattttattcaaaagttcacaaaagaagatcacctcaatgtaatgtaattatttgattgttcactaaattcaacaaaaaaggaaaatcatggtcacttgttttcagatcgtgttttcaatgttttcaactaccaaatgctacaggccaatgctcaaggaagaagattaaaatttccacacgtatggagaagattagggattagggaaagagacaggatttgagggacttacttgattacttgatgaggggccgatgcctgctccggtggcggctccaagtgagagtccgacggatctccggcagacttctggcagagctccggcgaggatgcggccaacgggacacgatgatttacatggaaaacctcattgatgtgaggagtaaaaaaccatgggactaacggtccactccaaacttccactataatcagcaaataggtacaaatggagtcttctctagaacatctagaggcacatcacaacatcagctataacatcaagttacacacttggtatcacaacatcaaccatcaaaactaacaagaggtatatcaataaacaattagagaaatagtatatttttgtcctctttggttctcagacgagatatcccaaaccatgtatgcaaattgtatgaggcagaaacgatggtctatgagtcccttccaagctgtccaaaaacagcccatttggacaccgtttgacccctcgaactgacattctactaaatgttgtacaaactgtaactgcagtaactcgacctgataaactactattcaaatctggtgctcttctcaaccaatcctcacataaactaactagattgaagtgctcaaagtgaggaaccaatccaaccacatatgaacctccaatcgctaatttaatgaagatcgggtaagagccaccaagcttaacaaactgcaaatcttcttctccactctcctctcatttctcttgtgtttttctagtttcttctcctcctcaatagccgctactctctactctttcaatggaggctcacatttgttggacttttgggttgcaatgggctgagagcaaaagctccatgtggagaaaaatttagcccaacagttcattcgtttgagagaggacgcatcaactagattattttttcccgtatggacgaaaatccgacggaatttatttcgttggtaattttggtaaccgaaaaatacggtttgcttgcttttagacactaaatttcgctgtaattttggtaaccgaaaaataaggtttgcttgcttttagacactacgtgatatctcatctcctcttggacactaaaatcgtaccattattcatgttctagttagcagcaaatcaacatgcttactcaatctggcactaattccgagattatggaaaaaaagttttatcctctgccagcaatcagcaattcaagaggttcatccttgctcaaatacaaggttcatcttgctcggttgcaccggtaaaggttgagcagttgcacgtgtaaaggattttggcctggtttagtccctaatttttttttaaaaacatcacatcaaatctttagacatatccatggagcattaaatatagattaaaaaaaacaaattgtacagttaaagggaaaatcgcgagatgaatcttttgagcctaattagtccatgattagacataaatgctatagtaacccgcatatattaatgacgaattaattatgctcaaaagattcatctcgtggtttacatagctataatgatcgaatatgctagtaagaaattaaagaggatggaggggatatcccaattaagctaacgctggattctactcccatactgacaggtggacccccacaggggctaatttggtaggcgtctacctaccattaacggcgggaagtcaaacctacgccatcacgtagctgaccgccccgaccacttgctcactgacaggtgggcccgggtgggtacaggattgcgcaaacacaccgggaaacagcacacccccgtgagggacaccgtgggcccaccctgtccctcccctgtctcgtgcgcgtctctcggcggtcaaagcgcacgtcagggcaacccaggcacacgacgagcgagctgtaccaatcctacccacccaatgacatgtggggccccagtaaaatcgttcccacatgtctgtgacgccacggaaaataaatcgaagcaacgcgcaccgacctgacgcgcgcaacatctctaacgccgctgacagatggaccccacgccgtctcgccgacccccctggccctctcatcccgtgggcccgcgaacagcacggccccacctgtcattggccgcgggtactcgaagagtcacgtagaaacgggacgagatgagcaaatgcagtgcacccacgagaaccccgccacgtatcactgatacgtgggcccagtaaccggatggccccacctgtcggcggtcagatccgcccgcgatacaaaagggccgcgccttcccatttccacggcccgaacagtctctctcttctctctctctctctcttctccccgagagctcgcgaggcgaagccgcggccaccggcgctcgcgcagcgcgcagatccgcgcagcccgcgcggccgttggcgagagcggctgtacggacgcggagagcctccccgcgcctcgcgcgctgagccggaggcgggcgccctctacccccacgcgcgcgcggagccgccccgattcggacaaatccggtggaaattcggcggcaatcgggggatttcggtcggtggtgagtggcggcgtggtgtggtggggtggggtggggtggggtgg

SEQ ID NO: 19665 - DNA, 3724 bp, Oryza sativa
tggcggaccgggggaggatgaagggggtggagggtggcgagggagggagtggtgccggggaaggggcggaggggagacgggaggcacgggaggagctggagctcgcgctgtcgctggggcggcgagggtggcatttgccggcagcgcggcgcgagccgccgcccccgcccgcggctatgaggtggacgatgcctcctcattcatgggaccacgacgcagccgggagctcgcgggctgcgacacacgtccctccgcttaggtgtcgcgacatttggcacggagacaatgatgcagggggcgctatagagggcgcggaggagggagacgaggaggacgaggagggagatgaggatggagacagggatctgcagagtaaacggcccaaagtgcgcggcttcggcgagtaagttgcttcgaccgttacttttcctattttgctgttttgcatgcttgtttgttgtgttcagagttttagtggagttttattgctgatctcatgtaaactagtagtttgtagttaaaccctatcacgtcgatattgtaatttggagcaactcatggatgccataagtaagttttttgttctgttcagtgttttagcagagttttattgttgatctcatgtaaactagtagtttgtagttaaaccctgtcatgtttatattgtaacttggaacaactcatggatgccataagtagtttgaagtcgcgttgggagttttttatcaaacacgcttattagaatgaaaataggataagtccaatttactccccagaactataagattggataattaaccccctgaactattaaaaatggttcactttactggttatttacatttcttttctttgtttctctctatatcagtcgtattttaagcttaaattttgtagagccatagatgacacctttatcaaagttttaaaattgtcccaaaatttttcttgactatctgcttgaaatttaaaacctctatgtttaaattagtctcagtgcttccaacctatgtaaacagtgattaaaaaattgaaaaaatgttgagagataagttataatgcatatatcaatcccaccaaattttattgcaaaaatgacctatatagagagaaatgaaaaagagaaatgtcgttacggagtaaggtgaaccattttcaatcgttagggggtgggggggtgtaaaatgagccgaaaatttgtttatggggttagatgctcaggtgaaagtttggggggagttaaatggacttttttcatgaaaataatgagggaaacagtatataattgcacttgtagatgttttattctggttattagaaatactgataccccttggattggtaattgactgctctgcctgtggttgatgcacttgttccctattcccttaaattcatgttagtacgtattttctgctgcagagacagcctacataaacttacttgcctaagtatccttctggaagttttgtaagattaatgtggacatctagtattccttcttttcaccattcttcctttctgaactatgacttgcatcccatttacgtccttcagataataatacagtagatcaatattgattgcagccatgctgccagaatgattggcaatcaattttttgtattactgttttacaattgtgaaagaagcaagatgtttgcctcccccctctctcttttgtgaaagaagcaagaagaggtgctacctcataagtaaaccttgcatagattatctgatattttagtattcacattatgtagattattccaggtagttatatcctacatgattttcatactgttgtaggttagggcttatctttctctgtggttggcaatgggtattgataaccttgttttgctgaacagtagtggtattttctttttatgtggacttggtcatgaagtacttctttttgcttaccactcttcatgtacatagtgagtaaacatattcttcctttttgcagagaaagcccacaacattctggtgtaaatgcttccttctttggcttggaatcaacacatttccctggttctgatgaacatggccatttcaagctctcacactgtccagaaaatgaattagattttggtttgtcgcttttcccaaatgatggtgttaatgagaacccaggggatggcaatgttggtgatgtagaaatctcaggtggagaaaattctgaagatgttgaaataagaatggatctatctgatgatctattgcacctggtgtggcgcttgtttcttttgcacttcctctatatgcaaaatgcttggttgaagtatactaatttgttaaatatgctattacagatattctctttcttgggtcagagggatctatgcaaagaaggtgcctcctgtaaacagtggcgctctgcaagtatgcatgaggacttctggaaatgcttgaagtttgagaatactaggatatctctgcaaaactgtatgtcatttggttggctcttttttattctttttaaatactataattcatatgtgaaattatttaaatgttgtatggatttcaatggcatttaggcgtgagacagccagatagggattgttgacagagatttttcaaactattacccaattatcgtattcttttattacttgcttctttggttacaaggaacacaacttctttacctaatgctacagaggcttggatggatctaagagctttgggatcatgttatctagctctccgaatggacttccatctatgttatacttacatgatgttaatgattagacatactttaactttgctgataaaagtacaaatatagaggtgatgatggagtctggtatcaactgctagaaatttgcatttggctgtagtgaaaaccatcaaacaaatacaattttatttggattgaataaaacatgttgattgaaacccattatttgtgatttataacttctatttactaaaatggaattgttctctgctgttaagctacactaagcatatgttctttttctagcatatacactacaactgtttagtcatatccatttcatgtctgattgtatccctctgaattattactcgatattgctgacatgctttatcaccctgttgttgacatttgcagttgttgacatttgccatcgttaccaaaatgtgacatacctaaatctgtctggtgtcccacatgcagaattactggtgatggaagcgataacatgcttaaggttttcttccgattctatttcattaacctttgatgtgataattttgtcctcgtatttatcaaaaatggcacttttctaggcatctcaagacactaataatgggcaaagggcagctgggagaagcattttttcagttgttgtctgagtgcccattactgactactctgacagttagtgatgcatccctcgggagtggcattcaagaagtaactgttaatcacgatggattacgtgaacttcaaattttgaagtgtcgtgcactcagaatatctgtcaggtaacaagcttgttgcaaatacttcattatatataatatgttcatgtgtcttttgatcttttcaatatatgttgtttatcatccagatgttcccagcttcaaatactctcattgaggcgaactggcatggctcatgtatcactcaactgtccccagttggttgaattggattttcagtcctgccataaactttctgataatgccattcgccaagctgctacagcttgtccgctgttag

SEQ ID NO: 19666 - DNA, 3105 bp, Oryza sativa
  unsure (1)..(3105): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgacaaggcatttccaaagccgacacaggtttaccatatgtcgacgagaggggtcccagaccaacaacaggttaggtcccagaccatactgtgccaggaagcccaggggtcctccccgacaccaccccggcaaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgtttcccggtccgcggttttggaaattcatttagttcgcaagcaccgacccaggtgtcgggttttccaagtattttgtaaaactccagttttacccaagttgttactcagattttaagtttgagggcaaccgtcgatactggcacagggtgcacgaatatcgaggcgcaactggatggttacaaggggacatggtatagcaattaacaatggaagaatcaaatgcaacaagttaggtaggtctaccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaataaagccctattaatgaactctaagcgtgccattagatagatctcgagatttgagaaattttggaatttgaacggagtcaaacggatttacggttgggaagatattgaatttctaagattattggatttttggtctaaaggaaaaggatttaattaaatcccttttttttggaaaagaaaaagaaaagaaaaggggagagggagggaatatagacttccctcgggcggctagggcgcggcccgagaaaaagggcggctcggccgagcttaacgggctggccggcccaagaaggcggcccacagcggcccaagacgcgcgcgcgggggagggaggagagagagccggtggaccgggctcaccatgcgcggtcccgggtgggacccgcttgtcagcggctcggctcaccgtgcggagggagtacgcggctcatgcgcgcgggcgggggagggacgcggtgcacgcgcgcggttcgcggtggacgcggatgcagcgggcccacgcgcagcctcacggctcgcggtggaacgcgcgcacggggagggactgaccggggttggctcgacccggtctaggctgagctggcgccgacgtggcgcctacgtggctgccacgcgggccggcgggaggtagacgaagacccggccacgaatggacggcgggcggcagcggcgagcggcggagcgaaccacggcgatacgggcaaaagctagcacaccgggcggttgctcgtgatgaggggagacgagccaacggctcggatttgccggaggaagcttgacggcggcgaatcacggcggcgacaaccggcggggagggaagagggaaacggcggcgaggccacgaggggtcgattcccggcggtgagagcatctacgcggtttcgggaactcgatgctagcgtcggattggacggagctacaccgagcgaggctggcgacgtgcgggtgctacggagctcgagcggtgacggcggcgagcacgcggcgagcgacggcaacggtcggggcggcgccggctaactacggggagtctactcgagctactaccgaaagctagggggaggagatggagcgaggaggaagaacggagggaggcactaccatgcgggtcggggcgctgtgacaagaggccgacggcgcgggagtaatctctccggcctcgggccggggaagaggaaggagagggcgcggccgaagtcctcttccgcgtccttgctcgtgccggctcctccgacacgcgcaacaacgaacggcgacggcgaacagagcacgggggcggcggcaatggcgcggagacgaaagggagaggaaaggaagggagggaggctggggtttaaatgggcggcaatgtcggtttgggaaccgacttgcgcggtcaagggcgcgagctagcgctcggcggtcgcggccaaagcggcgacaggtaggatgacgccggcgggggaaaaggggaaaaaggagagggagaaaggggcttgcccttttgccgattcgggaaaaaggaggaggggagcgggggcgacgcggcagagggaggagggacgctgcctccgtcccttggcggcttgcgcgcggagtggcgggggccgggcggtgacgacggcgatgacggcgggcggtttggagctgcgcgacgacacgggcgacagacgcggcagggcagcggggccggacggcaaccacgcggacggcgcagacgaccacgcgggcgcgcgcgcgaaccacggcgcgcgggggctggctttgcgagcgggaagctcgccagggatggggagaaggggagcgaggggagggggcgctcggcgcgggcgactcccgtgcacgcgcgcgcggcgcgcgggcggaacggaaggagaaggggagaaggagcgcaccggggaggggagagggcgagagagagagaaagagatagagagagagagagagagagagagagagagagagagagagagagagagagcgcccgggagagggagggccgggggagagggggag

SEQ ID NO: 19667 - DNA, 5608 bp, Oryza sativa
cccccagggggagatgggccgggaggaaatcggcccatcgacccccgggggaggcaaaatagacttttgcggaggaatttgatttggaaggattggattcggaattggactcgacgatagatcggggattgagatcttgagatggcacgaacactagacaacaagcaaagaaacaaatttcgcaattagggtttttaagagataatttttccgctaggcgccacgacggaacgggcgctacaataatagaataaaacatcccggcctttgctcatcagagctatagccaattattataaaagtaacacccaaacactgagtgtagttcaaatgaattaaacacacccaacgaaataaaagatcaaactaagataaggagagcacatttattcaagtctatctgtgaatcttcatccatagtttgcaaggagttgcatgaccgttgtctcaagcctacgacatgcaaccttcataagctctcgatcatcttcacacatttgcagctgtgcccaaaatcggagccaatatgttgccctgaaaatcacctgcatatatgagatagatggtgatttgtcaaaaaccatatcattcctagtcaaccgcagagaccaacatatggcagaagctcctacaagtatgagtttactcttcttcttgtctacccccaagagccaaccatcaaacatattagatatggtagtaggaaggtataaaccaagagagaactgtactgctctccaaacaaattttgcataatgacactctataaaaagatgttgcatagtctcatttttcatacaaaaacaaaatcttaaattgccattccaatttcgtcttgccaaattatccttggttagcacaacccctttaaacaagtaccacataaaaatcttaatcttaagtggcatcttaagcttccaaataatcttgtttatctcaatataaccattattagttaaagctagatacatcgacctaatagaaaatattccattctgatgataattctatctaaagctatcagaggattgattcaattgaatatgtacaatataagcacacaattcatgccaatatgcaagattctgaccaactaatgatctcctaaaggaaacattgagtggaacagatctcataacattagcaatagtagaacttttccttcggacaatagagtataaagatggatatttgtctttaaaagccaagtttcctagccatttatctttccagaaccttatttgtttcccattatttataatccaagaacccatatctaggtatctttgaccttcatgagacctgacaaaaatgagaatcgccttgtttcttattaacttgggtcatagactaataaattattccgatattacaaagttactaaagtataagcttgttgttcttcttcctcctcccataaagttcttaacatggaagaacgtagaagtcaaagacaaacatctaagtcatatacaagactttaaatccgtggcatctcactatatcatattttttttaccaccaacaaccaccgccgggtcatcacaacttatccttcacttcacctatccaactattgttgtcgatgttcgtcctaccaatgatttgttgttagttcttaggattgcttagctcatagttttgtgtgggaacagagcacatcatccactaagacaatagtgaaaatgctgatgctcttgtggcaccagtggcaggagaagaggctttagggaagcggccatggccacaatggttattgaggttgtcatataactttatggaaaaactgtcatccataactgactttcctctattacttaaataatgaagttgttctccttcctgttctcccaccatccatgagcggttggatcttgattcgaactcccaacctatcatcagccacatatgagcccatacaacacgcccaaaccaatcgtgcgtgcttattggtatgcaagatatgttactagtcaaaataaaaggcgaaacatcctatttagatcatctttttcgatgtccctccttactctactattttgttcccctagtaggttaggcctacatgttagttactacttacccatgttttgggtttggacctaggacaattatagactttattgagcttggttgaaattaagaagggttaatttgttaagttcgaataattatatatcaaattttgaagaaaacttgtacgaatttgaacctctctcatcgccatgacaccgagaaaataaatatgattttttttcttcgtctaaatgtaaactttcagatggaagtgtgtgaaataagtgtgcatgcactcatttcaaaacagctctggtttggaacggagtggtatatactccactaactgtttgaagttaggttgccatccattttattgagggaatattaattgtcatcaagcggtactacgtgtgaacttaatcggaacgtggtcgtggtctgaccaaaattagctgagatttaagtcaagcagacacgtgcactgcagtttgagatcagctgcgtcttcagaacaccaaacacgcgtacgtgacaattggcaaccctttcgttcatattcatcgatctttcaaagactcaaacgtaggattataagccaaccaattaacgatcaatatatggtactccctccgttctaaatatgctactttgaccaacagtattcaaaaaagatgttttaaataaaaagagttgaatattatgatagtttatttaataataaatctagtaaaaaatgttaaaaaaatgttagacttgtcactattctaaaaatacttatattttgtgacggagggagtaagatctatttgattcagcacacgaaaccccgaaatgcagcgattaattaattagttgacaaaaaagataaagattaaaagaagatgaaacaagtcacggaggtgatttgaaaacaagggcatagtagtactattgtgtgtgtgtgtatagtaatagcgggtgttcacaaaacgagtgaaacataattaattaatccaagtaagtacacaaaagaccatggatcgatatgatgtagattgcatcaacgaggaacaacctgtactttggccatagataagatagaaacggcgcgaactgaactaactaattcagcatgcatcaagttaacagcgacacactaagctatagctagctagctcgtcatcgatccgtccggccggggcggcgagaatctctgataggtcgtcggatcagccaggtgcatgcacgaacgcaatggccgtcgccgtcgcgaagaagcccttgcgcgcattggctggggttttaaacttttggcgcggcgtgcagtggttaaattagtcgtagcacgcctcgccttgtccctctcgtcgccacacgcgtcgccgtgcgcgcgccgccacctgtagctgtagctctgtacatatgcatctcatccatcgcttaattacatcgacctgcaactactggcacacatgtgtacagctctcgctcatgtcatgcctcctctcgacgacgacgacggagacggcgatctctctaggtaattaagctagctaagctcatcctttatttggagtacggagtactccactatctactagcttgccaaaacctgacaccgatgtggatgacggcaattactaattgtgatcatcagcaaaagctagctaagctcaagtggatcaaagcagcaactgtggccttatctgatccattattgatatatatcaagtgctggagtatgtgagttgcatgccttttttttcctagccttttattcctttcaaacgtcatccatttatatatgtatttgtatacagagatgctgtgcatatatcgatcggaataataataagaagaagaggataacaaaaataacttcactttttcagtcaattaggtagaagcccatgctgctgattgccgcgccatacatatatatatgatgggacgagagagctagctaggcaaaagaaaatggatacatagatacatatatatataatcgatgctagctgctactgctgagatggatgagaataaattaaaggggtcattcgatgtggatatatggcggcgcagatgtatatattactccgcatattacatgatctagaaaaccggtcgaattaatgacttaatgtgacgacgacgacgaccacacaatctcctgcatactggtagctgatagtagctagctaacctagtgctagcatctcttgaccattaattccgattttctttaatttgctggtttcatcagctagcagccacacgaattggtgaaataaaaaaataattatcgatgattaatttgtctcgattgattactgaattcaacaacatgacctggcgtatcagctagaacctagcttgaaaatgattggaccggatcgagatctacagtatacagataacagatactgcaaaactgaatcacaagtacactagccattagtactaatgatgagaagtacctacgtacttcggccagtttgtcttgcatgcgtggagcggatctatagtataaggaccgatgactctcgataaaatctagtggcggagccagaaattatataacactggtagagaaaggggctttactcccggttagaaacccccctatagtcccggttatacaaccgggagtacgaatccgggactaaagatacccatctttagtcccgggtgaaataaccgggactaaaaatccatctttattcccggttggtattaccaaccgggactaaaaatggtggagcagtcccggttgattctttttttttttttgttgttgtttcattgctcaatcgatttgctccctaaatatcccaaatcatccacaagcatcacagatttgggaagaaatacatcacatattgcaaagaaatgcatcacagatcacaaatacatcacatcaccaaatctcaaacgaaaaatacatcacaaatcctaaaagaaatgcatcacaactcaaatacatcccagatcagatccaatatcacatacatcacagatcaaatccaatgaaacacaaaatcaaaaaaaaaaatcggcagcagatgggagggcgccgccggcctcccggtccccgtcctctcggcgtctgcgccagctcggccggcacgcccgcccgccgccgcggctcctgccgggcgccgctgctaccgcccggcttgccgccaggcccgcccgcccggccgccgccacggctcccgctcggcttgcggcagtgcatgcccgcccgtccgccgccgccgccttgtgtcgggcgccccgctcctgcctggtgccgccggtaccgcccggccggccgccgctccagatcgaggggaaggggaggaacggcaggggaagtggagaggaaggggatgaaggggagaggaagagggggtgaaggagatattaatgagaggggaggagatcgagaggagatcgcgcgcggctctcgggatagtctttgctcccggttggtataaacaaccgggactaaagatctatttttagtcccggttatttataccaaccgggagtaaaaataatggggatctgtctggaacccgacaactttttgaaccgggactaaaaatgatctttagtcccggttggt

SEQ ID NO: 19668 - DNA, 34014 bp, Oryza sativa
ctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagttgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaaatatacaagagaacaaattaagttacgagacaagctaagtttgtacgtgttgattaattatcttattaacatcgatctgcctctcttttctatggagaatttcaggaattaatccaccatatttctgtatgcagtcatgcatatatagatgcatgcaagagttaaggaacgaggcggccgggtgcctttgaccaccagcagtgcagctctggtagcttcatatatactcgactcgatcgtagcttgcgaccacggcacgctagctatatactcccaagtgaagtgctgttgcactcaacggaaagagaagattttgatggcttaatttgtcgtggtcaccacgatcatgatcatccatctcacaattcatgcagctctacatgcatggaacgaccggtctagctagccatttctttttccccctttattttttccatggaataattaaacaatcctagagtctcttcatcaaagtagacgttgatataaagaccgtttctcttctccagcaataatatgcatgtatttaaatatttataattatatacgtacttattgtttatgctccaaatgattgtcttccacaccctgcaggttttgcttatcatttatgtatatgtgctgccatattgcaatcatctgccaataaaaaaaatgcaacttgctgatagcccattgcactttgcacaagacgacaattaaacaaggaaaatccacgtgtatatatgattaaccaccatatatatagttgattatgattttattatgtggcgttctagctttgatcggctgcgacgacatatatgcatgtacacggatgacttgaccaaatgactgccgtaaaaggacagactacccggccggttcgatctaaaattagacgataagaacaaaccaactgaccagtagtaatacgttgagagaggacgtacgacaaaacaattaacatgtgtttcaaataaaatatatactcccctttcctaaatatttgacgccgttgactttttaaaacatgtttaactgttcatcttattcaaaaacttttgtaaaatatgtaaaactatatgtatacataaaaggtatattatttaacaatgaatcaaataggaaaagaattaataaatacttaaatttttaaataagatgaacggtcaaacatgtttaaaaaatcaactgtgtcaaatatttagaaacggatggaatatgtatcgaatagattaacctcgagctagctactggcagacataccattgacaggtcaatttatagaactcgatctcgatcgaaagatgaaccatgcatggtggccaccttttaattatcgtgacatgcacttggaaacccttttgatctcttaggaaagctagctgcagacaaagtagtgaactagctgtacactctgaataagtagttcatctcaagaagatagacgagaataagaagaagaaaactttcatgggagataacaacgtgatgtttatcctctcctatatattgaccatatatattattttctctcattggccagctaattattagcgtacgtatatatacggctctagatcgggcgccacgtacgtgttcggattaatctctagctggtaattgatttggtaataatagtgctgagatagatagatcagctggacaccagagtccgacgttccgttgaagcatcgctaatgtcgattagtacagttatggtcttccaaggtaaaaggacgtacggttagattaattgtgctcaatgatgaatacagccattcccttactgtttgctgcgtccagtttagattgtgacatgaagaattcaaggcctgcatatatatatgcgcataatatatataatgtcgtgtagaggaagcttcaatgtacctgtaaagatccttaaaccaacttgagccaactctcccatttactgttcttattttcaatcaagaaaaataccttcatataagggcaggtgttgtgtaatttagtttactagctagggcatgcttgaaagtcattcattttgcaagcttttcatatggaacaatttgatttaatttacgagcatgatcgatgagtgtttgcatgtttacacggatctgacaaattaacttgttctggaaacggtaaacaaattaaactgaacttttctacgaattaacagctgataacgaacgcatgttctgaacctaacttttcttttaaagataactatcttttgaacctaactagagggtccaagttagatagggaagttctgtaagtgcatccatcttgagatactaaggctaagcactaagctagcaggaagcaaggtcagttaagcatcagcagctagcagtagtgtagtacaacctggcttcctaagaaaaagatggccagccagacacatggttttgaatggttggctccggtaattaccaacgtgatcgatgtaataaatcgtgttgatcacagctggtaaaaaaaagagagagagatgaagattaatttggtgagtttcttgatttgggatctaacaggtgtcgacattggcgaggagcagatcacactagttactgccgacgggacacgtgtaggctggttgtggaagagacggttaaaaaccgtaagatacgccactcttccgagtccaatacggtgagtactaaagatctacgtattcctttcgtacgtacccagctagctagcttagctactgcctattattcgattgatgtttctttcacccgtgtgtgcgcgtgtctatgtctacgtaaaaacgtgctttcttttttgtggaaaaggaccttccaatgataaattgttgataaagccaaaccactaattagcatagctgcagtgacaactgacaagggcatacttcactcagtcagatatacagcccattgggccgtaaacacttgggtctcactcccgttcagactgtttgatggcccaggtgtatctcaagcccatacgacactagcttgggccttgatgggccgatacaccataacaacttgcgctcaaagtgggaataagtgcatccaaggtctcttaacttgtcaacgaattcgattttcatcctgcaaccacaaaaccagatacaacggatccctcaattatcaaaaccggtgcaatataagtcccatggtggtttggaaggcggttttggtttacgtggcgtctacgtggctaaattgacccggtcttcatctgacgtggcaatttgatttggaaattaataaaaagagtgaccccacatgtcagctacaccaaaagaattaattaaaaatggtggagcccacgtgggctccacttgtcattcactcccctaatcttcttcctcctctctctccccatctcccctctcctctctccaggagctggcggttcggcgacgcggccggccggcggcagcggagccagagatgacctcggagacgaggacgccggggagctgcgcctggacggggacgccggcggtgattgttgttactggactcagagttggtgttgttgttgttgagctcaccgtggtaggagctgagagggggagaaggagagatggggcggccgccgtgctgcgacaaggcaaacgtgaagaaggggccatggaaggcggaggaggacgcgcgccaagctgctagcgtacacctccacccatggcaccagcaactggacctccattcctcagcgagcaggtcgtgaaaatcaacgatatcgccattgctgctaatgggatcgagcttgaggtgcatttgatcatatcagatcagattaaaatatggtgtttttgtttatctcttcttctctccctctaggggatgcggcgtcaaggcaggtcggcggccaaccatgccgcggcgaccccccgtctgacgtcctccccagcgtcgagtcggtcgcctccgccacctcctgcggcatccacgtctccaagttctccgtcagctttccccgacgacgaaccggactccggcttctcgcccgacgacccggacctcctgcgcaaccgccccgtccccgaccggctcctcgtcgtctccgccggcgtcgcagccaacctcctcttcgccttcctcatcatctacacccaggcgctcgccgtcggcgtccccgtccaggcgcagctccccggcgtcctcgtctccgaggtcatccctggctccgctgccgccggcctgccgcatcaccgaaccgccagctcctggagagaggagaggggagatagggagagaggaggaagaagatgaggagagtgaatgacaagtggggcccatgtggaccacaccatttttaattaattcttttggtgtagctgacatgtggggttactctttttattaatttccaaatcaaattgccacgtcaatgccacatctatgccacgtcagatgaagaccaggtcaatttagacacgtaggtgccacgtaagccaaaaccaccatccaaaccgccatgggacctatattgcaccggttttgatagttgagggacccgttgtatctggttttgtggttaagggatgaaaattggatttgttgacaagttaagggaccttggatgaacttattccctcaaagtctcaatttgtcgccagattttcgtccttaaccaaaaatacaatccctcaacttacaaaacctatacaaataaggttcatacatagctcttttgactaggctgcttcatcctacgtggaattgacgtgacgcttacacgacaatttaatccggagaacaacaaaaggagctgacatggcagcagagacaaagtgtgggacccacatatcagctgagtcatgctggcatgtgggatcaccacatggacacatggtcaatcttcttctctactgtactgcccctaacagaggtacagaactggagtagtatagatcaagaaaagaatgacaggctcgtcttactttcaatggtacaaaaaaaaaatgtatataccccttgcatgcaagtatgcaactatgcaagctggcgggtccttgtgtatcactcattatcaggctactgtatagaagcaggttaaatcaatcgatttcagtaacaaaatggtcacttggggcgtgcgcagcgccgagcaagcgaacaccctccagatccaaaactttacggcgatgacgccctctgatcgtagctcccttgctgaactttctgctgtctgtctatcaagatgcaacctcaatggcacttcccagtggccatgctgcttccacaaacgcgttgctgtaagggactttctttaccaaggtcatctcttggtgagaaccaacacctgcgagagtgcaagagcaaaacaaattagtgataaatttgtgcaaaatctgtaatgcggtcttgattatatttagttttaacgagacataccaaatccatccacaagtaaggtgtactggtaaacgagatccatgcagatatatggaatgttatccttttggacaccagggtaggcagcttcggcgtccttcaagtttaacttacatgcacgcttggcagccttttcaaaatctgaaggtttaaccttagccacaggtgccttgggattcacaaatccagcctgagcagagaccagaaaattgtttactggtgtatcatcatggcaacaaaagcaaacatcttcagtagttcaacaaccttacctcagctgccctgtcgaagaaaaatgatgccacaaacaaattcttctgtccagcgccaccaccaccattccaaatgccaccaaaagaacatttcatgtgagtgcatgcttggtcaactttaagagctttcactacatcatccctgcattttgaataactagcaccagatggtgaagccgacgcttcaaatttgccattgccatatttgtattgccctacaatcacaatgcaattagaacaaaactatcttaccaacatagaaaagataaaattgcatctccaactattgtcacagattggtcatttgtgttgatgaggatttagatttatacacatcactataaataattctaactgcagactgatggttggaaagaatatcaaggaaaccagtaaggtatttgtttcatagagaatttgagggtaacctcatttaaaccaggttacgatccactataagggtgtgttccttaccacctcttcccaacttctatttctcgttttccacgcacacgtttgccaaactgctaaacggtgttttttttttttgcaaaaaaaattctatatgtaagttgttttacaaaattatatcaatccatttttttcaagtttattttagctcatgcttaattaatcatgcgctaatgggtcgctttgttttgcgtgtggcgaggtgaagttcccaacctccacctccgaatgcagcctacgcattacattcctcccttgaccaaaatatgcataagggtaacaacaattgaaattttaggaacaaacataagctacttggcagggagttaaatgatagcagaagaatatggtagaagtatgttactagtaccttgatgcccctccaatgtacagtagctgtaacctttgccattgccggcttttaagatctctgctctagcagccagcaacccataatgcaaatagctgtgaagaaatgtgtacagttatatatgtggttcaaagactccagactaaaaacaggtcatgtgatgtcatcttatacagcagataataaaaaagtaaggagtattaagtttgtggctatgtcagattaagtgtttgctgtagaacattacatagaataccacgtgatatttaggtagaatctttacacataaaagtacccttacgtttggtctggacttaagtttctcaaatttgcattaatacgctattcttgcatttttatcaatacgagatagtatcttagaggattacaacagctgtctgctttgcaaagaatataacctatgaattggcataggcagacatcagaaataggcatgacaatatgccatcagatgcttaaatggattttgaagattgttaccgtatcacaactgaataacttttttcttgacaatgtagcagcagccaaaagctcaacggtatttcatactaacctgtgaacataaagataatatgttgttcctttaagaaacagtttcttcacatatgaatcttcaccctctgatggtttaggagccttcactgcatccttctctgcaattgcatatgccatctgcacagatccacctccaagatcaaccactccaactgtgtctgcgtaagtctttcccaatttccccagcagataattgatggtaacctataaggatagagaagagcaacacttgttatcagttaatggactaaaagctagacatagaatcactagttgtgaacagatcctaaacactcaaaaggtgaattaactgtcagaacagtgcaccacatggattcagatgatctgcatctattttcagggaaaatgttgtttctggtgcccttactttcaatgtttagctttcgtcatttggattttgtttcgtcatttgtttctggtgcccaaattttgtttttcaaaaatgaaaatagttattttgcctaattcactcatgaaagcgaaaatttctctttttttatcatgtcctttaaaacttatatctttgaagctggcagatgtcagctctaagagaattggcagatttgttgctgaacaaaatagttttttctaaacaaaaagaacttatattgtcaatctgacaaatgtgaggcatttctaataatcaggagcacaaagtaatgttctgaaccatatgaataaatcaggccagttttgtacccattcatatgcgccttcctgaggtccatcaagaactgtaacccaatccggttgggtcttgaacgaactcttttcgcgaagaagatccctgacctgcaaaaattgtgagtgtattcaatattagggacaaccaatataaattcagtgatcgatcaaacaacaattaatcaaaggtgaataaaagcaaaatttaccgcttgcaaaatctcctctgatttttctgctcccaacgctcttagcccggcggtggcctgtgtgtgaattataaagcttattattagaagatgaccaagcagcaataggaagctctactggtatcgtacaagaactcaccccaactctaacaggagtctggccgcgcaattccacgggaaccactcgtttggcatcctcaaggagagagacgagcgatttggcagcctcctgcgggttattggcgtactcgctaagccccggctttttctgcaaaaggggaagtggggggaaattaagtaaaaatggattgagagatgaaaggatccctagcagatccagatccaattgggtggatggatcacctggacgaagagctcgatctggtcgccaatgtggagcagatcgaggttggcgtcgaagcggaagacgtggacgcggctcccggagctcccggcgtcgaaaatgacggcgtacttgttggcgtcgagggggccccacctcctgccggcggcggcggaggaggaggcgggggagcgcggcatgaggaggaggacgagggagacgagggcgagcggggcgaggatgacgaggaggacgccgcggtagcggtggaggcggtcggcgagcgtgtcggggcgggcgcccccgccgggcagcgcggagtagcggcgcatgttcttggcgtcggcgtcggagggcggggcgaggaggaggtccggggaggagggcgtgcggtagcggatgcggcccggcggcggcggcgacggcttgaccgcctcctgctccgcggaatccagggcggagagaggtggatctgcgcggcgtgggctctgcctctgcctctgagatcgcagtggagagtataacgggtggggtttgacttggcggggatcgcgtcgcgtcgagatgggcgtcgtcgcgagctggaaatgcgtgcgcgtgcgggtgcgtgtgcgtgtgtgtgcggcgttgggatctgcggcgagagaggggttcgctgctgctgctctgctccccggcgagccgagcgccagaggaagaggacaaagtggcgggcttggaatggggacgcgacaggtttgctcttgctgacgacgatgcggatgcggtgcggtttgcttcgtgcgcgcgccggctcgatcgatcgatcgcgcgtcccccggtcaccggctttgcccgtttgccgtgcgtgttgctttcagagtttggctaatctgtgcgcggtccacgcgtgtaccgtgacttggtttggtacgatcgggcacgacatgttccttggatttgaccatgtgtatacatcaagaggcgaatgcgatcgatcttttgtggtttgtttatatatccagaatgcttttattttcattcctttacaaggcttgcctctacggcttatgctttttttctcttttacaaaattaaagtgttgatgaatattatttattccagaattatatattttgatttttactgctttttctttaagaggggttaatgtaagagacaaacgaccctgaatatataatctttcgacacgcaattattggaatattcaataattcgcttgctataattgagcatataagcagtacactcttgttgtattctttgtcctctcctcttatgcacgaggttagcttctcttgagggatatcttgcttatctatcatgaataacaaacgcttttctcatgatttcttcttgtcccatctacatataagataacatatgtaacctaacatgtctaccgaagagcatattctctcctctaatgcatgaggtaccatttataggcggacattatgttgtttgtctattttaggcgtatagatagtagatgattatacgacgaacaactccaatggctagtgtagtattatcgctattggcatttatgcgttcctatgtattgtattcaagttatagtaatccttccctttttaataatacctccatccagaaatatatgggattattcccaattgggtacaaattaaggaagaaagtatacaccaaatctgattgtgtgaaaagacatatatagttaacacgttgaatgatgtgcatagagtacatctttaaaaaaaaactactaaagtttggtaggagtgaatgaattttaaaatgcactacatattagtattaatgagtttgtgagagccttatatgctgaaatcagtttgttgctgcccttgttgcctcagtataacaaaaatcgtctatattcttggacaaatgaaggagaaataatcccctatattcccgggcagatgagtagatgtcgacaatgattttgtttgcaaaatgggaaaaaataagataaaacctcctgaaagaaaaaaaaacaaaaaagagatttgacaaaattccatagcccaggtatcgtgatagaaaattttgaaatacgttttgtttgcaaaatgggaaaaaaaacaagataaaacctcctgaaagaaaaaaaaacaaaaaagagatttgacaaaattccatagcccaccgagtcaaaggagttactaggccgagggcaaaagttgggccgtaatcggccagccgcgcaagaagtaaaggaggcttggactgcgacgtaaagcgcgctctgggagtctgtgggctggaagcctgcaagcgccgggtctgggaggaaggctgggccgtgttgtcgcgacgctatcacaggcacatgcttgaacaacacgctgggcttgcttttgaccgcgatctcactcgattctcttctcgttgacttgtctcgtgccattttctcgtctcttcgctgtatgcaccatgtgttcacgtggcacgcacgtgcaacgtttcatataatccacgcatgtgttccctttttgactcgtacaagtatgaatagtatattgcggtgctataccttttctttgcgtatcagccatctactgaactgcaagtctgcaacgtgatgcgaaaagaaaaaaaaagagctgcaacgtacgtgatgcgaggactgtatgaaactgctcgcttgggttgggccttaaggcccatcaatatcgagtgcttagtaatatgggccgcttcgctggcgccgctgtatacaaacgtgacgtgatacgtactagtacagctttgaacgcacctcgtcgatcgatgcaaagtgcgatctgcattaatagcgttgcgtctccttgccaacctcctctgcatgcggtcgcttcccaccgacgcctccatcacatcggcgcccgtcgcggtcaactcgaaatcaacataccaccagccgcgcgcgtgcagccgtcgtcgcatctcaccatcgcagccatatcctctccctctcccacttcgcctcatcactactccgttccctaaccaccattcctcgccatggcggccccggcggacgactactacggcgacgacgacgacgagtacgacgactacaacccccacccctacggcggcggctacgacatcttcgccacctacggctccccgattccgccctcccccaccacctgctaccccgtctcctccgctgctcctacggccccgccgcctaagccgtcgcctactccgcctccggcttctccaccgcctgcgcccactcccccgcaaacgcggccgccttctccgccgccgcagcagcagcagcctcggccggtttcgccgccgcccgtggcggagccgtactactggcccaagccctacgactacggggatgcgccgcgcgagcagccggcgtacgccacgccggaggtcttccggggctggcccttcttcgcgggggcgcgctgccactcgcggtgcggcggccgcgactactggaggcagttcatgcgggggctggattacctcttcggccacgccgatggctacggggagcgccgtattggggtggactaccacggcgtccccgtctacgccaacaggaagggaggcgtcgaggaagccgtcgtcatacaagtggagccgccggccaccgggactgtagagtggcaccacgccgccgacgacccggagtacaactacaacaacggcaatgtgagcgaatacaccataccactcgggatttttcacttcacttctgacttgctattgttgttcacttgctacgtctgctgtcttgcatgttgagccagcgcttatcttgggatgacaatgccaaagatgaaacatatgcatatgtgcagcacaattacagttcgtatgatcgctcttatgatcagtcttacagtcttgatgccgtttccgatgaaactacttggtttcctaatcagaactaccagcacgtgtacaaagaggaggaatctcagtatcaggtactaattaacttatcactgatcaagaagaatgaggtcaattagtcgtcagcctgagtatttagctcaattgcgtgcaatagtactgtaatttagttatgtttgattcatttttctgagaatatgctagctaatcttgtcagtggacatatttgacatgtaaaatgacagaaaatggaacgaaaaggattgtttattttgagggagtcgctttctgtgactagacagtttaatcaatgacacattagcgttcgcgaaaaaaatcaatgatacattactcttgtgtagcattcaacagatcctgcctgctatcttcgcttctaatccctgcttaatattaaatttgcgtgcaggaaatcttgtccagctcttgtgcagaaagtaagatttcagctcagcctatttattgttacaaccagcagtttagtgaacaaccgctacatgttcttgttgagcccccagaaacagtttattctcagaagttggagtactatgaggtttgtctgtcatctacaaatgctgtttacagtgtcttcatttggtaattatgcatttgcttgttcaggttgagttcatcaatctcaagggagaacactttttttttatgtagtcttgtgattgtcaattaaataatttgtgcagagcttctcaacatacaaccaccataacagcaacgatgattcagatatgttgggacattcatatgacatacagctgcccgatgaacatgtgccagatgaaccatttgaaccaattaagccttcttgggctatgcattcgggatactatcagtcctgcacagatggggcatctgctgaattcgaaaatgtaagttaggtagttatttcaggaattatgttgtaaaaaaaatatccaactgagactatctttttcacatttgatgttataccgatatggtgataccttgctgcttcaagatcaaagtaattgtattattgaaattttcagtggaagctatcgttatcacatatgttgtgctactaataccttcctgaggcaatattattttttctttaaactccttgagtgctacattttatcggaccatgaacttttttattggactatagctacttatgttttcctttactaattcgttactttgacttgcagcatactttaagctccagtgaattcagtggtattgcaagcttatttgcaacttccttctaccctcaacaaacacaaatttatgagtgtcatggagatgagaatgtttccttgcagcaaaattggcagtgcaactggaatgtggtttctgaaaatgatttccaatcggtaagcgtaacggtgtctatgtctgtgaacgtgcttttttaataccctatactcttatttttatcgctccattttactcctatttgtgtactgttgaatgtgtgtcatggtcggtacacatgtagttgaagtgctaaggatggcgcacagggggcagaaccaagcggcagcagatagaccatcaatgcatttgccgcacctatcgtacctccttagttgtttgattcaatttgtttaggttgagatttgttaaactttttaggtttgttaggggctggctttatttaagagagcttggcattatctttgaaattaagagcaaattacaagtctactctctcatcccctgttctctctgcctctccccttttttggtgctgcctggtgccatctcattcaaccatgggtagtaagactgttaacctatctagctacttcccactcctatcttattagatcactccctaacgcccgaatatattatattgttcttggcctcatgggtggctgatgacgatcaatgaaaacttcagacatgtctgtgagtgatgctttttttccccttgcaaacgatagaattatgaattagtatctgttttcgttttggatgctgtaaatttaaaatgtctggacctttatagtatgtcccgtgtatcctttcacattcttctgaaatatttatttttgctatttaatatgcaatccatgacacaatttgttttgttgctcaagaatggccatcacatgatctcatttgctgaagttcaaaatggcactgcttggctgcgattttttgcggctgcagctgtgcataatgtctgtggctgtggcgcacagccgtggctactagcagcagacgcagccacaaaaatgacagccaaacaagcccaatatatctctttcagatttagttaatacttggttgctctttgttccatatattctgatgttagtgtaacttttatccacattcatgatctaccacacttgccagtgttagtagtaattgggatttacttgccaaaagaataattctcagactccagcagataagtgaggttaactctgtctttatggtatagttttcttaacaaatcagcaatctcagtacccttgctagacgattttaatgagtgttaatagtttggttgtttgtgctttgctggtattgttgctagatttcaactgaaacaatcttgtatggtgcccgcatcacatttttatggttgaaacatgagtgtgcaactgtgcatgcgatgtctccatgttgtcttttgaactgaaatatttctccatttttatttgcagggttacgattccaaccatatgaatggctccttctggccgtttggagatcattcagcataataccacatagtctatattgttgtaatttcactcttatcttttttatgtacatttcatttaaatttacccggccaaatgtaaatgaaaaaaatatatataagaggttatgcaccaatgtatctaggttcagcatataatgtaagatcattgacgctgttgttgaccataattacttctttttatagtgatatccagtttctttttaacctgagaccataccactattatttacattcaaccatacctctgaatatattatcatattcttgtattcctgagcctaagactgttttacccatttcaggttcctctaatctgcaccgcaattatttggcactacatgtttgacttgcttgaatatataagctgatacctactgttatgctgtttcagttttctttgagtcctggctgaaggaattagcgtattgcatttcagaaccaaatgagcttttcaggatcttcacagaacatagcttgctctgcgtatcatttgataattggtacattatggcattcctgtcctgttttagtttcttatgtcagttgaatcattatgattgatgagcgcctttttcccatcttccttacagcaagtcctactcagtataatcctttgtcagtagaacttttttttcccaatttatttcctttgtcgccaatttggacgggatgagcatatttggtttactactttagtttggttttcaagattatgcagatttgtgtgaacacaaatcctgggtatgatatctggtacaagttggctatctagaaactgtttgttcttaactcgtcaatcaatcataccagcactctatacagtactattttcaaggttttgtaccatcatgaaggcttgatcgtgaagcaacaaaaaaagggatttggaagtagacagctacgtcctgttgtaagctgtaacttatgaagacgacttcccttttccaagcacaatctaatgatagttatgctatctcttttggtatctgctaggcccataggttgctgctgtcaaataggagatctattgtcgttaactctagtgtttgttggttgctattttcaggtcaaatctttgcaactctcctggacctggcccaattaggtcctcctgtcagggccttcaacgggaacctggagagcgaggaaccaataataaaaatagaagttctaaagctacatatgacggtatgttgaagttctgaagtatattttgaacttaagactggaaaacatcagagcggctataggtcaaccaatagcactaactgatacacaggtccacttgttttccatactatcttatgcttgtttagtggatgataatcaaacaaacaagccttttcttccctctacagttttagctgccataatatattttacatttcaaagctttgctactgattgttccctgctcttgtgaaggtgtatcgaagggtaacatctttctcctgtaattaaatctgctataatagcaggcccactcattggagatagatatgtttttgattcccactttcttttcttgaatcatgatcttttaaataagattaccttacccctgggaaaaagcaaagacaggccatagaaaacagaaagataccgaatggatcttaaggccatcatagctctctgctttctcatgtcacctagttgagtccctgtagttgccagaacttgtttgtaaacagttgaagaatgattgccttttacattactacgtatatatctgtaccttttttttttcctttacaactgccagtaaaaaaagtgtcaaaaaagttgggtcgaacacaaacagctgtcccgatccttcaatccttttagcaggtattagtgctactgttaagcaaatattaactaccgccgtttaggtagtgatgcagaataatgttttaatacctgaaaccatttaaggtggttgctagttctacccggtagatatgtggagtaaacattatacctgactacctgagtgcagttgaaaacaagtgacttccacaaagggtaaccccttttgtttgtgcacctcaacttacagcaagtttagccagttagtaggaatctgggagaagtccttatcagacctaaaatgcatgccagcatggaactaaagtgtagagaaagtaaatgcatagcgtattatgatcctttatttccttcctctttgatgcaccaaatagctgcgaatctatgataagacgtttcttagtagtgctagtggtgtaaacatacaattcgtttaagccttgttaagtttgactgttttttataatgaccatccacacaaaattaccattcaaaaattggaaggttgttttctatatgtaagttgttatagaatttcttgtgatggcttctttcccttgctaaatgaacaatatcactatcacagtaagttatctattttttctatgcaatataagtaccaacaaactcatttgacaggctttaataatcagtgtgtacaggtctaaagtggattatatttggaatcgtattgagtatgcaccatctatgcttgtttgcctacttgtttctgctgtagttttagttttggtgcatggagacaaggacgagaagcatttgttattgtgaacacgtaggcccatatgatctcatgattctgatcagatcccactattaattacttagtgtattattgaaaagggaagggcaaagagggagtcagatttataatttatacaggtggactaaagttgtcgtttgaatggagagaaggccaaagctaatgatatccctattctctaatccaaactgtaatgtgtattgtgtaggcaacgaggaatggtgacatctacagctcgacctgagccaccacagcgacctacctgcgtttggcagaatggcaggtatgtttccccccttgcccttttatccgtgtttgcttctcacctcctgacaataaaattcaaacaaatccgacaagttctttggtggttgcttatgcaaaaaagcatataatctcagcatatctgtcatagtctcatagaattgagccgtgatatagatttctagcttccatgtagcttcctcaagatattgcgatcttgtgaagatggcatgtagcatagcagtagtgattctagtgtaatcggcgagatatctccactgtggagtggtctcttcccgaaaatttcgctgtgtccagcaagggtccaattggtacccacatgggtgggatccggggtgggggggttttggttactatttgctcccatctcctgctgttgtctagtgacctgaactgacccacaaacacacaagaccatgaaaagttttcttgctctgtagtatgtactctgtactggtgtagtgccttgcaaatccatgctgaacaaaaaacaccgtgccgcgcccatgccccatcctttgcagacccatagccagcctgcccaggtctctctgttggactcacttgagctgcctctgcctgaccctgagacatgcagtccggttgcaatgcaaattctgaccggcgaacagcgaccacgagacggtgatgttgaagggaatcaaaatcgatcagcaacatatgcatgtgggtgttgttccatttcgcttttggatgtactccccagtatagtggtacgtacaagagtgacatcaaaccactgtttcccctcacgggttcatatgagttacctgttggggctgtacactggaggggcactgtcaattcaaaatcctagcatggacattgccaatttactacgagttctatgtggttgtccccatgctaccgcatcaatcgcccaatcaattacccaaaacccaagattggacagtaggttgccgcacactagcctccctgcatatgcaaccagggtagtgtctgttgtatttgcgcaccaaagtacggcataatgtatccgcacaattattagcttttctttatttttatcgtgtgctaagattcctttggattgattggatgaatttcatacgatttatgtcggattggaattcttgggaaattttatgtcctttggaacaaagaaataggatgccagaattcctatagattggcctcatatgaccctaattccataggaaaataaacatgagctcaaacatcatgtttctatctttctttgacaagtcccatgcacccggtctctctagtttctctctgtcattaatttacttcctctcttccagaataaataaacctagaatatgatgtaaaattacctagtaaatctgaataagagcacctatccagattggccatagtaatgtacagtattattctagtatagttggtttatttttggacggagggatatatgtttacttcctacttcgtccgtaaaaaaatcaattttttgaggaataatggacaaacatagttcgttattagaaagttctattttccgaagggtgtagggaacggacgaactgagccatcgtttcacttaattgcgaaataagcgaaacggcatatttgcaaatgaaaagtaatttgtgaataaaacttttataaacgtgttcttagcgatctaaaagtaaatgctgaaaaataaacttcgttgaaaaaaatctcaaaatcaactctaaatttaaggttgaaaatttaaattttgattgataagcataaacataagcgaaaaaataggcccttcaaacacccactatcatcgttcctgtgttttggaatccgattcatgtttatttttctgatcctgcattccaaaaaggttggtgacctgctgaggtaggtaatggggaaaataataaatgctggtgatggcaacggggttactcttaccaataagatcgctcacaaaaatgtcgcatcagggagaacaaagcacccaaggtacaacactgttgtatcagcatcaattatcaacccatcgatgccagataagctcctagattagggacctgcctacttgatcaaggaagggagcgcatcagcaaagggcatcaatcataattagtactgaaacaaatgttcctggctaatctcttgacagcgtccaggtcgtcatgagtggtcttgagctgatcggttggggttcgccatgttacccatcgcattcactgtcacgtaaaaatcgatcagtgcaccccacacagcattcattgggggggggggggggggggggctcccgtgcgctgctgtaccttttaatgtctgatgtttgcagacagtggcttgtcagccttcgctcgagcgctagtggttgttgatctgggcaacagacattgccactgcacctcccaccaagtagtttcgaaatcccctcagattattattgataggcacttaagtttacctaatccttccttaattggcatctaacatcttttttgctgtggccaattcccataaagtccctttgcctactgtacgtgtaactcaaaaacaattttaggctctgttggtctgcagtaggtccacaaaaatcaaataattaattccacatctataggagtattatgttaaatattttgccctctctactatgaccaccacccaagtttacaaaactgaacaatttatattttcttcagttactaaaaccaatttaaataccctccagccgtaagaacttttcctgaatcatacagaacaattaaattcatatgaaattgatatatgtgcctaaaggggcatgagaacttctcttacactatattggttttgtataggatggagggagtacatgacactttgtaacgaaagaatgaccctgttatacttctaaggtacagtatattcgtggcgttatacttctaagttatattcgtggcttcaactagggcaattccaaggcctggtgatgtagggatcagttttgttagtgagccgcactacagtgaatggctacgtgactgatttcttggctacatagaaattgatcggtagagccgtagagatggctgcgtctacctagcacatgagccgcagcatagctttgttgctgcagagcagtcacgggcagctgaaacgtgcaggcctagtgatcaagcgcatcatcggctcgttctcgctttttaaactgccaaataatttctatataaaaattattctaaaatattaaatatattcaattttttaaatttgtaataattaaatttcttattttgcgtgtcttaattttaatcttcagtatggctccattcttttgtgattaagttgtatattttatctcgatttttggtaacatgtttttcaagctgttaaagggtgcatatgaaaactttctatacaaaagttgttttaaaatatcaaataaatttatttttcaatttgtaataattaaaacttaattaattatgagctaatagttttcttgttttttgcaccctaacttcattttatcttctatagagacgaacacaaccttatattatattaaaggggatacatgaaactatcccgttcggacgggatgatcccttagagcttaaagatattacatgataactggatattagccattacctattaagtatcaagagataccttagaggtatcatattgtccgaacgagtatcagccaatatctatcaggtgtgaagcgatacctcgtagatatcactccatctgaatgggataccatattgtagcatttccctacattataccactttacacatgttttcgcacatgctagctgaagaaaatattcggatcttatgtttggctctaactatgttgaaagttcactatcgatattcctcttttttcgctatggaacacagaaataacacaatatccgtgcttttaaaaatcgtactaggagttgaggcactgatagctccaataatcgccaagaactcgtcaacgaagaacagaggggggggggggggggacaggcagaggcagaggaggaactgcaaggcaggcgtgggcaatttacttttgatgattgcgcatctgacaagagtgtgcaaggacaggcactgacatgaggcacatggtgctgaatcagtgatgaggggcagccatgttgcagctgtccattgggtgcactctggtggcccccattcctttcgggtctggttctttttgttaacccgactccttcaaaatgtactcctactactccctactttttcatcagttttgtcacataaataaaaagcccaaaacccgaacgacaattcacgcctccgtctccgttgtttcgatggcagtttagcagctgccgacgacgtcggccggagcggaggaggaggaggtgtttgaacccaacacaccgccgtgcggccgcgtcaaaaatgtgtgctgccgccgcagcatgtgcagctacaattgcatcgccgcgtttgcgtatcgtatcgtatcatcaccggccttgtcgtgtgtccccctttgtatgagctgttgtggtccgtccggtcctatgtttgacaaacaaaacatgccagcagtaaaaaaaaaaagtacgtacacacaaactagtcacgtactgtacgcactcctactgcagtactgcactagcacaacaaagtagcaaacagtggtagctagatcaagcgagtgactttggcttgtttgatcaacttaaaattatgagaaactgacggccattttggattagtatatatgacggttttgttttgaagccaaatcattggcattgccaatatccaatttgatattttctatattctactcaatgcttggttctaacttctaaattggcctccaaccaaggccgtgtttatggggtgtttgggagagaggggctaaactttagttcacccccaactactctaaacttccaactttccatcatatcacatccaaaactttcctacacaaataaactttcaacttttttttctaaacttccagctttccccaaactttcaacttttttcagaaactaaacacagcccaaatacaactctaccctaccaaaatgttggtagtaccaaaacttgccaacattttggtaaggtattgaatcaaacaagccctgagaaacatgtagttgttacagttttttagtttctgacttatagtttattttttgaattgtaaaaccacagtttctcttgatccgaaaaatttatatacaatttggaggagtttctgagcttgggaaaagttagaaatatcagaaacttcctcaaacatattcagggactctctgcaattgtttgttttacactttcaccgttccttttggtgtgtagcagtagaagaacgggaggcaataatgtaggcaaatgtcgggtgtcttggtacgtaccctagctagcttgggtggtgcgggcactgcagtgggccaaacttttttttttttgtgtgtgtggcgtcccggttccagcgcagcagtcctgaccgagacatttgtctccaccagtgacaaatccgtcgtgtcatctcatgggggagctcacacacaaagactacgctacgccacaaatattgtctactccttccgatcgatcttttccatgcaaacgatgataccatgcactccttccgttctaaaatactatctcaagttttagaagtatactacatccctcctaaaatactttgttctaaaatgaagctatttttctatctaccttctcctctcaaccaatcacaaccattttttttcatctactttctcttttcaaccaatcacacacttttttcaatcattttcacctactttcttaatacccgtgccaacctcaaaaatgcttacattttgggacagaggaagtatatgagatcaacataatgctaaaaaaaatgattggttaagatgaaaagattcatggagaagtgaattgtaagagatggttatgattgcttgagataaagtaaatatgcaaagatttaagttgtcatatttttatataaaatttaaatgctgaaaaaatttatatcttagaacgaattgagtaaggttgtgttcgttttagagtttagggtgacaatgtcttgttttccattagtgttgctttctaaactgttaagcgatgtatttttatgctactatatataaattttatttatccaataaacatttttaagtctattataattaattaatcataagctaatggcttgtgtcatgaagttttcacctccatacgcccaaacaaattcagcctgagtaggaaaatttttttagaaatgaacttgtgccaattaccttcccgtacatagcactatagctacaatacttttttaaagagagagagagagagagagagagagagagagagagcatagcagcaatacggagcagtagttttctaggtgtgtactgtatgcctttgagacttaaaaaatttccagcaaagagaagtgcacagtgtaaacttgatgcatgtgttgctttgtccgtaatgattgatgcgcatttcacggcaaatttgagcaatctaagattgatcatgccccccccccccccagtaggttaagatactgtttagcatcttaaatgcagacaaaatggacaagatatcagctgtggacaaatgaactactcctagatcaaaaaagtgctgggcaatgaaggctagtcgtgctaatttcggctagtaaagtttatcagtacaagtagctgctacctaaggtcttatctttcggctcaataagcagttgagattgcaagtggatcatcacttcactagtaggagtatctttttttgaactatatattgatggatcacttcattatcaaattaagctgatcaaacctccttctatatatgcatagtacactagtaattaattagagagatcaggatactactctattaaagtttgcttatttactcagtatccgtgatttggttgggaggcaacgagcttataggagatctctcatgtatgcaagcatttggcgatctcatatataataatgcatcccaattaatacatccacacacagaatgtttcattttctgtcaacgaaagcatgcaggtacgtaagtaccctagctaactcaacttctttgttagtcattatcgttaagctcatcccccggataatcatgatgattttaaggccgcaagcaacataagcattgagtacgtatacgtggttgctaggactaggagtactctatcacatgcaaacccaacataagccgccctgtgtttgttgcaacgcgtttgatcgagcacacaactggagtagtagtaattaattaattagtgctggatgtggcaaattaaatgtgcgtgatgaatggcttgttaatgacgatgtctcacccagagagaccggcaacttaatgagcccagtgactttataacatcactgcccgtacaacacacattactctgtcataggcttataaattgttggatgtggatggatatattggatccggtctgaagcaaacgaaacacattacacggccggggcagcatccagccactacgggggtgtttaaatgcatgtgtgtaaagttttaacatgtcacatcggatattatatagggtgttgtatggagtgtttggacactaataaaaaaaactaattacataatccatcagtaaaccacgagacgaatttattaagcctaattaatccgtcattagcaaatatttattgtagcaccatattatcaaatcgtggagcgattaggcttaaaagattcgtctcgcaaattagtcgcaatctgtgtaattagttattttttagcttatatttaatatttcatacaggtgttcaaacattcgatgtgataggatgtaaaattttgaggtgagatctaaacaggccctacattgcatttgcatctgcatccatgcacatcatatattcgacattgcgatatgagaaaagctttagatttcgtcgcacatacgatgctatggttttatcagtcacgggcgcaagtgaatcagttgtagctagtagcttagctaggttggttgttgcacaggctgcagctgctttgttgcgtgcaacctggtggaccatgctagctagtgtgcatataatgcaatacaaccagcaacagatgcaaggctccaacgttgcattgctgcatgtatgtatgtatggacggtacgtgggcctgtcacatcggcagcatgcgtgcaatgtacaccggcaaccagccggcaatggcacgtccggttgggatgcacgctcacgcccgcaaaacctccttttcttttctcccaattacacgaaaggcacatagtacacgtgcataaaacatacccgtaaatgtgtacttttaatgaataatgtttggttaagacccgctaaaataatgattttcgcatgtgactctcttaagagacctgtctatgaaaataaatctattttcacagatagacctcttaataaacatgcctaacacaaggctcgtcctcactccctcttattttctcttctcacctatctctttaaaaaacctccttactctactcggccactcccctctctccctcttatcctctcctcacccaaggccgacgggagcggtggcacctagggcagtgacggcgggcggatctgaccccagcagacggagagacaacaacaatggctcctccgctgctccctcttcctctccctctccctctcactctccctctctcttactctctccttcgcccctcatcatctttgtctctcaaactctataggctggcagaacacaaaatttgacaatttgaccctttccgaaatctaatttcgcaaatgaaacgtggccaaaacttatttcaaaaatgactcttttgttcaacaccaaatggtacagtgctaaaccatacgatttggcgctaaacaaaagggtcgtttttcaaataagttttggccgcggttcatttgtaaaattagttttcaaaaagggtcaaatagtcaaatttaatgctggcagaagcacttgaggatagcagcgggtccagcggtgcgtgaggaggtcggcaaaagaggcgcacgttgacggcggcaatgatgtgcatcgacattactagcggtgttgcctccttggggcatctccaccgcctcaggagtgcccaaccccctcacggatccatcactgtcagtctcgagtgcagcagggtctcgacaacaatgacggcggctgagatggtttgagctagagttttgactttttgaattttcaaaaatgtactctcatatagtcatgtatatcataaattgaactctgattggtaaatttgtggacacactattgaccattacaccatcggtattttcccgacctcttgtttcattgatagcaaaatttgctaaggacatctaaactttgtgtaattggctggaagacattgcaaaatcgcatatctgctaatggacaccataaaatttgtatacttgactgtaggacaccgaggcaatattttatcaaatttagacataaagagttgaaattttaaaaagacaaaattacccttagcctgattgaaccatcgcaaccccgaaccctatacccacatgcaccctaccctaatccccatccaaagaccctaaccctaggcgacggcggtggcagcgagagctggcaagcagtgctgggaagcaggtgatggtcctgatggaactgaagtggatagggctgagggtaattttatcgttttaagacttctctcccctagttttgccaaaaatgataaagtattatctcgggtgtcctacaaccattacataaattttgtggtgtccatcaggcatcagcagcgacatgattttgtagtgtccctcagtaaattacataaattttgaatttcatgaagcaatgtactaccaactaggagttgtagtcttatggacaaaattctgtgcttaatcggctataaattaaacatgtgtactgcttgaagctttgtatccaagcagtactggatggatgaatgtcaaacaaaattctggcgggaatcgaactgaattgttgtaatcactggtacaagtactagtactaaaactaaagcagcgaccgtatgatgatgagtcgccgtccatttgatagcaacacgaccaacaagttgcgttgtagctagcccgcgtcaggtcgtggcatatccatccatccattcatctagctacacaactatacaattctagccatccatctgtccttctccccatctggcctttcaattagtcctctctcttgtcgtctgcgtctcctccaaattatatatcttgtcgacaaattggcacttagcaattaggccctctttagttaccaaaacaaaaaaatttcacccatcacatcgaatgttcggatatatgtatggactattaaatatagaaaaaaaaccaattacacagtttacgtgtaaattgcgagacaaatcttttaagtctaattgcgccatgatttgacaacgtggtggtacagtaaatatttgctaatgatagattaattaggcttaataaattcgtctcgtagttttctggcggaatctgtaatttattttgttattagacaacgtttaatactttaaatgtgtgtccgtatattcgatgtgacacctcaaaataaatttttttccatctaaactgggccttagcaacaaccatgctctcatcacttaattacgagctagctatagccaagaaccaaacagcagttcacacccatgattggcacaattaatttactactaatcataataattaatactcctagctatactaatcattcatcccatgcatgcatcactgagcttgcatacgtaccagcagctgcatcagcaggaagaggaggagatcgagctggatcatccgttgtcgctctcgaacagagaacgtcgcaacagtgacaggttcttgattaatctatctattataaaataagcatgcaaaaggaggaatcaatcggcagatatgtatgtgtagaatctagcatcgacataacgattggaggatttgtctgagccactcttttgggtccatgaccatggtgaatcacctaatcaaccccacttgtgggatcatttgtgtttgtatatctaaacaaggttctcggaacagaattgttgcatcaatcatatgctcctgtccatctaactactgactatatacaactgcagatatatttactaactttccaagtggattcgaccagccaattcatgaatttggaatggggaagagcaattctaacttctcatgctgccattccgcaggataaatcatgtcgggcatatctatttgtcagacatcttaagctcggtttccctcaacataattctactttgccaacggataattattatagtgtcctatcatattgacataatttcatttatcaagagtaattaattaggatatctatttcatgttttacccatattaaatatctttgaaatctctcactttggaaactacacaagcagttcccattcttttctgactaacatacatattttaccttggtttcatcagcacgttttttaaattgctaaacggtatatttcattcggaaactttttctttaaaatattagataaatcctcttttggattggtaataattaaaattcagttaattatgcagtaataatgttttttttattttccgtgccttaacttcaacttcattttcaatagaaacgaaccccactttacaaggggtaaactcgcctaaaaacgtacactaatctcgaacggcataatgcttcccggaaaaaaaaacataccctgactattccagtgatactgaatcttacagtttgctgtttgccaacctgaatagcgaacctcctgaagccaaatatccttgagagatccgtgcaaatgattcgccagttgggttactgcacccccttcttggtcacctcaccatcatttttaaggccgtgtaaccgtgttcgttgaagttggaaactaacccctcgcatgcatatataatacagagcgatttattagcatatactccccccgtcccataatataagagattttgagttttttcttataacgtttgaccactcgtcttattcaaaaaattttgaaattattatttattttatttgtgacttactttattatctatgttactttaagcccaacttttcgttttttatatttgcaaaataaatttgaataagacgaatggtcaacgttacaagcaaaaactcaaaatccattatattgtgggacggagggagtaattaattaaatattagcttgagtattttttaaatatattgatatgattttttaaaacaactttcgtatagattattttttaaaaaaaatgtaccctcgtagtttcgaaagcatgtgcgtgcgtaaaacataggatggagttgggaaagtcaataaacgaactcagtataaaagctttaccccatgaaaaaagaaagagtagtaaactagtaataaggcaccaccagtgcaactacttctcgcagctaataggtagccaaatctttatgtatggtgcaaagcctagataagccctttccatttcctaaaagaaagcctacagaagctttgaatcccaaatgttagatggatctggtcaaccggaaactaagtgacaattaaattaacagcgaccaaaccaaatcggagcacgatcaaattaacagcagtaatggtccccaggcaattggtgccgaccagagcagtgttctcacggcgccaaaaaggctaattcgatttaaaaaaaaacatgcatagtagtagaagggctcggcgtaagtgagtgaggaatatttggttgccagcaacgcttttttaggctgtgttcgacacccctcgttcccgaccctctctccctcgttttttcacgcgcacgtttttcaaactgctaaactgtgtgtttttttaaaaaagtttctatacgaaagttattttaaaaaaaatcaaattaatcaatttttgaaaaaaaataactaatacttaattaatcacgtgctaatggatcactctgttttccgtgcggagggaatgagttcccatcaggacatgcgaacgcagccctagtagtataagattagaccagtctgattaacttaaataaatactatttcctccgttttacaatgtaagattttcttgcattggtagattcattaatatatatgtgtgtgttttttcattaatatctatataaatgtgagcaatgttagaaaattttacattataaaacgaatggagtagctactatatggttgtagctaaagttatagctagcttccctcttagtagtaataaattaggttctatactcaatgaagagaatggcaaaatcctcttaaaagggtagtaaggactttgatcatatacttctcgctcccaaaaatacttcatttttaatctcacacatatagatataaagctgaaaagactgtaatactgtgcacttttaacaaatttaaatgtattaattactctaaaagatactccctccgtcctaaaataagtgcagttttggactattcaccttcaacgtttgaccattcgtcttatttaaaatttttttatgattagtatttttattgctattagatgataaaatatgaatagtattttatgtgtgattaaatatttttaaatttttcacaaatttttcaaataaaacggacagtcaaacgttgggcacggatatccacagctgcacttattttgggacggaggtagtaaagtcttcgtgggacaagtgcgatagacttaaaaaaaagtaggctgtgtttagttggattcaaagtttgaattttagttgaaattggagatgatgtgactgaaaagttgtgtgtatgacaggttgatgtgatggaaaagtactgaagtttggatctaaactttggatctaaacacagccgtattgttgcgagggaggtagtggcattaagcaagtacggtaaattttgtttgcagataaccttctgtaccataaaaaaaagaaccagagatttttacccttctctaaaaagaagtgtctctatttagagatttctctacttagatgaataaatcatactctcttcgtctctgagtatttgatagtagttagttcgtcttttaacaaatcaacgtcaaatagaaaaaaccaaaggtaatatgctagcagcaaatagtggctgacaaccatatagtcgtagaatatgcgtgtacaacatggtctcttgcaaggtagagtagctacagtgatggttgccggtgcagttgctttcagttgagcaagtgggtaggagccgtagtagtagttaggtgaatctgatgtgctaaaattttggggaattgaagattgtggcaaatggcaatggacatggcaatggcaaaattatggcaagtgaggaggaggaggaggcagtgctaccctgtgctcccttgtgttgctccaaaacaccgtcctttgcagtagcccaggctccttaactgcagcatctattacttcattacacaaccatcttgcacgtgtcctgtccatcctctgcatatgctccatgtcctacagcaacaagagatactacatactgggtgtatccagcactaagatttccattttatttttaccacagtgctatcttcagtatctccccaattctaaattaacacatatatctattcagattgatatatcaaatcttatattaaagttgtttattttaaggcgaatggacttgtacataggagtaaaatcctagagattttttttgggtcagaatcaagtgtatgttttcggtacaaacacaaacctgcattatgatccatcatacaggtcatgatggaagttgtgcagccatgcatccgtgcgaaacaaaacaatccgggagattgttgttgttttcggggaaatttggtggtcgttttcgaacagtaggctgatttgaaggaagaaacggggagaggaaaggtggtggtgagctggactgaaatcagcagcggtggtgactgcaaccggccaagcaggacgacgttgctgctgctgttggagtcactcttggactgatacggcggccacaggagggaccacgcagttggtgacgacaagggatccggagaactcgcttcctccatgtgactatccatccatcattcgaactgggaggagcaaacttttctgcctgccttgatgaaagctcctcccctccacaatttctcaatctccccggaaacaaatcccctgtaggatttctgaaaattctatatgatccatagtagaaattcgatttcgatcaggtgtttgggaaccaaggattataaaaaaacaaaaaaaacgatgagaaccgctttttttttctggttttcgttgacttcgttgtggatcgagctgacaaaccagttggtaaatcttttcaatttttaaaaaat

SEQ ID NO: 19669 - DNA, 48763 bp, Oryza sativa
  unsure (1)..(48763): unsure at all n locations
ttgcgaaccatgtgtgagactcgtttgagtttcaaaaatttttatggaattaccatgctccggtctaaggtcatgttcatttttttttcttattgattattgcatgcacgcttcctaatggtattgtggccgagtttagttccaaaatttttctttaaactttcaattttttcatcacatcgaaacgtcacatcgttccaatttcaaccaaacttccaattttgacgtgaactaaacacaccctatatttccttgctaaaaatttcttcattggtatatattaggtgatgccctgcgctttgctgcaaatatatgttatataatgaagaaatgatgaaatgatttgaattgaaatattttaaaaatgatttgagaatgatgatttatcatgtatatgtttagttttagaaagaaataaattatggatataattactatatacttgcatgttaagctttgtgtgttttaatgggttgatgtgatatgcttgtatgtaggttttaggagtggtaataaataccatatttgcatgtttatcggtcattagtgtacattagttttatagaaagaagagatttcgtagaaaactttttaaaattaacttcttcactttttaaatatttaattcattctggttcaagtgtggaattatactacttcacttagagcaggtacaatagcagactataagccaactataaacatattttaaggagataaaagataagagataagagcagcatgctaaagatttgtagccagatgcagcacggacttcaagatacacgtgtatgacaggtgggaccaaacattaattatttagagcaagtttaatagtatagccaactaattacatactacactattaatacctggtcccatctgtcatacacatactgtgtcttggagtccgtgctatagctggctacaaatctgtagcccgctgatattctctctcttcatttatctccttaaaatatatttgcagctggcttatagcctgctattgtacctgctcttataagtaactattgtatgaattgtctattaaattgactatatgtgatttggagcaaataattagctatactattaaacttgatcttaggattctggtcagaatgggattaaatcctgcgaactgttggtgaaatttcgacgaccgagacaacatatgcccaatgataccgtattgatttgttttgtctgttccatgcattggttaggctaattctcacgctaagtggctatagtacccccgcactacagtacagtgattactggtcatgttcaaaactcaaaagaaacatgttggtagagtgaatctgaacaagacgacaaatgatcctatctctcatcagttccattgtataggagtcgtagtagcaggagtattcaacatttctacggacgctctcgccagcacaaaattgaatcagacaagcagtatactatgtgctaagagcaagtttaatagtgtagtctactactagctctaaattatctatagccaatgtaatagtcaattcatacaatagttgcttatgatagtattaatatctggtcccacctatcatacacatattacgtcttggagtctgtgctgcagctggttacagatctgtagcccgctgttcttttctttcttttttttatttctttaaaatatgtttatagcttacttatagtctgttattgtacctgctccgatgacacaagcagttaacagtgagaccgctccgaatgtccgacattctgacgaagaagatgttactactagtcctgattcagagtttttcaccgccaaaacagggaggtaaatgcatgttgactcgtcggtcagggtaaagcccgtacgcttaggaaacgagtcaagggattcttgatgacagtgagaggttaaaacccaagagtacttccattagctatgctagtaattactgctacctgccgtgccgatggagcatccgggtggtgttaaattggattcttccgtttggtggagacgaaaacgatttgggagagaattcgtatggaaaatcttctatactagtatacgaggtactagtactacagtacgtagaagcagaagctgaggaagtgaagtggagtagtactcgtacagtaggcaagaacaaagctgcgactgctgcggctgaaaacgacggtgcaacaaaagcgagcgaaaggcgaaaggcgagcaatctgtagtatctgctgtgtgtggcctctgtattatctgtcgcttccgttccgtcatgccaaatttgccatggtagattggtagtagcaaacctgcagccttcgctcgcacaaacacacgcaccatggcatggcatgccatgcaaaggcgcacgcacaggcacgcgcgtgcgcacacaaaagtcggtggaacgccaaaagatgagccaaaagctaaccgggttgataaaaagtccaccagttgcatcaacgtggtacccgaccttgtttatttactacctttccccatctagtctaatctaaccttacttagttactccttcagttttaaagtataactatttttatatagcttaaaatcttatattctaaagtagagtaattagtaaacacataataaaatatagacacatatcctctttcatcaaactagttatcgttatctatttttcatgaccgacaccaaatacctagagtttgggttaggccattcacgacggcctctcccttctcaccttagacatcaatgtggcgtccctctctagcacagatcggggagacaggccgatgagcttagcggcgtggagaggagaacgacaagcttgctggctagggttcgagcgggtgcggcaactactctctccaatgatgaccgttgtagcctcgcatggggtgtagagttgaggcgttgcacaaggccatgaaagcgcatggccacgacccccacagcgtggccgcgctattctcactcatgccgcacgatagcttttctgacaaagagcgtgtgcccagtttaggttacaaatctcgttcggccccactccgagccaagctgctagagaatcttctattatcatgggttgatcgaatgccacatatgtgcactgaccttatagtttgcgcaagtgatgatgggaagaaatgtggcattatagattagtagattagtagaaaaaggatgtgccttggatcaatggaggcaacaagaaagttagcaacaaacagttgatgagacaattagaaacagattaacatggtgcagagacgatgataaccgattgatggttattcttccaaggccatcaatacaatgttgcgacatggaaaaaaaggaggggagcatgaaaatcatgcgatttgaagatcaaattataaactgttatggtttgatgtaggagcgttgttgaaaaataagggatagtacctagtgtgcgggtggcgtaatagagattgagagctaggataatgattaaatgatgaataataaggtaaggtggaaattgtaaaaatgtacacatgtttatttaagtgttacaggttcacccaataggatagccacacattaaaaatcaggatattgaatccggtacatcttaaatctacatgagcaacatccaaaagataggagtatgctcataggccttcatagagaagagctaacctcacactcatcattgctcttctcctcgaccattgaggtcagtgagctacgatgtgataatcacgaattgagatcgcatgattaagaaataggataatgtcataatcaggagatcgtcgggagaatgacggtgacacgggcataaggcggctctggtacgacaacagattatatcagtttttcttcatgtaagcttacaccatatcttatgttctcgtggtttgatactatgcaatcgtctttcttttctattcagattcattgttaaacgagtagctgctatatttcgggagcaagagaacaatagtactgaagtactacagctcccatcgaatggcatattcactcaaagaaaaagctaatttaaattttcaaacttaattttgacattaattttgagatatttttaacgtagtttttttttcagtattagcttttaagtcaccaagaacacatatataaaagttttatttattctctaataagcttagcttattagaaaaaagccaaacgataaggccctacatgaattgatcacaatagacgccctggccttgctgaaatggtaatgtcacctgctgtggttgacgtggcaactgcgtatcatgcatgtaaagccgatttactcgagggagggaaatggaaatggaaatagagtgccctgatcacaaagacagcagcgtcgtccacccaacaacaaagaaacaaaacaggtggggccccacccgtgcagtgggtccctggggaaagtgatgtcgaaattatcccccgtcatttgtttattggatttgtgcatgataggacgcgcttctgtggcgacggaccgaaagcgaccgtgtttgtttgacagggaaatcagacgcagccattgcattttttgcaattcctcccccctcaacccacaccacccctgcataattccaattccaaccggatcatatgcacttcctaatccctcattagtagtactaaactcaaactcgcgtgaagagttgagatggattatgctttccttctttttttcttttgtctgaaatctgaatgaactctctcttctgatcgccatctcgtatccactgtagcagttcatttttcagagagacacccatctacagttaaaaaaatggtgagacaaggccattcttacggggaaacccgcagtttgaaggcataaaaaaagagaggcaaatggcgtcgcagcgtgtgaaacagtatccctggggacagagacggggtttaagataatccaacctcatgtcgataaatatgatttctcatggggaagtgtgccatcttatcgtgaaaggccctcatctcatctcgctgcagcggccctgcggtttttttgcagcagcagcggcagcgcagtgggcagaaaggacaaagaggaacgggacggtggctgctgcagcctcgagaaacgctcccctcacctcgtgtgggtccctcccggtcagcaccccatattacggccgtgtcactcatcaccaaaaagctcaaaatcatgtatctgacgtgggatgtttgatcggacgtcggaagaagttttctacacgaatgaaaaaataatttcataactcttcttaaaaccgtgagatgaatttttttagcctaattaatacgtcattagcatatgtgagttactgtagcacttatggctaattatggactaattagacttaaaagattcgtctcgcaattttcatgtaaactatgtaattactttttatttttatctatatttaatacatatgtttttggaaaaaaaattgataactaaaccagactaattcccctattttgttacctcattattctcgtattccccttttattaccgtacggatcctcctgcagtagactggcgcaattaaatctccatcttcttgctcgtacaacgtaaatactcgtctcgtattccccttttattaccgtacggatcctcctgcagtagactggcgcaattaaatctccatcttcttgctcgtacaacgtaaatactcgtactactactgccagtgtacagtaagaggaagagagtgatggagctagaggctggagtgcactggagcggatcgagccgagctcagctggaggagctggagctggagctcgacatgtataaaaatggggtccacggagatccagatctatccaacgctccacgcacccatcctcctcacatcaggcagcaaaaacaaaagcaaaattacttacagcaaaaacaaaaaatttcaccaaaaacaccctgaaagaaggctcaaaattacaatgcaaaaacattttcgcgaaaaacaccctggagaaattgtggcatcacctgtcactcccccggccccaacaaaagcaaggggcaagccaagtaaagaaaggagtagtatagatcgatagggatgcagcgcactagtacgagtactacttctactacatagccatagcttagcttcttgttctagctcggctgcgagcgagctcttcttcctctgggggaaaatggagctcttcctctgctcttcactgcctcagtggcgccgctcccactgatctctctctcgtcttcttcttctttgagcttgctttgctgcacactctagtggtggtaatagaacacagctcagcagcagcagcggagcaagaagccaagaagccaagaagcaacgagtgttgtggtaaagaaagcggaggaggaggacgaagaagctcgattgcttgcttgctgtggagctcgccatggacgcctacgaggcgaccaaggtggtgttctcgcggatccaggcgctcgacccggaccacgcagccaagatcatgggcttcctcctcatccaggaccatggcgagaaggagatgatacgcctcgctttcggccccgaggcgctgctccacaccgtcatggccaaggccaggaaggagctcggcctcctcccggcgtccgggcccgggacgcccacctccgtggcggcggccgcggccgccgcccactcgcccttcatgctctcgcggcagaactccgggcgctgcggcaccgcgccctcgccgctctcggtgtcctccccctcctcgtgggcgcctcccccggtgttttcgaggaacaacagcatcagcaatggcgccggggaggagatggtcggcctcggcgacgagctcatcagcccggccaacggcgggggcccgccatcgcccttcttcggcggcgacccgctcatggacgagctccagctgcaggaccagctcgcgttcctcaacgagggcggcgtccccgcggggcaccagatgcccatgttcgacggcggcgagtgccggagccccggcggaggcgacggcggccttttctcctacaacctagggtgggcgaacggtggccccggacaccgccggagcgcgtcggtcagcgagctctgcctcggcggcgccgacggcctcggctggaagccgtgcctctactacgcgcgcggctactgcaagaacggcagcgcttgccggttcgtccacggcggcctccccgacgacgccgccggcaagatggacccctccgccgtggagcagcagtgtcaggacttcctcatccgctccaagtcccagcgcctcgccgccgccgccttcccctactcgcccaccggctcactccccggctcgccatccgcagccaccaagtgtttgagcttgctcctccagcagcagcagcagcagaacgagagccagaggtgccaactttttccacctccgagctcctcctggagtaccagtatccctttaacttagctccgattccgtcgatttgcagggcggcggcagcggcggcgctgatgctaggcggcgacgaggcgcacaagttcatggggcggccgcggctggagcgcgccgacttcgcgagcatgatgaaccccggctcgcgccagatttacctcaccttcccggcggatagcaccttccgcgaggaggacgtctccaactacttcaggtagtatactataatcccaccgcccaccgtcaccgccatgccatagctttaatctgatgatgccctctcaattgaagcatctacggccccgtccacgacgttcgcatcccgtaccagcagaagcgcatgttcggcttcgtcaccttcgtctacccggagacggtgaagctgattctcgccaagggcaacccgcacttcatctgcgacgcccgcgtgctcgtcaagccatacaaggagaagggcaaggtccccgacaagtacaggcaagccgagcttacttacagtccacattgcctctctaggttgatcccctataaccaatttgtaacttgctgttactttgcaggaagcagcaccagccgggcgagagggtggacttctccagctgcactactccaactggactcgatgccagagaccccttcgacatgcaccagctcggtgagcttttgcgatcatcttcttcatggtgattgggtgaatgattgttgctgaaatcgcatgagtctgtttgtaatggtgtcaggtgcgagaatgctgcagcactccaacagcgcgaatgagatgctgctgaggaggaagctggaggagcagcagcaggccgccgagctgcagcaggcgatcgagctccacagccgccgcctcatggggctgcagctgctagacttcaagtcgcgcgccgccgcggcgccgacccccattggcaatcctttcagcgcttctcagaccgccgccaacgcgaccggcgagtcgcctcccgattccggtaggacctggtgtatccgaccgaacgacgtttcacctgttgccgcgccagatgcagtgttgctaatgtttaccatggcggatttgcttgcttataggggagctcggtaagggaagcggcttccttcttgctcacaagaaggcggtcaacggagccgataaggaggaatccaccggagagtcctccagccctaacacagacagtgaccaaaggtggaattttgcgattaacatattgtctcatcgtcatcatttaatcatttgttattttcgccacacttagctttcgtccagcaatgcagacaagtaacatttcaccaaactgatcttttttcctctgcccattgtgcttgctctctttggcagtgtggagcataatctgccggacagcccgtttgcgtcgccgaccaagtccgcgggatttgctcgcgatcctttcgctcccactgaggcggagatctccgccaccgcgtcgactggttgtagcgccacctatgttggcatcaacaatggcgccagcaatggcggcactaaccatctcctaccttctgccttggacatgccctcaccaaaaccttatttcttccccatgtccaggtatgcatcataataatgtatggccccaagtgctattttagtattgcaaattagtacagtatgcatctgggcgccatgatttgctgagtgctatcattcattcatatgcatgcaggctggcctccgatcacggcgcgatcggaatgtaaagttgttctgaatggaagtgagtaatactactactgcctaatcctagtaagcacctcagtcctcttgcctttccacaaagtctatatcaagctctcaactccatgcttcctagtattgaatcatttgcttttcaccccccattggaatgatggtgccttactctcttttcctctgtccttgccatcacttgccccttgcaggaatactagcagcaaagaaaaagagaatagtggaatataggaaaagagtggagaagttgcagcatagtgttagtttcagtcacccccctttttttttactttccttttctttttcatttttcaagaagatagctttattaaaccataaagagaagaaagaggatgccctggcctccagaagagaagcagcagcagcagcatcaatcaagccaccaccaaccacaccaccaatgttttaaaatgcagtgccattcagataaaaatttagagcccctcctattactaccatatcatatcaccttagttaatcttagttactattaccacccaccgacccaccaccattgatgaattaccccccaaagctcttgataagctaccaccaaaatagccactagttttatagcattaggggtgatgtttagccacaagactagtactagtaccaaccacaagatacatgtaacactactactgcctgattgcagctgtgtgcaaggcagtgagtacagcagatatgtaatggacccaagaacaagtgacaggtttgagtgagagagagagagagagagaggaaggcttaattagctagtgtagtgtatgtaaaatcacaagaagatgaacaagtcagtcagtgtaggtgtgatgaaaggggaaggaccactcactgctgatgctgcaccattctgttgtgccaatgtggagatgtgtcagcgttggtgttcatggtccccctgatcagcaaatgcagtcccaatacaagaaaaaaaaaggaagtttctttttttcttttataatttcttcatggccttcgcctcataccatatgtatttctctgaatgagttgaatcactcacctgtcccaattgcgttgagattcaccttctccggcgacggtggccgcctccatggggcggtgctggtgccggggtgggggtcggatacggagaggaacggcggcggcggcgaggcttgagttgttcttgccgtcgccggcgccagcggtggcgcgggggtggggactgacggcgttagggcttgggtattgtttacctttgggagagtagagtattagagatcgtagggtaatccgagatttatgcggctggatgtttaatattaccactttagatttggtattatttaagaactgatgttttttttcttgctaattttcatttttagtactttgtccactgtagttgactgtcatagaaagaagaaagggaagataaaatttttagaaataggttagctttggtttttaccattatgatgccgcctaattttctactgctgcctccaaggtgagtaggactacatatatgttcccactctttctaaaagaagattcggtcgaaaatgggaattttaggagaataaataaatgggcatagtagctctgctagtggtaataacgcattattaaggataaagaagagggaaggcgtaaaagtggcacctttggtgacatgcttttggggatgctagtgccaacagccacccccagcgtcaacatccagtaataaaaaagaaatggacgtgaatacgacggtacaattaaaatactcccaagaaaaacccacacaaacaagttatcactccctcaatcccattttaacacagctataagtgttggtgtctaactttaatcatctatcttatttatttattttataaatcatctaataataataaaaatactaattattaaaaaaattaaaataagataaaacgatcaaaattagatatagaaacttatagggaagttctactacttctactcccattattgtgatctcctgtaaataaacttgttgcagcagcagtggtaggtttgctccctacattcgcagtgccaatcatcctatgaataaagcccaggtcaaagtagtaaaaaaaattaatccattcgcgttttcaccgcagcgccggtgtggtagatcgggaaaagggggtggggggaagcaagcgtgggtgtggggcccaggatgtcaggcgtgggtgacgcccacgtgtccgtgccgctgtgtgtgcgtgcatccgacaaggacgctacactgggccgggcccatttgctgccggatttccgcggagcacatcgtctcgtctcatcgcatcgcatcccatcccagatttgttgcagcagccagctacccgcccccagctactgcactgtacgtgtacggtgtacctgtacacgtagtaactttttccctttgtcctcttttcaatcagacgcatgcaatgcattgcacctactcctactcgctgtatagtagtatactacagtaatcactagtactagtaaaaaggccgtaacttttgggcgtgtccgctgttcggatgcacgtgaatgcttgcagaggggcgcatcatcgatccatctttcaattactagtgtggaccagtcaaacgagggcaatttgcaggtaatcaccctgccttaggctctgcttagagagcttctagctgaacagtttagtttttggttcacattatgagaagttgtagaagtagaataaaaaaataaactaaaagtttcagattatcagaagctaactaccaaccagctgcttttcagaatcttaaactccctaaacaaaccctaatcaattaacagattcagcacatcaggagagcagaccggctggatggtacgtatccgtggctttgcagtttgcaggagaaaggcacagtggcctttcctgaatggctgaatagtcaaagcatcgatgggcagcagacagggttggccacgcttgggctggttaattaatccaagcttttctctatcaatgaaatatttttaatgaaaatatatccgtccatttgcttggcaagtgtgcgtgtgcgtgccatgttgttgtgtggcacctcactggagggtacactacaggaggagtattttgatactagtactagtgtgtgtatgatacattggcaccgtggtcgagtcgagagagatggggctttgcatgtgctccccatgtgcccactgccctgtgcccatctccggtttgtccccctctcgctcaccctgattcaatactactacaagtattccttctttttttttaagacataagtgtgtacaagtattattgtttgtctatgtatagtacatctcgcatgcaatgtatacggatggatggatcgatcaaacacccctgttattagttgatttgtgaccatgcatgcgagatctaatccatggcgttgttattggccacagcggctgcatgctcatgtgtggcgacgtacgtactactcctacgtgatgaagctgccggcataaattttccggcgacaggacaggcaccagtacggagagcaacgtaagataactctgcatacgtgtgtgtatagatccacgtcaattagtcgcaatactaactacgtcctaaaatgtagctatttctagcacagtagtttgtcctaaaatgaagctatttttctacctaccttctcctgtcaacctatcacaatcattctttttcacctactttctcttttcaaccaatcacacaactttttcaatcattctcacctactttcttaatactcatgccaacctaaaaaatacttacattttgggacggaggaagtatatctcagtactatcattctatcgaaatgtcttgggtgatgaaaaattactccctccgtctcattttaagtgcaaccataattttccgcgctcaattttgatcactatttaattttttttatataattagtgtttttattgttataagatgataaaacaagaataataccttactcgtgacatatgtttttattttttattaaataagatgaacggttaaagttaagcatgaaaaactatacctacacttaaaaaaataggatggaggtacctagcatgcatttccagcagaatagacggatggacgatggatgtgctacgtccaacgcatagctgcgactacagctacagatggatggagactatgccgtcgctaccatctccgatggccagaaaacgaaagggatacggataattaattattcgagacgaggtatccaattttttcttggctttcttatcacccgagactaatccgatatttccctgcacaaaccagtggttcattattcggattacatctactactctatgctcttgcacggccaattcggtctctccccaatcagcaggctttcccatgtctgtctgtccagcaccaacaccaccaaagataaaaatcatcatctccacctgataaaagtgtggaacctctcaaagcaaaaaacacctgaaacctcaaggcctgtagcttgaggttttgatctaaacaggcccttagtgcatgcaaaagcagcattttttttcctcttttctgaatcttcacctgataaaaagtataaaaaacagagagagagagagagagagagagagagagagagagagagagagagagagggatattgggctcctgcttctgcgacaaaaacaaggcctgacataagccgccatggtagtattgtacaatcagatgtgtggtcttgatgatgattagtatatgatcgaattgtattcgtgcattcccccccacagacaatggcgaatttttgtcccagtccaattcttcccatatgaccaaaccagttgcatccccttgcactactgaaggatgcattttgtgagatttcttaaccttgaaaggcagcatgcagttaccagtactgttttccaaattcgagacaggctttcatcaatgaaggtggtagtactccagcacagtgatactactatattcgatcgaggaaagaaaatcttgtttgtttaggacataccagttgcaaatctgtctgtccctgcttgcttctgccgctcgcttcttgtttatcactccatctcccccccaactcgcccttggtacgtggttcgctgcaggtttccgaggtaagtaaaaattaacgagacgaaacaccatgcaagctactagccccgtgcgcacgggagaccgcgccgtcgtcttcttcgtctcggcgatcgatctgttcgtacgttcgttcgtggtcgtctgcaggttggtttccttcagacgcacggggacgagtttgttctctaccagtactactactagtagacagtctacttatactagcagtagtatatatcagctgtgtatttttagccgagttggggttggagtggtgtgtgtgtgtgtcggcgtttcttggcgggcgaggcgttgtttcttgctgtgtacggtttccatgtttgttttgagtatgttcatcgctaacgtaacgactttaattgctagctgctcctgtttttgcagcaaaccgatgcgatgcggatgcgaatgcgaatgcgaatgcgaatacgagtcgtctttaattcgttagttgatgcggatcgagctggattagttgttcacatgcatccccatttattagggctatctcccctaatataatcctctttgttaattttgagggacaatcacaatctctctggtcgaaactaatccagcgcggtgtgtagggctgatgaaatttgatgccagcccatgagattctccttgcgtgttcaggtccatcaacaggatatggcccaatctaagctgggtttaatgtttccttcctcgagaaacggatgaactaagcacaataaaagcccaccatgtgactgcaaaactattagcatgtgtttggttgggggatatggtgggatgggttaggtccattcctgttatttgggatgggttggacccagtttctgtttggttggagggatagaacggaccctgttttttgtttggtttgagggatatggtgggtcagaatggttctatcctctgtttggatggagggataaatgtgggttgttttggtggagatatctcctggtgaggttacctcacatatgaaattacttggacaaaatctccataaaatccaggataacatgcacaagtactagaaatacagctatgtattagttcccatgatggttttgacggttagcccacatgtcatcagcaagtccttgtctgaactgaaccatcaatgcatggtcatttgcttgcccaaatggctctgttgtggtctcacttattaaatctaatggatctgtaataaactgatcaattccatcatttatgacccaattatgaataatgcaacaagctacaacaatatctacttgagttggataagggaagaatggggtggcatcatctagaattttgaacctcctctttagtaccccaaatgcacgttcaactgtgacacgaagggacgagtgcctaaggttgaacaactccttctcattttgcaccggattattcccccactctttcaagtggtaccggacagcacgaaatggagggaggaatcctggtttggctccatatccagcatcaactaggtagaattttcctatcatatgatggagaagttggtcacatttctattgagatggagaaaatgatgaactaaattgttctattaccttggggtacaagaaggccattttcacgttccaatgcatctcttaaaactacaacatcatgtgctgtaccctcctaaccagccaagacataagtgaaccgaagatcaaaatctatagctgccattacattttgcgtggcatgagacttcctaccacgaaaatagggctccatattcttctcaacagaggctctaatatgtgcgccatcaatagctccaatacaatcctattttatattcaacaccataaaagattagggcacattgaggtttgttcaaatatataattgaaaatgagacacggattaatctcacaccttaaagtaaggatcccacctagggttcccggtaattttacttggggtgtccaatgagggaggcctaattagttcatctcgcagctcaccaacagcatgaaacactttgttgaaataacgactaactgtttctccggacctatcaaaattagtgcgaactaatctatttctaagattgtgccctactgtatttataaacatagctacttgttcctcaatagacatgtggatggtatcttcaagcaaaccacgatttctaaagagcttacaaaaccgaaagaaataatcttttctaagtctaagcatgtcgacacatgtggtatcgttcctccaaatttttgtgtttagatactcaattctcatcctatccctttcaacaattgggccatatttaacaccttccctcctagaaactctctttcttttcctagaatgaataatcatggccatcattgacaacaatagattggcagcagcagcaaaaattaaaatcttggtcctcttatccatctacaacaacaatcaaagaaaattaaacacattgccatgtcattctcaagcataaatcatctcatcataaactacttgcccaaattacatactaatacttgtttccatcaggaaaataagtactatgtaaaaattgatgaaaccccaaatcacatactaatacttgttcccatcaagaaaataactgctatataaaaattgatgaaaccccaaatcacatactaatacttgttcccttcccatcagggaactaatacttgcccaattcacatactaatacttgttcctatcatgaaaataactattgtgtaattgatgaaacaaaaatattgcaatgtgcttgaacagaagttgtggacagcaagggcattcatgcaaacggagtcgcacagatctagcattataaacaaaatagcagatatggtacatagctagggtttcattaccttggctatggaggtgagggggagctgacggggcgggagaggcgggagttccggccgtgggactggaaggaggaggcgcagcagggcccgtggcacgacgccggcgccgccgccctctctgcgccgccgcccccttgcgcgctagttgccgccgccaccctctctcgatttggatttgtttcgcttgtgattgtgaaggggaaaaaggtggtgagaaaagagatagggttactctcgcgtggtctcacgtgatgcgcgagaggaggtgggatggatcggtccgccacattttgccgagcgagaccaacccgcatatgggcagaatattccttttttgacccaacccagcccacacagttcttcaaccaaacacctgtaaaaatgggacggctctagcccaacccaccaaaaccttgcaaccaaacacacgcttagggtactccctccaactattttcattgtatcacttaacccttaaactttttattcgttttaccaataaattgttaaaaatgcttcacttatttcttaatagtatttgtctctttaattttacctctctatacacatcatttattttggagtcgaaaatattttcatttgtttatggatgtttgcttgaacttggtgtttaaatcagttttaagtacttccaacctatgtaaacaatgttaaaaagatctaaaagaaaacattgaaacatagtataatacatctatcatctttatcaaatttctacgaaaaatacaacttacataggaggaagaaagagagaaatactattacagagtaaaataaagtgtagaacaaactgaaaaaaatttacagggttaaatgctccagcaaaaatagtttaacttaggaggaaaaaagaaactgccgtgcatgcgaacatggcagctggaagagtttcttcgctgcagttggatgaccgaacaaaccactagtagcttcagatcagatgcagatggaagaaagaaagagagacagatcgagagaatgtcaacgatgacattgcggcgaggggaagatgatcacatcacatgacggcacatgcgctcgccgccgggtactcctcgtacacgaacttgccctcctgaacgagccggcaacccttgcaccctctgcacgacgacggcccagggcagcacatcgcctgcatcggcgccgccgccggccacccgccgccgcggcaggtgccgcacccaccgcagtacgaggggcctccgcatggccacttcggcgccggaacgccgccccatggcgggagctggtggtggtggtggccagggacgaacgctggcaacgccgccgccggggcttcgcactgcggccactgcgggtggacgacgccggcgccccagtgggtggggtcgctgcacggccacgggtagcagatgccgcacatgttggtgaactgcaggttcaccgtcgtcgacgacggcgccggcgtggccttggtctcctccttcacctttggcttctcctccttcttctcttccttcttgccttcctccggtttcttctcgtcgcccttcttcttctcctcctcggatttcttcttctcctcaggtttcttttcctcaggctgcttcttctcctccttcttggcctgatccggcttcttctcctccttctttgcctctgcaagcttcccaaattcaatgtctttgatgaccccgcaggccttgcatcttagcttatgggcgagctcctctggcttgaaatggcccgatatgatcaccctattgttcgagttctcataaacgatgttaatgatcttctccttgtctgcttcatgttcgncaattcaaaccacaacttaatcatatactgtaccacctttttggccttaccccacaacttagttatgggattaaatttacataattcagcaagtgcattgatccatacatacctttgagtttgttaaggactttctggatcttcttgcaacacttttcacactcgagatttgccttaatgatcaaactggccatttgctataaaagcatccatgcaatacaaaaacagagcttaattctgcaaaaaccttaatgcatatgcaacctttgctttgcagcaaaactgtggaagccagaaaggaggaccaaggactcaccttgtctgccatgatggatccaacaatataatcctaacaaagttcagcaagttcagagtggaggcatgttgccaaaaaggagtgaaatttatagggttgttggtcattgcaatactataatcgactagtactttacattgcggtcaatcgtcggtgaagaggagtctaccatgattggtcacttcaacgtgctgaaaacctaatccctcttattcaagtagaagattccgaacaacaacctagtgctccataattagagagaagagtcttggaagcccaagttacagagcatataatggtacgtctgtcaattttcggtttagtactaaaaaaacatgctagttgcaatggtccacaaactgaagctgattaaaatggggcgccaaatcgatatgctaggagtgtaacgacgttcgagcttctagtgacagactgacagacagatgttcttgctaatcgatcactagttaattaaagctgattaacatgttagtagacattagctagctagcttgatcagattcatcgttggtgaattctttaatggagagattgctgttggagttcaaaccattctggagtcttgacccgtaccctccttcctttttcagcaacataaaaaaataagataaattttgctataggacatctaaattttgtgtaagttgctgataggcattgtaaaaaaaatatgtcacggttgaaagacactttaaaaaactagtaatttacttcaattcgaaagataaattcttaagaaagaagagaatgcccatataacaacatgcttcaaatataacgctagagtaaaaaattaaaaattatgcaactccacatttaccataattccaagtacatcactagcatacatcgtattccatcctcattgcaacttcagatcaaaagctttcgatcctagacattatcgtcttttagaagaaattctctccaatcgagttaaaattatcctccagcaaattattaatttttaagtgtctttcagcaatgacacgttttgatgtctactaacaaatcacataattttttattgtcctgcagcaaatttggttaaagaagaacagaaccctgggagttcatttaagaggaaaataattagaaacaaaccacgttccaagtgtgattggaatcagcaatacaattagcaacccaataaaagaggtgaaacgtgatcgatgaactgtacgtacctgatgacactgacttgcgttgtagcttgattagcaacatcaggcatgcatgcttgcatgcataaggtcgtctaacaatggtcaaattaagcaggttagatgccactagatagctggcataaagtacaattataaatgatccatgttagttcgtctgatcgatcatcaaacgctgcaccaaccgccatgcatgcatatgctgattagtagtaattatctaaaaaaattctgattagtagtacttaatatcaatccagatggccgccggccggccggccggaggaatagttagttgcggatgtctgccgagattgccggcgacgatggccgatgggtcccaatccgaccgtgcagtgctcggactctcaccatggtttgtaccatacgcagcgcgtgacgtgagacttaattgttgcctgctccctcggtcaaaaaaaaaatcaaactgtgggtttccgtgccaaattttgactttccgttttatatgaaatttttttataattagtattttcattgttgttagatgataaaacatgattaatactttatatgtgacttatttttttaatttttttcataattttttcaaataagatggacggtcagacgttggcacggaaatctacggtttgcattttttttttaagacgggggagtatagacgagacacgtcctcatgcatctgtggttacagtacctgagtcaactggagtcaactcaaaaccgtgggcttcgatctgcttggtattttcgctggcatacaaatcgacaatcaaatccatccactgctccatgtgggacacgttaccgcatacgttgtcacaagagatttcacgtcccaaaatcacatcaccggtgcacgaatttggtactggatagtagtggtttatatactcaaacttgtgctcacgcagcctttcattttttttttaataatgaaacttgtgctcatgcagcctttcattttttttaataatgaaaataaattacatcttgggtctccgtccatggacacacagcacactttgtcctcactcgtgcgcactacccatccctaaattgctctaggccaaacacgcttaacatcagagttctttagagagcggcttccggaaaaaaaattacaacttgttaatatgagtattctattaatcctattaagctctaggacgggatgtcacaataggacatgaaaaaaaatgttgaactaccataaaaaatgctacatatactcttttaataagtaaataaatattttttatgtcattatgtaagaataaattttgccataaataatgccttgtataataaaatcatgaatataatagtcttatataacaaaattatacacttccaacaatatagctagtctacaattttcaaatttccttcatatgtaagggcaaaatgatcattttcatagggattaaacattcaactaacgggatggatatgaaagggatcaaaaccaaaatttagaggtatacaagggagtggacaaaactcgggggtgtagaagagattggctaaactttcagaggtatagaagaaattttctctaaaagaaattaaaagaaggcctttcatgaaccatactctccttcccgcacgtaaaacggagcacgtattattgtatgattaattaagtactagctatttcttttttcaaaaatgggttattttgattttttttaagcacatttcatatagaaactttttgcaaaaacgcaccgtttagcagtttgaaaaacgtgcgcgtgaaaaacgagagagggattgggaacttgaaggtaagaatacagccatgtggtgtttaggaaggaggaactaaactttagttcctctaaaaaaatataagttctgatgggaggaagctgcatgggtagctattcgatcggctattccttcatgtgcaagcgatgtcaaattgtcaatcactggaatacatgtctcaatccaactgcacccgatcagctcaacatgcgcccaatcgaccactcaacaggcatgctgattactgagttttgtccgttgtgatgatagctagtgtacatacagtgcatgcaaacactggtacgataacatgtcactctaaaacacagtagcggtgtctcaattggattaaggcccatcaaccaccaacctagctacaccgcgagacccatttgtgtgatatactgcgatgagccaatgaagtactactacttactatacaaaagccagttagatgaagttttattgcgagaataagttaacaaaaccgcaaatttctgccgctgaaaatcgattagaacatgcatatcatcatttccactgtactcgtgtatggtaaactgcaaattactgctcaaaagagggaacttgtgtatggtacttcagtggtatattttcagacatacaaacatcaatatatatcctacagtatatactaccggggagttattcaaaaccttcaattctatgcatggagaattcagatgtgctagcaaatatagtttagggtaaatgggcaaggttaggctgatagtttagaggcagctcatatgtctaacttcaggctatgtatattcagtggttcacattgatcacaatcctatgctgcctaatattatccaatagcaaggccgcatgagctagctggaaagcataaacagagcgcattgcatcaaattgcctcaccgtcacagcttgctccaatgcgcggttggttctcttaaccacctctggacattttctgacagaaaaaactaatcctctctagtagtatgtgacatgacaacgaacagggaccattttagcactaagatgggaagtggccgatagcacatttagcaattttcaggctcatatatcaactgcaactgaagaacatagcatccttaaaaaaaccaaatatgcgattgatgataaatcagagtggtgtgctaataaaattttaattgatgaagtctgaaactctgaatcgacaccgcgatctgccgtccagtttcagatctcaggagtgacaaattagctccttttcggttgttcgcatgctatagtttactgttgaacaaacctaactaatatgtagaatgcaaggtttgtgaaagggcatatagcctagtggttgcagtgatctgagtagcactctaaggtcctgagttcaaatcttcataggagcgaatttcagattgggttatttgagggctagttccctgttcgataggctaagttcctaggctaagttcctattaaaaaaaagctgtatatatccggttggatatagaggccgggtaaaaaatacccttctccagaaaaaaaatggaatgcaaggttttggagcttgacacggtgatggattctaataactcatttagatgacatgcaataaacgagtgaacgcctactcgagctattaaaacagttcccgcttgacacccttgcctctattccggaactacacagcagcatacctgggtgaccgcccgcgtctcacggcggggatcaccggcttctcaaaatgcgagttgaaaagagtgagaggggtcttgtgcactgtctgaagcggcgtcggccggcggccgtgggcgagtactcgaggcgagaaaaataagggccggtttggtttgaaacttaaattaggcttgtcaatatttaacaatttaaatagtgtttaatgtctatttggtttgaaaataggccatttcaatagtgaacttaggctattttggattcaatccaaacacaactttaccttaccaaaattagtcatacaaaaacttgtcaaaatttagcattgacaaaatttggtaatacctatttagccctcaaaccaaaccaacacaggcttggcttcggagtacgcgtcggactagtgtacggcccagaccacctaaaagcccaacatacttgccagttgcatgctacatacggattacggtccatttaatgttcgggcttactatctttggtgctaagcggcccatatgaagcagataaccggatcgctaagagaagtggcgaaccgttttttcacaattaaaaccactctcctattttcacaatattgaacatgttggaggagagtaagaacgaacgaggctggaagctcagattacatctagatcatactttgttctgaaatgtttaagaccaaaaatataaagaggacatgaaagtcttgatatctcagatacgtagaccttatggaaaatcaatctcaagcttaagttcaatgattgtagctgcatttctcccccatgataatactctcactgtcccaaaatataagagattttaaatatatgtaaaatatcctaatactaaaaatctggacaaaatctattcatattcgtagtattaagatatgtctcatccatctaaaatctcttatattttaggacggacggagtacaatttataatattcatatccaaatttcaattataatgaatgaatcaccaagtgaggaagaacaagtcgaaatgtacagtagaggttaatcacagaggtgtcgaaagcttccaatagcagactttccgtgtgaagaattcgataaataatccatgtacaacaactaagaaccaaaaaacaatgactatcaggattacatatatttacccttattggcagaagaggaagggaaaaaccgtcatgaatcgatggggcgtgaaacacagccatgagcccgaagctcgttgaataccctatctaacaatctggacagtgccttcttccaagagaacgagtatctggacaatgaggctgacacccacctttacttgaagactcattcatatcatcaatacctgcaaagcatgtagtccccatatttgagactaatcccatcgcaaaaaaaatagttaatcaatcctgtcaattaatgaatagaacatgctttgtccactcttctgccgacatttatgaccaacgatagcaacccttctcctgttccacagctgtatttgtagtcgtagtgcacaataaaagcttttgggagctatagcatccagtcagtacgccacataagggtgagactcgttgatgcacactgctatcggttggtctgattcccaggttcaattgtgtcagtttgtcagggaattatgttgcactcatccatgaatttatcgtctcgagttaggaacctcttccagtatctcctgtagcttggtatacctaattcaagccaaggtttcatattgccattgtagtgcaatgctgcagaactccgtgcaacgtcttcatcaattgcataatcatatccaagtccagatagaatcaacctctcatcaaggggataaatgaggtgttggaaagataacaaacttagaggaaaggctgctgctcgcagagatgtctcatccttcgtcaagaactgcaacacaacagagtcagattaatacgtgcaatataatagtaaccatgaggtgcataaaaaacagtgggacaaataattttcagactgagactggaaaaacacaagtagcactacattatctttccagatcaccctttgttgtgcccttttcttatcatatgctatcgcaagaaaataaatagaccagaactataccaacctttttcagaagcagcaggtagttctctgtaactttgtgcttcctccatttatccaaatttataacatttattccagacatccatgcacatgacttggtatcaactgttgtactacccaagagatttctcacttgacccagtcttaaaccacaaaattcgatagcaccatttaccttgtcccccatatcaagagaccacaagaaagaaagatcacgttgaacaaccacatcatcatccaacacaaccaccttatttagatccttaaatatttctggaatgaagaaatgtgagtgactaaataatgataggtattccattcttgtcttcccagcaggttgctcagtactcctaacaagaacacggaactcctcggacagatacaggtgccgcacattaaactttgttaacttctccttgataatatcctcatagttcacgacatggatagctgcctctctgtatgactttttgtcaaaccagtatttcatggcatagaaattttgagcatcagttaagatatgaaaaatgattttttttgggtcctgcgaaaagaccaacatgaatataagcaacacccacctcgaatataatgcaaaaactaaacactgtaaagaataaaaaccatccacatacctttgaactgttcactgttgagttgataacaaccgaagcagcaaggatgttcttagatagtatgacatagtgcctaccatgtgcagcactaaatttgcgagcagaagaatcatttgaacccagtgaagaggatgtgaaatactctaatgtcaacctcatagatagacagtgatgactcttaggcaacgtctgagcaccaaggttgtagaggaatgcactctgcttcatatgaaagtgagcttcatcctcagtcatgtcaagtatctgacgaagtttcctgtcaacatttcgacaatctacagtgcaagattttgctctagctattgtttgctccatctgctccatcttcttgttgatactgaaatcaattgataaatatcattaaaattatgaaagtagacttatatattgatgatgggaaaattattcatcggttgattctatactattttcagatgaatgcacatttttctcaaaaaaaaaaaactatttccccttaagagataaagagtttaaatggcattgtaatttgcaagatatccagatccagtttcagtaacatataactgcaactttaagatgacaatgaaatgaactgtgaaagaccagaagagtaagcaccagaattttaattcttacaaggacggtagatcagcatcaacagtcgatacactaagaaccctctcatggtcttgtatgttttgcttcattagcacagtaagttcctcctgtccttcaagcttcgcaatgcttggataatatgagcgtgccacaaatagttggtcttttagccttttcacaatggagtccttcatgactactttgtgttctctggaccagagacagtagctaccaaattcaagttgacaagccttctcattttccacttcatctgtgtttgtgcctttgtctagtctctttctaactttgctaacctcctgaaagcaatgcatgctcgttagtacctcttgttgaaaaaaaaattctcaggaagaaaaatagagcgctctatgagaatgaagctatcctcgagagatactaggatgcagtatatttagcattgtcctaaaattttgtccttgaaagatactgggacacagtatattttcagcattgtcctaaaatattgtccttcaaacatacagggacacagtatttttcagcatcatattattagaataatggcatgttattacatcagtacgactaaaaggaaaggtaatttttggcgttattgcatactatctacaaatatgtgtttgacctgaaaatatagcatttgataacttctagcatcataatacttactactactgttactgcaggaccttagaattccattttaatgactgaacgtgtcacaaaagtagcaaaataaagtacaaattcgaatgctagaaagcatactcttgtgccttgagttgactccttcacagcctctgatgggtcaacttttggtgagggaagaactgtgtatagatatgaaaaagaatactataaatatcatacagaataaaagaccaatcaggaataactggaatacagcatatagacttcttaaacaaagagcagcagtgaacatattgttagtatcacaatgacaacattgtttctaaacaacatttgcatctagtatgtaaagtaaagtattgggaaatggtgagaagcaagagcgtgggactgaagaaaacttgagttcacatataatatttaggatgaaggaccatgcagttgaaattatgtccatatataaatatataatcttcatgttactatcactgttctttgtgtaacccgaaatgctagatttcctgttaagtttaccagattacttcgtatagcctataaatctataattcatgaatgacatgctagcattggcaacattttagtcacatctaaaaaccttagctgcagaaaatgaactgaagagtaccttttggtttagtgctaatacgggaggtgtgtcgatcagtttgcttatgcttctgcagccctccgctgttaactttgggcgtcttctttggtgcatcctgaaggggggaaaaagaatgtgttagtgttgcagatgcaaccacacaacattggcaattcaccaactgctacaaatactaattctaatttttcatacatttttgcaaactattttttcataattcatgaaaaaaatgtttaagtatttcccttgagaggcaataaccaacaaggatacagtgttgtcctcggaaagctaacacgctagacttaaaattcacctctaagttgcaggtagcaaggattagacaagtatcagtcgtcctggccactcatttattacatcataggagtagataatgcgagcaccttacgatgcattggcaccaattgaggtttcagaagcaaacaacatttacaaagcagtcaccatcatcgaacaggatttgcaaatgcgaacctgattcagtccattgacagtaccgtcaccatccgccttctccacgtgatggaactcaggcaaaacaacctcctaaaagccaacgcgaaatgcaataatttagcgcgcgacgcagccttgtaacacatcgaaatcagaagtaggtgcaggagaaggagaatgggggggttaacagttgcgggtacctgtcggcgccgctcatccgtcgtgacgtaccctgcatcacattcacagtcacagacaaaccaaatcaaacaaaattatccggcggcagttcgaaattacagaaccacagagcaatcgaacaacaagtcgatgcccagatccagcggaagcggcactgatccgagcacgagggggcactgcattcccctcccccaaaaccctccccactaaaatggttccagaaaggcgagagggttacgaaccggattgagagcggtcgaagaggaaggcgaggggaacgagcagcgagcagaggaagagcgccagcacggccacgcgtggccccctccgcctcttcgccggcggcggcggcggcggcagcagcgtcgccttcatcgccacctcgccccactactgacactgctcatggcgaaccgaatgcttgggggaatcgaagcggttgcggtgctcggccacactccgcttggatttgaactgaacaacaacaactcacaattcacaactgatcgatggatggatggatcgatgggtgggtgggtgtagtgcgagtgcgagtgcgagtgcgaaaggggagtggagaaagatggggaagaaagaaagaaagaaaaagaaaaagagagagagaaagccaagccgttgagagggccagcgtgtgtgtgggcgtgacgtggggtccagctgtcacgtgatcatgccaagttgccattgccaaccgtgtgctcgctgctgggccggaggcagcgtgggccgcccgttcgaggatgggtggcctgtattggtaacgatcctagctgggccgaaattaggatcgctgccattgatagctatccatattccgcccaaaactgaacgtatcgcaccgggaagtccatgctccatcgcagccaggctgtgtctgacactagtcttcactgaaaaccaactagaaacaaaaaagaaaaaaacttgatcatatttgaggctaggagcagactctgattcttctacaacgaatcagggtcactggatatgatgatccttcaaggccaaacggcactagtttctaaactctgaacaagcagaaaaaactgaatgaactaaagatcagttgttagtgatgaacaggtgaatttttcatacggataaagagggaaagaagcctacactcattaccactaaattttatatatacatcatttgagaccgtatatgttcctagatatggggttactagcattgacaaccaactggtaacattccttcagatctttaatttcacataatcatgtagcagccattcttcttgtacaccagaaaattgccttccagattgtccaacatctcgacgacacattctcttttcgacccattgaagtgcttgacaacatcctccaacgaaacctgcaacaactaagatcatcaacgaggaacaacatgaattccaatcgaagaaaattcagaaaaaaaagatgtcttaccccattgcgtccttcaaccagttctagtattgcatcctctgtggcaccgattgcggcagtagaatttacaccttgcccgtctatcttttgtagtttacttgctggctcatcaccacaaatcaatgacccatcagtttggcctctccttgtcaaagggcttgcatcacaaacatctgcgccaacttcacctccattggaggtggtctttggtgcctctgatgtcttggactggatcccatcagtaggaacagtaccaaaaacttgatccgacaatccaagtccctcaattgccaagaatgtctggatcatctcataagttacctgcaagtatcatgttgcattttgccaggtaaattaggccttgggaacgctttggatgaactaatatctaacttggcagtgcataagaagcagttgtttgttgatgcaacagatctattagatattaacaacagtagtctaatcatgcatggaggaagggttacattttctggaagttcatctttgattggcttcaacttttcatgtgatccaagctttgtaatggcaagacggatctgtgaggctatctcatgtgtaagtcctacctcctcacaaaacctactccagtccatctcacatccatctcgagcagcatcaagtatgtaggaaatgactgttttctcttttattggtactgctctgcggtaatgctagaataaaccaggatgttaagcagtgaacttaccaaatggatctatagcaaacaaaaacaagggcaactcaccgcaactttctggaacgaaaacttcattttctgccacaattcccatgaacaaaatttcgcgccacccaaactccttgggagattattttgtgtaggttttggagcagcaggtatactttctacagccgataaatcatccacaggaagattcaattcttttgccaattgtgtgatattttggatgaaaatactgccgtaatgcgagatgaagtgctgaaaaccaaaggtcggacattatgagtattaagacaaaatatgatcacatccgtcgtattttccagtagggtgcaccgcaaaaaagtttagtgctctgtgttatggcataaaagtgtgttagctactattattttctgaagtgatacctggttaacaccatcaatattagccaacctagctatggtgctaggcctgaacttcgcaaagtttcttagtgtctgatcaccacatatagcgtacctgaaataatggattaaagagattcaattcagtgttgctccaataagtaaagagcctagaaacctaaacctattgttgtcaacatttaagtatttaactcacggcgccgttccaatatcttgtgcaagttgcatcctgacattcaagagtacttggtagattttcaattcatcctgaaagagatccaaaatgagactaaagaactctaaaataatgaattttacaaataattcctctgagaaacttacctcagaaattttttcagattctgatgggcccaaaggatttaagccctcttctttacactgtgaaccaccatgcccctctagctcaatcatctctgcagtcagctgtaaaaacagcgatgctccatcccctttatcagcagtggatagaaacttgtacccattaggactaacactgaacatagacacaaggaatcagtgagttgtggctgtttgagcattcatgcttgggttaactggagtcaataaattcgaaatgagctagcaaaatagaacaagtagaatattatcttatgcagtgaaaaagaaaatagtcagcacagcacctgatggatctaaatgtatcatggacagtctccttcaaataatctgcacacagaataaaaagaaataacaaatcaaagtgacaatgaaagacaggacaaattgttgtgacacctgatgaataaattcactcactgtagccattaattaacagtacagcattgacaaaacgatactccgaaatctgaatttcagtgctaagagacaatttaagaaataaacatggtagaaaaatacagatcttgagctctaaaaaaaaggtctctaggaatgaaggtatacgagaagaagggtatcccaaaaaaagggtcagatgaaatgagctattatggtgcctactctgtacaaaatatgctgtttgcatccgtgccatatgatcgaggacctaaggtcatgaaaaacactacttttactaaaagaatgaactgcagcatcacaatgtttattgatactattattttaaaaaaatgcaaccatttattttctccaagaaaacgacactgtacatatgtacaaaacttcaagtcagcatacagaacatgtatcttagcttgcacaagaaaatgactaaaaatatgtagagagaggcatacgatggtaccatgtgctaaaagcaggccgccaagagctttccaccagtttggtggatagtcttttccccgcccatgcaatggaagtttatcaaaattgttttcaactattttcttgacctacaaaatgagaaaatacttaccatgaaacataatcctttacaaaattgttactactgctcaaggctaaggtatttttttcaaaaattattagttgtatcacttatatcttattatcttataatgaactaatttgtgattatgaaaagcttgaacgatcaccaggatagtgcagaaaatataagacctaaatatacattccttgaaatattctattcacattgatctttgttcccaaaaacattatcagcacacaggtgatcttatccaatcaagtgctaatggccaatttatgtcacaagctggcaaaaatcacaaacatcaggatagaaaccatacacgtgatccacggagaacatcaataggcaaattaaggccccaccgtccaccacaggacttaatgcaggacagcaacaagaaggattcttttgacaaatccctctcgttttttgtccttgtgcaattttcacaattacctgcaaatcaagagatatgtcaaaaaccaatgagccactagcagttgaaataagactcgaatatatcttactctttttaaatggaaaacattactagatgagttcaaactgactcttaaatgtaacatatatacttaccacagtcagtggtgcggtcttcgccaaagtactgcagcaagaattttctgtgacatgtagcaagcaggcaatatttttgtgctgccatgaaggactccatgatggcttttcgatgagtttgctatcagtgaccaaaaaaatatgagacactaaaatagtaagcaactgaaagaactaggctgcaaatatgtaagatatatcactttggcatgaacagagatacgatgcacataatattcacatacacttttagcttcagcacaatagaaatcagatttcataaaatcacttctttggtaatatagccagcagactgaaggcagtccatctcttccacaacgcccactttcctggtagtaggattccaggctctttggacatccataatgtattacacatctaacatctggcttgtcgattcccattccaaaagcaatggtagccaccatcacaagtacttcatctctaacaaacgatctgtaaaggagaagcataaattatgatgagcccctattgtaccagaccaatattgcaaaggcagcatgcatattataaattgaaaggtattaactactcatttcatctgtctaaatatctttctagtctaataacttcatgatctagtgcatacgtaacagaatgccaatatttctacaaacattaaagatcaaattatagcactgcaatattcatagatgttcgtttttcctcatgaaaattgtggcacgatcaataaaatttaatacagttatgcaaaccgtagccaacaaaacaattatgcaaatcattctttatgcaaacaaaaagggagtaaagtggaaagcataatgaaatgtgcacaaagaaattaaagtagatgatatacctatgtgattcctctctagctttatttcccattctaccatggtaaatgctggacttgattccagcagcaaccaatgcctcatgcacctgaaagaaaacggcttacaagtcatcacatgtgcacctattacgaaagttcaaaaatacgtaaatgcatgataccataagctgtaaacctgttcagtctctcggatggtagtacagtatattattgttgagccacccacagtacagttctttgagacatccttcacaagttcattgataaaggccatagaccggttgcatgatttcacgccatagaaaaggttaggacgatcaaatgatcctaccacaatgtgaggaatgcgcagggtcaaggaagtggcaatgtctccacgtaccctacaaaattatatggcactggtcaaaaaaaaattatatggcactatatatttggtgattggaagggaaaaaaagaattagccactgtaaacaaaggtaacgcaacctacgaggctataacaagtgaacatgtctattttgaaaagaatgagcatcaatatattttattacaatagaaattagtggtcaaagttacgttttggggaacttgtcagtgtccaaaacagcatggtttcatgaacagaagggagtataatcaaatccctgcatttctgtctacaatatattttacacgcatcaagaccaaaatttagtgccaatgtgaaatggaaaatgacatttctcccaaagtcaccagctaccgcgcagcccccactctatcacttgattcacagtttcagacatgctgtcagtttacatatgaacacaataatggaggtaagttacaagttttccaagccatttccagcttctatgatatgtggagtattgtgccaatagagatataattatacccctctaaaaaacatacagctatacactctcactattcttactttaaatagagaagaaacataataatatgatattattaatgggcgaaaattttaccaagcagggaaacaactaatagtgcaacatctatacctttgtgtggctgttgcagttaaagcgacaaagggaacacccactagaaggtcacgcaacatatgcaactgtttgtactccgttctgcaaacaagaaagagaattgcaatcaagaaaaggtcagctatttattaaactggatggtgtgagttttaagggtgggagcacaaattggtaggcagtatgaataacctgaaatcnnnnnnnnnnnnnnnnnnnnnnngccccattctgacagccaacaagcagattccggcagcctgcaagttactccaaaacctgggaagaagatttagaatgtcaaatcaatagaccgaatgctatgttatcaaacccatgagtgatttgttgtgtccatgaaattgaatgagcatgcctcccatttccagacaagcaaatacataatcaactattccttttagactaaccacgcataatcacaaagtggatgtgactagagtttatcaaaagactactagagtctgccttttaccttgaaggaagtgagacagctttctctggtgtcatgtacagaacatcgaatgcgcctttttcagcctgaccgctaacagagatgtctgtttgggtgctgccaaggtattcagacttcacgccatgctgctttaagctcatgacctatttgaagtagataagacccacgattatgttttcttgtaaaaacaatcaacaaagatcaaagcaataatgatctgcaatgagtatttgaaccatacctggtcttgcatcaatgacagaagagggctgacaacaacagctgtcttctttgtaacaagtggtgggatttgataactgcaataaaaagaaatcaattagcaatcaataactaatccaatgatttcctggaagaagaattagatgatttatgtatgtgtatacccaatgaagatgaacttaactacttaatatagctcataggctctatattactatcaaaatcattatgttttatttttctaagatagcataaatgcacactagaaataagacaaacccaattctgaaagaatgttttacctgcccaatcaacaaattacacaaacgccaatatgaacattacacggcgatacaacaacccatatatcaaccaaatgcagcattccaatttagatttcatcactggaacgatctaacttgcacatccatagaaatatccacgatagctagcaaacagtggcaccgcacgaaggaagggaacagccacagcaaaattttccccacagggaactaactcaccagatcgacttgccgctgccggtggccatgacgaccaagcaatcccggccttccaggaccttctgtatgatctcccgctggtacgaacggaaccccgagaagccgaaatacgtctgaaaaaaaaaaagcagaaacgccccagttcaagcatccagatagggttttagcccgcgggatcgcggggctagggtttattagggaatgggaacgccattagggcaacgagcacttgccttcagagctgcctccatcgtacgtggtatggggctcgcgcgcgcggtcgcgcccccgcgtcggcttcggcgaggggagttcgattgagcggcttcgggaagaagaaggcgaggcgaggcggctggggtggagtggaaggggaatgggaggacggaacggagcgatcgggaggtggtggcgaaatgggtggtgttttggtgtttttggccgggtagaacggaacggggagcgttgcggcgggtctttttattggacttcccgccatttcttccgtttccttttttttttccgcatggtcgcgattattccttaataataaaaagcctgtgaggcccagttttagcccattaggccttgtattctttttcgtgtggtcggattaagtttacttgtggtccctagttatcattgagttcgaattaaatccttgaaccgcaatagttgaagtgaaacccccatctttcaaaaccaggttaaataaaacaatatacgatgattgggccccacatgtcttttatttaacctgattttgagaaagtaggattcaacattactgatattacggttcaaggatatcatataactttgaacttcggattcaacattactaacaggcccaccgttggcacattaggcttcggcaaagccggccgtatcaatttatgttttggcaattattgttaaaatcttagttgtttgatttggactgatgctaccttggtttaaattttgtcgaaaataagcatatgttgagatacagctaccactgcagttttacagaccacacaaatatactacctacagaaatgtacatagacagatcagaaagttctaactggatacgttgtcgagcaaggcctctgtatgattttgggttcacaatgctaccctgaaaatagcaacgttagcaatgcacccagcaaacaagattagctagcatctctccgctgacagaattcagaaattttagatagctcgactgagaaatcctgaaccagaagacatctctacacaagtcctggcctcaaatgtgattacaaaaactcctatgtcagataatgggtgggaaatgtcaagaggcaaagatcacaacaaggtgtcgactacagtggagattgcctgaggtcctcctcgctcaagtaaagccaatgcaagatcgtgctcattccaactccgaagcccagacgctatcttctttagcgtgtccagtttaatgtcccgcaaccatgacgggacaaacttcaccaccaggaacacaaagcgcgatacatatgccttccaggtgccatggtcacaacccagaagaatgtgcccatccaatacacccgccatgaaatccatatggtttcccaccactcgtggccttcttgacaggaaagacaatttcatgacaggagaagttctttccgctccccagagcagactaccacagaagaagagcatgttggccatggcgtaaccttggagtgtgcttgaaactggtccagggtctttcatactctcttctcgagctgatagcagcagcgtaggcaaggtctcctcatacaatacctggaccagaagaggtccacctgcaacacacaggagtcccccaccaagcatcgcaacttgatgcgccatacatgcagcgctggatagtggcgtgcgtcctgattttaactgtggagggccactggaagagaatccatttgcaagtttgtcagcccactcaatgacttgcttcaggattacctcactcacaaagtaggtgtcatggaatgttcgacaagttctcaggtaaatgaaaccaggagccatgggaagctgaagaccttggccggtgattgcatctcccattaaggcaccaactccacggtttgcagtaaagtcagacccactgcacgaggaccgtagaaaggatgagaagcaactttggatgagctgtgcaactgcatctttatctctgccgaatggagaacgcagacaagagaggatgataaagtcatgccatcttctgactttctgtgtccataaggctgctatgatgggcatacttggccaggaactgccccctgcgcagttctctagtgcctggccactgatcgcatggatatactctgaactcttatcaagcttaaatgtaattgttaagctgaccagcgcagccattggtaaaggaagcattggtggtacaccacctgcaaaatgaaataaagaaactatattcatgaagtgatattaaatggaatgaacttaaaagatcatataatgatggagctgaaatttatcagtaattaggtgtgaagcaatgcaactaaattgatgcacaagaataggatgcaggtaatacgtggatagcagctgggaatctgaatgccagcagatgcgagaatttcctttatttctgcttcgatggaatgaagagaagcaccaggactaggccattcagttccattcatcgggaccattttccagattcctcgtgtaatttctgctaagaagtagctaacaattgctgcaatagaagctggcaagaagtccacaagatctctcaaacctgcagcacataaataagattaagacttggggatcaaatcaatacggtgacatgaaagaaatggagtttcctcacttgtagtcaagtctcggctggaaaaccgtccatgagcacatgctgtaagaacagcttcaagaacaaaaggaacagcttctaaaaattcccatgcaggaactgttggcctttggtaatcatctggtgtacttacagaggaaccactgacactactgctagaagtggatgaaagattgccagatgatacaacaggtttgttcatttttctgcaaatcatactcaaaatcttgtttgcaacttgatgaacaggatttttgttgcaaagaccagaaagggttgaagctatgcaagcttgattctgaaaataccaagcccttaacttggggaaagaatcaatataaagtggttgagcaggaacctcatttaatggacctatgttgttgctagagtttctactactggcagatgaatttgcaaagtcaatatggttattgcgcattaacagcaggtagtccagagtaagctccaatctaactgagcctccacgtccagctagacagtattcttgtgggggtttataaaatttccacagtcgaagaagacaaagaaatgcacaagagaagaccgaataaactgatatttcaccaacaatggcaggcttgtggttagatggaggtggtatggacccaaaaacttcacagattggcattaaagctgcagcaacatctggaacctgtattttacaaataataaatggtataaatacatataggtgcagacatggagttagcataatagctaatatgatatagacatgaaaataatcatgtatcatgtaatgaatgtgtgtataccattatgctagtcataagtaaaatattaatatatggtttcagtatatcatgtacaatggctctcacaaaaaaaaaagatatggggaccaaacgacacggtaagctatggcagtcattaactgttagcaacaacaaatgatagacattacagcttactgcaacaacaactacaaaagaataagaagataaaatgttagcaatgagaggcaaactgtagaagatttgaaattgaggatatataagactacacaagatcagctcccatgtttaataatttgcctgtggccttacagcagctgcattgatttgtaggcagttccataatttttactttgaggagaagtgaagaacaaatcaggaggatatttttttcccctttcagaagattaaaataaaggaactataatgaataaaaaaactatgcaaaacattcaccagtttgatattttgagaataaattgtgcaggtgatagtacatgatgtattgctcaccattccatacaaagaaataatgtggatagcatcaccataagaaataccaagcaagagtgcatttaatgtagacatctgagcaaggtagtggctcatgctgccctgtgttgaggaatttgagggcaatggaggtgataatagcttgaccaccatgcggaccacatattcctgagacgacaagtaaaatttaaataatcatcattttaggttaaaaagtatgcaagtgcaaatgaacctttttggcttgctcataagcacaaggtcaaatcaggggcatgaccacttgtaagcgtgcagtaagataaggcatacatcatataggaaagaataggaaagacgaatttgcatgtggacatggccatggcagtagtagacacatcaaatgcgattgaattgtatttcagttaaattgtatcaataaggtgagatttttttaaccatatgaacataaaagttgaaatggcaatataaacaatttccaaacttctttacacaatataattaatctaaaataaaggtacctggatattccaaccacaaacaaatgatgcaccacaaagaatttttgcagcagctgatttttcctcctctgaaccatttaatgctatgtgatataacctatccaattctgtggtgctgaaacagaatttcaaattaaggcaggaacatgacaatgccagtcaatagaccaaaaaaatgagcatgaattgggaaataaaaagaatcattgaatcgagaagaatcagcttaaaaatggagttcctaaacgtgaagtgctagtcctagtgtcttttctaaaattcaagctccaattgtttcagagtatatcttaatgtttacgttgtttggaaaatggcagaagcgttacacatttaagttatcatcttgcttgtggcattggttgtctacacgcagcaaagtggtaataggaaaaagttcctagctgcaggataagtggttcacttggctactattcatttgctggttttcaagcaggctctaacatgtgaaaaccaaaaggttgccaaataagtgaccgtaaggatattgaggtcatagagcaaggagatagtaaagatcaatgtagatggatcttaggaaaggtttggggatctgttccccccaactctcagagtgtcgtctcccagagagaagtattgatggctacgattgaactactccatctccaggatagtttccaatcggacattacagggcaatgcatgcactggaaaatgctctaataatatggatatccaccatatcatacagagagatgtaaggaactaatgtagttcttcggttcagatgaggaacttagtagcatcaatgatgtaagtgtaaccattcaaggccaaactcctaatggtgaatggcttcgattgaattaaatttccatttttgtcataaaaatatataatttcctgacatgtaaacctggaaagttcagcacacattggattttcttttcttttcttttttttttttgcatccaacacacttgacctgaagaattcagagagtttgcttagccaggggtataactcgttgtgcaataggtagtattctttcttaaaaattgcagtgcagcaaaccagcccataaaatttataattttctatactaagttactcgctgctagtataactgcataccttgaagcaggagtagcaatcagagcatcaataagtggacctgaaagtggtgctccttgcataaagtttaaccagggggattcttggggtaatgtcgcatctttcaaatgcccagatgatacaacatagccgggccataagtaagaagatgtatcaatcaaattccttgaaatacaggcttcaactataagatgtagcatattcccaactgaaaagggatagatggtaagaacaaaaggcctaaacaactttacatacaaaaataaatatatttgcatatagaacaaaaaggaaaagtggtagtgccaatctataaaagatgtgaaagaaagaaagatgcgagtatttgtgaacaaagaaagattgttattttaaaaaaaaaatctctactatcaccactaacacaaaggcatggatactcgtgtcaacgaagaaaaatgtgaagtatatatagacacggagaatattatggataagatcaaatctcaattgagtatcagaagtgtaccagtttttgtcgaagagtcattttggcccatcatgccagggttgccacctccagacttatagttggccttaaatgctgctgcttttgaggctgcagcattggctgcatttaccactgatgaaggaggtactagaagtcctgaatactggatcaaatcctggagtgatgatacaagtcctgatgtttttggaagacttttgcttccttgagctccatggacatcagtttcttctttaagaattgcaccaattgataatggaataagagctaatagcatgcatagtcttgaatctagatgaggaattggtccttcgagaggttctctagcctatttagaacatttacatgtgagacacaatacaagtgtgtgtgtgtgtgtgtgtgtgtgtgtgtgtgtgtgtattcaacaataatagccaatacagaaaaggtctatttacccgctgtacaaggcgaagggcagaaatccaaagagctttaaaggtttcctgccaactcgcctcattaattgcttggagtgtcttggtcatttctgattaagagcaacatgatattagtcaataaaaacatgttatctcataaagaattgacagtaaggcggtgttggttacaaaaaccatgttcatcgacattgctagccaacatttaagatgaactcacggcacacagatagttcaatgtattgcagccattttaaagaatgaatacagaaaaacaaaggcaaaatttatgtcaattaatcggattgtgtatgcacacctttcagaacctcgatagcagatatggcgcttagatgttttccatcaattgcattctcaacatatatgtcaaatataacccagcatgcagctctcccagctccagtaaactggcccagcatggagccaccatatttcatgttaccaagaacacccaaaagccttttgttgtttggttgataggctgtattgctaaccctccacatattcatcaacagatcatcaattttatgattagcagtcaatagtgtctccaattccattttgtgagcttcaaccaagctcaacctctggcttaacacactgaacttttcaggcctaacctagaaaaactgtctcattagcaggcatttgtaatgtgcgtcacgcacaaagtatgtcaggagaaaaggtgtattctttaaaggttcttaggaaatttgcgatgatatgaatcaataaaaaaaaaacttagaattggatatttggatagcaatttcctctaactgagcatgacttacatgttcaggaatatcaagcgcagaaatgattggatcttcctatcagcaaccatcataatcaacacatctaaagccataacagtgttcttccggcgtagttgtgcacggtgctcgttttgcttctcagttgaaacccctttgacatctaagtccatatcctgtggcccttcaatagcgtaaatgctcccctgctcctctgtcagcccggatggaaagccacagtcttcaagtgtgcaatcgatcagtttggtgattacaaacatcataaagaaaatgatgacatgtccattgtcgattccagaaaatccataaatctttgacagttgcaaagcatcatcgatggactttgttatcctgaggaaaaaaaaacagcaattccattttagcaacatccagcaggatacaagcgactagtacgttctgctctgttgttcatactacagaagtacaggcaattgcagtatacccctactttgaatttggcggtgcagggtttacaattttgttgaaaaccgatcaaaaatcatgagatttcgtgatttcgagccagttcaaaattcaatcatagctactgattgtgctgtgcccttgagaaagttcatgaccgcacactttccgatgtcacattccaaagcagaactcttacttgtctcgattaggcccggcctccatggagagaaaggaggatgtgacgttacttctcagcaactccaggtagagccggtacgcctcaggctgcgcccgccgctgcggcagcaccctgcaaaaacccaccatcgccaaggagtcactcacaaaatgcttgggaagatcaccgaatccgcgccacgaacgaactgggaaaaggggacccccgccgacctcggggtgaggagcgcgaggacgtggagcgggcagaggaggcgggaggccacggcgtggccgacgagcttccacagcgagggggagttgtgcgcgaagcagaggttggagacgaggatcccggcgaggtccgcgctggggagccccgccccctccccggcgacgacgcgggccacctccaccgcccacaccagcggctggtccccacgcgcctccgacgccttcagcgccgccatcaccctcctctccagctcccctcccccgcccccggcgggcaccatcgccgccgccgccgccgtcgccgccacggtgacgacgccgacgagggtttggatttggaaatttgcaactgtgtcctcctcacgtggatggaccgcccctctcgagtcttccgattcgtgcgggcggtggcgtttatgaaaatggcggggcagatcgatctgggccgtccgatctgatccgagggtcgggcacgcctgtcaggtgggcccggacgcggagaccggacaaaatcatcgggtgactgtgaccaagcacgaatgattgggaaagaaatggtgtcccatgtagtaaaccgttatagctgttggctcacaatggggaaaaagagtggcacctgtgtgttcatcttgttgagaatctatgtgtatcgctgttacgttttcaatggtttttaaacggattgataaaatatgatgcttaggattgtgtgaattcatttattagtgtgttttgtgcgagtgatggtgtgttgatgtggattagtttctctgcgtaataaagtagcacatgctaaggttcaacggatctggagagctgtggccacggcagacgtatgagctgacgcaacgtttttttcgtgtttgtcatttgtgagaccaacgaacatagtaaacctttgctatagtcatttttcagatcttgcgcccgctttaagcttccctttacaattgttttgtgctttgtctctttgttgacgtagaaataaaaattgggtaaattggaaccatgccattataaatttgcaaagtttgagatatgtcatcggtatctcaatgacatctagaacccacatgagtcaatgacatgtgggtcaggatgacatatctcaaattttacaaaattataatggcatggttccaattttcctaataaaatttcatagccgatgtaagttggtttcgaatgccacgttaaaatgacacttgtttcttctatgttgtctaatactatatctctattaaaatattatcatctagtgatagatgaacacattgtatttaaatttagagtgttaggatatgtcacatagatatcaatattttgggacttcaaaagtgttttagtgcaattaaagttaaacagttgcacaagttctcttttttgatttcaacgaaaaaatgtcgagccgcttgatattttccatgtgtttcggtagggtcggggcgatcgatatgcaaccaaaacaatcacgctcactgggactgacagaatcatcgagttggtcactcgttcaatgagaaatgatggtcatcacacgatgcaaagaccagctgctaatggatgattaacacgttgtccttccttgtaaccccgccgataagaacgttgaccttttgtaaaaaaaaaacaaacaaacttcgtcaatgacacactattataaagtgtactactagcagtgattcagtactgacatgacagtatgacacattgacacttacgacaagtttaatagtatagccaattaatagctgcaaattatctatagctaatataatatacaattcatacaatagttgtttactatagtattaatatctgatcatacctgtcatacacacattacgtattggagtccgtactgctcttatctctattcatttatctatttaaaatatatatttatagctagcttataggctgctattatacatgctcttacggtagtaggccgtaacaaactggtagctcgtccatgggccattggattttctgataccggcctgtggctaacagcccatctgtctcatccatttttcacaattgtgttgggctagtgcgcgactggaaggccttttgttatggaataatttaatggccctccctcatctcttgctcccgattaaatcacctctctcaacagtaaaaccaaataagtttattatgttgtgcaccagttttgaaagacgagagaagtgttatacccaattttacggttgagtgagacgattcaataaacagaaagacaagagggagacaaacagacttattccttttgatatctactgaggcccaatattggtgtcactcagcctttcgccacagcccagcaagtctcacgccgaactgggccgtatatacggcctgtgggcacactggcgctactagctagtactagtgtgatgtgctaatatgctatgctgtggtaccttttgtattcctacaaatttactgcagcaattttttttgtgtttcaatcaggaatgtaaatgaagtaacgacctttttttaataaaaaaaagacagataaacaagttgccaagcattttggggacctgcatggctccttatattctacaaaataacaactgtaaaatttttgtgtttcactttcaatcagggtcctaacatggagtagtaatatcctccaggaaaacaagttaccgagcaatttgggtgcctccatttccatgcaatgcaagcgtgaaagtgaccatgttattttcaacttttttcgcccaaatattgaaacagataatttgctttacgcttcaaaatatatgttgtctcaacaaaattttcttctactctattacttggacagcttgtattcagctatttgataattttatttcttgaattatttagtttacctatctatcaagttgataaaccacagcaatataatccacccaataatctaaatgaaacataaggattgctattgaaagggaagataaaaaccaaacaccgaatttttaaggttgacgtgaaagttagagatagctagggtcaagaacatccacatcactattcgctagattagcaagcgtacgtccatgtagatgtataatatcaacaccacctcaccacacaacaagttgtgcgaatgaaggccacagaaaacgaaactcaggccctgcactgcattccgatgcacaaaacaggcactaacagggataaggtcgtagctgcaacaaaagtggaattgccttgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19670 - DNA, 73432 bp, Oryza sativa
  unsure (1)..(73432): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagattatcctattaagtttttaaggttttgtaatcagactgttctatataaaaatccatacaatgctttcatcattgcgatagcaatttctgtgcatcttattcgattgttttgtaccagaaataaaaggagtggtccaagccggtttgcaagtcatagtggaactatacatctgttctaccggtggaggcagtatttggatgcgtcatttcacctgagcagatgtggttgtgtgtgttactgtgcatgtgtgtgttgttttcctttttttttcctcttgccctttgttttgctgtttttacctgatgaagtataatgaaatggtagggcagcaacaggtagccctttgttttgctgttttcacctgatgaaatgtgatgagatggtagggcagcaacaggtagccttcaataaaagaaaaggttgctacttgcaacattactaagggtctgtttaattcgcgaaaagaaaattttagggtgtcacatcggatgtttgactggatatcggaagaagttttcggacacggatgaaaaaactaattgcgtaactcgtctggaaaccgcaagacaaatcttttgagcctaattaagttgtcattagcacatatgagttactgtagtacttacggctaatcatagactaattaggctcaaaagattcgtctcgcgatttccctccaactgtacaattagttttttttatctatattgtttttttaaatctatatttaatgctccatgtatgtgtccaaagattcgatgtgatgtttttagggaactaaaccaggcctaattgtgcgcaccatttacccttgttgcccccaatgactcctaaagctgttgactgtacatgcgtttcacacttagtggagttgtaggagaacaagtgaccttcgtgccgctgtaatttacgggtggaataagtcgtccacttcgtttccctcaaatataggtttaatctaatttgtatctctcaaccacagtaatttacgagcagaataagtccactttatttccttaaatataggtttaatataatttgtatccctcaatcacaataccaggtatcttcccccctcctccaattattaaaagcgatctaatttgacttccaaggcattattcatagtagtccacttcatttccttaaatataggtttaatataatttgtatccctcaatcacaatactaggtatcttaccccctccaattattaaaagcgatctaatttgacttccaaggcattattcatagttgtatttgttacatggcttgttcacttggttcgaccagctgaatcattatgagaaccatatgccaacaccacatttttcttctcccatcttttctcttccttgctcccctctcatttcaccacaatgccacacggtgacaggctcgaacagcggtcgacggagccgcttccgcagctgacatagcagcctcgaggcggagcaacggtgacgcagcctactgcaccccccaaggtctcctgtgacggacaaatctttgctgctaccatgtgagcctacttccaggaactcctcaccgagcttgagtgggtcatcgatcttgcccatggcatggatgcattggggcgatcattcgccaaggccatcattgtcgtgaggagtggttcaacggctgggggctcctatatggcatgcgtgtgcgccaaccaatcaagtcattcgcacgttgaccgagctagggtagcggcgttttcccctttccctacgcttcgcgacaaaaaatgttgccacgtgacctatttcacgtcgcgccaaaaaattcgccacgcaaagcatcgacgctttttttttgtttttctaaaatttgatttggaagttcaaacttttgagttgaagttttgaaattgggttgcaattcgcaaatattgaaatttcggctgaatgttttgaaatttgatttgaatattttcaaatctttacttgaaaatcttcaaatctgagtcaaatgttttcaaaaatttgacttgaaagtttaaatttcgtgtttgaagcttccaaaattcgagttaaagctttcaaaatttgagttgtaagatttcaaatttgagttgaaagttttcaaaaatttaggttgaatgtttccaaatttaagttgaaagttttcaaaattttagttgaaaggttcaaacctcacgtatagatttttaaatttctagtaaaaaagggaaaaaaactccttgagaaaaggaaaggttagttaatgattaacggaagtaaaaataaaactaatcatgatttttcctctaaatccacgtgtgtgcatgcctcattgtgtaagaaaataggggtcccttcctcgctagtgggccgtaactgcacacaacaatgtgaccgaaaccatgcatcaaaccattagctaacgaccacgacaataacttgatagacctacagctcgagctccagaaggctttccccatcgaggcgcgcgcgggaggggaggggtggggtggggtggggttggcaggcaacagcgagggcatcaagatttataaggtttttccctatcttgcactttctctgtgccgccatgattggccgtcgtggccattcttctgctcgctgccatgcttgatgctgtcagccactcctagtctacctccatcaacaagttcaagagaaacgagttcccctcctctgagaacgcgttttgacgcactaacttgggcatgttcggcattgaatctcgcttggccatcttcctctctccaccgtcgtcatcatccaatatgtcaagcgctgggacctttaattggacgagtcatatcgtggtacacatcctaacaccgccatcgccgtctttttggccaccgaagcactgacacttgagccccccacccttcccttgggggcatcgtgtcgctcgaggcattcgccacgtgcaactgtggggaaaggagatgagagaaaggaagagaaaaggagagagaaagagaaggcgacactaaccatgtgggccccacacattagccgtttcgaacaggtcaacgagccacgtcagcaaatactctttggaaatcaaattacactgttttagtagttcgagggtctaaatatcctgtatttgggttgagttatatgaattagattggtgaaaacgtacaccgaaggtccctcaacttatcatcgagttacaaaatcgtcccccaaccacaaaaccaaatatctggcgtcccttaattaattaaaaccggtctcaataggtccttcggtgatttagacccggttttatcctacgtgacagctgagttagcgtggggcccatgtggatcccacatgtcagcatcttattccttcccctctctactgccctttccaatcctctttccacgggcgacggacgtgcgcgggacggagaggctgggcgcggccggcgcccgacgggaaagaactgggcggcggcggcgggggaggagctgggcgtgagggcgatcgcggtggaaccgtgccatcctagcctcgcctcccgcgcgcgcgtgccgcacacgcgctctccgccgcgtgcgcctcgccgtgcccccgatgcctaccgtgcccgcacacgcgcgctccgccacgtgcgcctcaccgcgcccccgccacctaccgcgcgctcgcggccgccactgccgagcaaggcgaaggcgccatggaggcgctcacgcaggcactctagttcgtggcacccgcgtcgccgccgtcgtgatctctctcctcatcgtcacgacgtcatccagttccaaggaaggatctggtctgtatgtctgtacatgacttttttttttttgttttgctcgggctagcttggccattgctagtgaattgatggtgaaaatcaaaaataatttattgggtaggtctggtgttgctgccgacgccctcccgcgaccaggcagcggcagcgttcggagggaggcgaccaggctgcggcgacaaacggaggggaacacgcagcggggaacggaggggaacaagcggcggggaacatgtcgatctggccaatgccgaggttggtgggtaccagcgtggggttcacccgctcgacggcctggtactgcttcaagttctgcagcttggtggtggagacgatccaaaaggtgtcgccggcgttgatctggtactgcataggcgagtatgcattgggcgagcgggaggggcacccgcacttgagcggcaccagcagcggctgccccgccgcccgcgcgtagccctcccccgtcgccgcctcgtgggtctcgtcccctccctcctccgcgcacccatccgcctcgtgcgacgccatcgtcgccgccgcctcctctcccgcattgcagaacgcagagcagagaagtgagagagagatgagggagggagagaagaggggaaaagacagaggaggccaacgtggccccgctgacatgtggggcccacgcaggtcccatgctgactcagccgtcacgtcggataaaacggggtcaaaaccatcgaaagatctaaagtaacggttttgttagttgagggatgcccggtatctgattttgtgtggttgggggacgattttgtatctcaacgacaaattgagggatcttcggtgtactttttccttagattggacctaaatttaagggagtaaaagtggaccttttctttcgcgggcatcacaaaagcactggcccgtcggccaatttggttatcccaagcccactgggcatcatgaaagcactggggaactaagttcacttagggtccctctatttatcgcccagtccgattttcgtcccttgaccacaaaaccgggtacaacccgtcccccaacatacgaaaaccggacaaaaaaggtccctcggtggttttggctgacatggcacctacgtgtctaatttgacccggtcttcatctgacatggcactgacgtgccgcttacgtggcaattcgatccggaaaaataataaagtccgtgggacccacatgtcactttcacacacaaaataatactccctccgtccaaaaaaaatgcaaactctgggtttccgtgtccaactttaactgtccgtcttatatgaaatttttttataatttgtatttttattgttgttagatgataaaacatgattaatattttatacgtgacttgtctttttaatttttttcataattttttcaaataagacggacgatcaaacgttggacacggaaaccagggtttgtattttttcttagaacagagggagtaaaaaaatggtgggacccacatgggccccacatgtcatactcacccctcatcttcttcctcctccctctccatatcccctctctccatctctctcccctcctctctccagcctccaggtgccatggcccacggggacacggggaggtccggcggtggcggccggcgacgcgacagccgcccgccccgacgagctccacctactccccccgattggcgttgctgttgggatggaagttgcgcatggcggccttgtacgccgaagtcagccttccacttgaggagcacgccgtcctcgatgccgagctcgtcggttggcagctcgatgtggaggcggtgcagacctcagacggcgagtggtgtgagacgtccacggcggcaggagtggatggcgtcgaagtcggcgccgtccatgctcaccagcctcatcgccgggatccccagcttctcgtggaggtatgccatgcctcgcaccacgccgacggcgatcctcatcctcgccggccaatccagcaccaccctgtccgggcgctggtcacctgaaccaacaaacaaacacatcgtaattagcaaactataatcgagattagtagttgattaagaactactagtatttgctgtgattattattaccgtggaggacgtagaggaggctgccacgtggcatgaactcggagacgatgagcttttcttccctgcggtaatggtagccgacgggggagaggacgttggggtggcggaggtcgccgagcatctggatgtgctcctcgaacttgacgcggttcatgtcgcgcatccgcttcacggtgatggtgacgctgttgcgcatggcggccttgtacgccgacccgagctccccaccctcgcgcccttccatcccaacaacaacgccgataacctccccgtgacctcgtgggccatggcgcctggaggccggagagaggaggggagacagatggagagggaggaagaagatgagggggtgagtatgacatgtggggcccacgtgggtcccaccattttttattattttgtgtgtgaagatgacatgtgggtcccacgggttttattatttttctgaatcgaattgtcacgtaagcgtcacgtcagtgccatgtcagatgaagaccgggtcaaattagccacgtaggcgccacgtcagccataaccgctattaaaactgtcgagggacctcgtttgcccggttttcgtaagttgggggacgggtcgtacctggttttacggtcaagggatgaaaatcggactgggcgacaaatagagggacccaaagtgaacttattccaagccctggagtgtgggatgcagcgcaggccgtcagccgaggccttttggagtttggacgtacgttccgaggaaaccatccttttagaaagactaggaatttgaactcaatttaaatttcaattttgtctgtacggttgccggttaacggtaaaattataaaagttgttacgttctggttatcggaacctgctcaaaaacagccaagaaaactctgtggtttgcacaaacgcgatggttctcttttgccatccgaccaacatcgaacttaagcactcttacaacactagcaagttaacaaaggcactgtcaaaacacatcataaaactggagggcggcgaaacggcgaaacggcaaaaacaggccgccctcccgagaagaaatcacgccatacaacattacaactactgcacacaggcgagggtaagtaaagcactagacacggggcccgtgatcgatcgattcacaggcccggtaggtcgaacacggcgttgctgaccgccatccccatgaactccatgctgccgtcgaacgctcggccgtcgtgcgaccgccggtcgaccagcagtgccctcccgatgttggatgggctcgacagctgcgccggcgagaagctcggcgtggcgtacgccgtcgcgtacggcggcggggtgcccgaggtggacaccaccgggtacgccggcaccgacgacgccgacatggccggcatgcaagagatcttgccgctcccggcgcccgcggttggaagcagctccgcctgcctgctccgctcgtcgacgtacagcaggtcgtcgatccgcgcgatgatgttcgacgccaggctctccagaaccctcgagtagctctccagaatcgatttccccacatcctgaagagagagtcatctcacgatcagttcatccaaacccgatcaccatcaacacggatagcgagatttgcaaactgcaaatgatggattcaccaaccttgttgtactgaatcttgctcgtgtccaggctggtctgcgtcagtccggggaacctctgcttgaggcacatgaggaggccctcggcgcggtcggcgaggaggtcgtctctcttctccgtgtccatgatcatgtccttgacgatgccccatgacgacttgtttccggcgcggctcgcggcgcccgacgtgcccctccggcgccacacgtagatggaggcctcgacgcggttggcgatctccagcgcctggtactccgacgacaggtcgaggcagtcgagcaggcagtccggcgagaactggtccgacgtgatgtacctgtatatgatgtcgcccagcgtcgcacgcccgttctgacaatcaaacatcaatgtcagaatcaagaaacagcaaacgttcatgtatgatgagcattagtgtagttttcttttttctgataatttttacagtattctctacggaaaactcttttaatcacccaagtgaatgcatgtcatctaaataattataaaacttttttaaaaataattaaaaagatagaacaatatgtaatatatcactccacaaacatgtaagttaaatttcaacttctaaaaattgtaacaaaaacaacaaataaaacttaaattagtatacgtatatttgcaattaaatttgttattttttataacttgtaaaagttaaattcgaaattgtatgtttgtggagtaatatattacatattaatctatcttgttatttttttaaaaaaaattcataaccatttagttgcggttgattagaatccgtctcctattctctacaggtagtagaattgatttggaccttgggtaacgagtcgaggtaagagtcggggacgtccatttcggcgagggcgttgctgttgatggccatggcggccttgaggatctggctggcgcagtcgcgcttgtgctcgagctgcctcctcgtggtctcgccgacgccgccgggagggacgcggggcacgggcagccaccacttctcgtcgcggcggtggaacgttagcatgaagggggcgctgccgtcgcggtccggcgggcaaatcccctggtcgacgtaccagaattccgggtccctgaagctctccagaatttcctggcagaagatgtgctcgtttcgtcaggagatgcacattattacagcactagttcatcttttattttcggatggatggacagatcgttgatccgagatagagttcgtcagacttacgaggagcatgtggtctagctttcggagtgcgggcagattgatgtagagatcagaccgtggcctgcttgtcatgatctgaagtagtaatccacatgtagagtaacagtcagtttatcattgttctcaccacaagttatataatgtgtctgtgtaagagttcataaaaaaaagaaactgaacatttccttgccaaaaaaagacctgaacattgcattgtcgaataaagttggacactacagaagaaagattggtgtaaacagatgcagcaagtgggaaatgatggatctccatttgatctagagtagtaatggatcacgtttggaccggataatttgaggacaaacaaatcggacacaactaaacggacagcacattgatgtggccttaactcttttgggcctcagaaatacggcgtcgcgcgcccaactgtttcaatataaacgggattactaagtaccaaacggctaaccacgtatttaatgactatatataatttctttttgtggtccatatgttcatgtaaaattcaaatcgaattttgcactcgcttcatggttcatccgtaggacgccaaattaaatcttgcatctgctactcagtgctcacgaacggcccgcactgatgatcctagtaattcctgtatcactcctagcttaactactgcagaagtgcagagtaaatttcgtcaggggaagtgaagtactagtatacctcaagcttactcccgtcggggaatgtctgccatgtggggactagctcgacgatgtggtcgctgacgcagagcagccagtccatctcgcgccgccacatcgtctttttctccggcagcagcggctccagcctccacagctgcccaaatatcgtcgctgcagcaacgcaactcagctcagcctccatgtccgtgtccatgaaaccgccgcattaatcgcaatgtgcaattcgaaacctcccacttaccgcagaggttggtgatggcgttggagatggcgagcgcggtgcagacgcccttgccgccgccggacatgtcctcgccgagcagcagcttcgcgaacctctccttcatcatctccatctctgcagccaattcaattaatttaaccgcgtgtgttggaagggaggagtgaactggggatttgcggcggcggcgcacgtacctgagggccggtggtgcttgtccgccggggcggcgtcgacgcgcggcgacgacggcggcggcggcggcttcttctccttggccggctcggccgagacgacgacgaggtcggacgacacgcaggtcttgatggccaccttctgccactcgtcgggcgggcagtaggactcgctggaggcgtccccggagcttgcgctggagctgctgctcccgcggcggcactcctcgtcggccgacgagtccgccgtcagcgcctcgctcacctccctctcctcctccgccgcctcctctcctcctcctcctcctctcgccatcccctagcacaatgcgcccactggcaatgactagctagcttcttgacgacttggccgacacgaacacgacggcgccgccgctaggtggtgcgggtgccagggctagctgagagggacgcctcgggggtagcaatggtgtttttgcctcgttgtgccagtcgtgactcgcttggcccgtggctggccgtggttgcggttgcggtggaggagaggaggacgggggaggtggtggtggtatatgcatggcgcggcgagcgcgaggagtaaaggcttaaaagaggtgaaaggcgaggcgagtgaccgttggattttgagtttttttggtgggcttctactccttagagcaagttcaatagtattgaccattactagctccaattcatctatagtcaatctaatagccaattcatacaatagttgcttactatactattaatatctggttccacctgtcatacacactatatcttagagtccgtactgcagctggctacagatctgtagcccgctgctctcctctcttctctattatcttattaaaatatgttgctagctggcttatagcctactattgtacctgctcttactgctactgtagtgtttgttcccttttcctttttagcggcaacggtcagtggagttcgggaagcgtgtgtgtgacagagtaggtcggcggcgtggcagctacggctcggacctttcggatggttcggtcggtcaggcgagtcacttctcgtggtcattttgctgcggccgttgtatcggcatgtgcaaccgtgtagggataggtcgatgggggagaaacaaacaaaacggttgcagcatctgtacgctagaggggccgttgattcctcgttggcttaatttagtggcgttgaacgtgaccaaacggtcaatttctctagtgggggtagtagtattgtttccgtcataaaataaatttggtttattttttcaccatccctatataccaatacaatattaaaaatataaaatacctttactttatcaaatctaaatgtatttatttatttattttatctactcaaatgtaagggtgaaaacgggtcgggttcgatcggatctcacccttctcatatcctaacccacattttataatcagaatcgggtcggacatggatagtgtcgaatacggatataaactcggataatgtcgggcaaaaatacatagcgaatacgtaccaaaatagatatgtacactattggttacaaatttttatttggatatcaagtcgaagaaacaatcttatatatcacatgggcaataaccatttaacaattctatttatctataatacggttatattagtccattagtaccttaggaaataaataggaaacaatacatcgtaatagaaccaatacatagtaccaaaaatttcctcacaaaaacataatatgggtaatatccgatttttttaccggataatccgtatacgtcggatactacgttcccgaacccgatctcatatccgcaaaaaagacccgtattcggatccatgaaaagccccgggtaaccgaatttgtcctgaaataatgtggccgggcgggcgggcaggaaatacccgcccgtttccacccctactcaaatgcattcatcttttgctttcacaaattttgatacaatagtaactacaaataagcttataatagaacaaatagcagggataaagataattttatttcagaacagaggaggtagtagtctgtaatctgtatgacagtagtttattcattacagtgatatatgctgctgtagtggtacgtactagtatcctcttggcggatacagagatctcttgcactgcactacatactcatataccgcagacaagcgtgcagctacagtaaccgactacatgtaacagtacggaagcactgcagctacgttattttttgcacagtttgtcggagtggcacttaaattgacgtgccaagtgatgatacggtccgttggatgcggattggacgatctagacgtacgtgttctaatgtccggcgccgaacgtctcgaaccacggcagaggatcgtgctcaccatgctgctcttgctgcagcgtaatccctcaatcctaaaataagatcatttttatcctcatcttatttatcttaaaataatttcatctttaagctaccactatataaaaaattatgaaagcagaggacaaatatattaattagaacaagataaaacaagagacaactgcattaacattgaatataagtggtggctattctagtcttttttttattgttggtatgtgtcagatagagaaaaaataaatgttatttcggggtaaaggtagtactgaggccatggctaacgcttcaagctggagcttggtctcactccccgccaccccccgcccaaggaaaatattcatgccagctaggagggacccgtacccccgaaggagtgtgtgaaccccaacaaattaaggtatgcgtggtttctgtgcaagaaatgggtggagaaacacgttggggagaggtctcaccctatgccaatgcctcgtgtcgggtagctgccaactaactcccgcattgttgcccccgcgaacaaggtcaaggtcgttgtcgccatgtagctttggcaagctcgaggtcggacctgacaacaacaacaaagatggcgagggggtggctggggagaggaagggcctacccagactcatcatcattgatttgcagtggtgttgactactctattgcctcgaccacatccacgatagatccgccaccaaggccccgtcgaagagcacgaggacgcaccaaccccatatggttgtcttcgcctcgattcacgccgcctagaagttcgtcagccagcgaagcacaactggaaccgtattaggaaggaccaatctaatccggcgagaccgctggcacgggagagggggtggggagttcgagccaaggaggagggaggggatcttagcaatggcgccaaggagaaggggtagtggatagacgacaatgccgagaaggagagagggtagaggttgcgaggcactcagaaaaggtagaagggcggagatgataaaagggtaagggtaggtttttggaaaaaaaatttgaattgcgccttctgaactatagtggcagtactaattactcccctcaattcaaacccagatattcttcatccttaacttttcataccgaacgaattacctccatgcccgacttcggagcggttttgttcctacgtggcacacacgtggtaatccagttagcattaaaaaatatataaaaatggtgaggcccacttaccggttttgcctcttccctagatcaccacatgtgggcattaccccttttttttatgttgattagactatcacatgtgtgccacataggaacaaaaccgctatagtgtctgtcaagggggtaattcatccaattaaaatgtagagggtgaagaatgtctgttttttaaattgaatgggtggtaatttgtactaccacaatagtttagggggtaattcaattttttttcctatgttcttatataagattctaactataaaatgttggacttatatatgaatagaaacaatctaaggatttatacataaaaatgtaaccaaccgaggggtaaaaaaaatagcacgtggctaagacttatattgtgtggagaatgttaggccatccacaatcggtgtccctgggtcgtccccccgctcacgccgtccgccgttcgtccgcgcggcatgtctctggagggaggcgcgatccccacgcggggaacgcgcccctctagctccccagcttgctttttccagagacactccctcgaggctacgcgttgcagcgactcggtgcctcgtcctctaccttctctcctggcgtttccccttcttgcccctcaccggcggcatgacaacgagagagagagagagagagagagagagaagagagaggcgacggcgataaggatccacaacggcgacgaccagatccggccaccgccgcggcagccggcggccaccagctggcgacgggctcggcttccgcgacggagaggacgacgatgacccggcgacaactgcgcccgccaccttgacgccgccgcgcccgcccaccagatctgcccgcctcggcgccggatccgcctcctccggccaccgccggcgctggaaccacttcggcgacgacggcgggacgcggctggcggagggaggaggaaggcggctgctagagagggcgaggagggaggcggcagcggtggctggggagggcgaggagggaagtgacggcggcgagcggcaggggagagaggagggaggtggcggcggcaggctgggaggcgggggcggcgaatgggcgaccaggagggcgagaagaagaagcgagaagacgcgagaagagggggcggaagaaaagagaaggaaaaaggaagaatggactgggggaggggtatttggggattttttcatctggggttactttgggccaagacacccattatgggctgtagtaccctcatcggattgcttcaaattttgaggagcccatccaaggatacctcccattgcgagctgagttttctacgagtgtcctcagttagtgaggacactttaggagtgtctcacattgtggatgcccttataacgtggtttcgttagcaacgtcttctctctttttctcgttatagcttatattgaccatgcatccatgcctaatgttctctctaggcaaaacgctccatttacgctgctggtagtgacttcgaaagctgagttttgaaatccgggagaggaagaaagcagaatggtgtgggggcgcacggttgaactttgaagggggataccatctgcggatcaggacgcatccactgtcagagaaacggcgagggtggaagcgaaaaaggcgagttttgactcggaagccgcgctcggcgaggatccgaacttccgaaggcgacgacactacactatccaccaccttttgcggcgccatgaaaaatgcatcccgcgtcggacgctagctgccgcctcgtccaccctactccacacgtcgtcgtcgtccccccacccacgaaaaaacgcgcccacgtcgccgagttgctcgtatgcatgcaacgagcgcatgcgagccgatcgagcgcgtattgaaaggggagccatctggtgatatggaccatatggcactcgtcgcacctaccccgttataaaatcatcaaaacttgctactgcggccgtgctggtccagttctttccggcattctactctttcccaagtagtcctgtagcattttgataaatactacgtattgccgtactgctagtgttaataacaagagatctccatatatacagagaaggcacgtaaaacttctaaaaaagtagactgtaaaagacggcgccgtgagtttttttatttaaaaactttcaaatgtaacataaacctaaatataagatatcttcatataaaggagccacataaacattagtaaaaggactattaaaaaacggtcataagctttttaagttgaatactttcaaatctactgctcccatcgtttagcggcatatttacaaacgaaaaataatttgtgaataaaacttttatatatatgtttttaacgaactaaaagcaaatactgataaataaaccacaataaaagaaaccctaaaatcgttaaggttgaaaattcaaattttaattaataagcatacacataaacgaaaagatgagttcgctaatgttgcagtgactgatcgtgattagtgctcattaagaaggaacgatcaccccccggggtttgggcaaggtcgatcggaaggtgtttggttgggaagcaatcgatggatcgaggcatcgagcattcgagcgagccagccagcaactggccggaatgatggggaacgggggccaccccatcccccctcgtggcctcgtttgatgatctatggatcatggatgcaacctcctccagctttacctagctactcctactagtagtactaccggttggtggtgggtgtccttttgctgatgcgccgaagcttctcaaaatttgcagcgactgtgaaacttctgtaaagtagccctgtgcgacacaagatccgcatcgcccaattggcgtactgccagattacctgcacaggccatctaggatgctggaattttccatccacggatgattggatgagaccaaaacaagagttatagtgctcctgtcctagcacactattgctggtccagaattgcgtacgtagccggtcccctgaggccgtgaatgacaaaattttaggcgcctcataaacaccagcgagagcaatggctggatgagtgtttaaaagtgtttttcttgttcaagcaaggacagtgtgtagcgtgacagcacggcgctgtccagccacacggtcacatgtcgtacactcgtataactcacctttaccggtcttgaatgggctatgggtcacttcgaaaactccgtacatctcacggatgggatggatggtcatcactcatcagggtcaaaacctctttgcttaattaaacaagacaatcaaggagtagctttggttcagtaaacgggagatggtccaagcctgcctactaactcggcagctagatccaaatgtatagttaagtgaataggacttcctgtcctgtcaactcgaaagagatttttttttttttcgagcaagaagagtactactgtagtgcacaataacaagtgctgtcgcatgagtgctcactactcctagtaataacggtgctcaccactgctcctttgtaccctgtatttttgaacagaatgtacttcaaacaacagtaagtactccgtggcagtgacatgaagctctctgacacgccgtggtccggcgaaatgccgtccgtttccgcggcgctggcgcatcggtcattaacggcgccttcgaggaattaccagccgtagttaaaatttaaatattaactttagagttgattttgattttttttttatcttttactttactgtctccttccaaaatctgataactaaaatttgaatttctaatattactttactgtctcttttgatgtttttctggttgtttgctttactgccattttgaactctagtaaattttgttgttattaatttttataggatgacaaactaaatatgttgtttggaagttccgaaaattctcttataaaaacatcaccaaaattttaaaaaggtttaaaaactaaacatatttaacaccactaaaatacagtaacatcaaaatatgtaccaaaaattaatattggtaaatattggtaagttgattttagtaatacagtgaataaactcttaattgtggtttatttttcaacattgatttttaagttatatgcaaaagtcaaaagttttacttataaattacctttttattgttcataaatattaaggtctataataaattgtaagttaaacgaagagactggtaactaattagtgaaaagatggctcttgtcacctaggcatttaacttttttttgtcacttttaagatatggcaattaagaacttgccactcataatatatgacatatgagttcttatgtgtctataatatttgaatctaccggcaaatagttaaatatctcccggtcacctggtacttcggttcacatggccgtggcgttgcacatggggcactgccgcctgggtgaagtgggtgactgggtgagtaccacggtgcaaatgcggtagtccctgcttgcttgctcgaggacggtacgtacgtgcaaatgtgcaatacgaggatttgagatgtcagtagatcttctggggttaaaattaaatggaagtccggagttatttattgtagtgaaatggtatacgtgaagaaattctgcgagaatattctacagaacagtatagtgaagttcactatgatttcttacattggatctcatgtgatgttagttgggagtaaatatttcataagtacgtgccattgtatgtatgtgccagtagttttaaagaaactaactatattttttacgccatatttttcataaaaaccagttaaatattttaacattgtaaattacatatacttgcactataatttttacatatctttgatttttcaaaagaagataaaagggtaaagtgcaaactgacacacgagtagaagcttagtaatatttgtcgatagagcagagtagatggatacaacacaaggagatagacttgccaaaagatccatttggtggaagacatcaataagcaataggatgacaaatcaactgagatcgattagaaaaaccgtggacatcttttagcaaattcgtacaccgaagggccagaacaggattaatacgcgtagctactcaccataattggttgtctcacaaggtctcgatctgttgtcaaacagggtactatagcagttgaattcgacatgatcccacaatcactattcatcatcaatagtgatttaaaaaataaaatcatagcagttgaaaatttcttgatttgggttttatggggaatttttcacaggatcggttgctatccgtcgaagcaatggcttgtccccaaaatataaagttttgaactcaagtagtagtagttgccaagctgcaatatgattaatgtgatctttggaaataagagctgatgattactgattagttctagaagtaagataaccaagctcttttttttttctgagcgtgatattttttaacgtactggttttctaatgattcaggagtccgtggacctaacaagggtaggaaaagacattcttcacttggaagtctcggatgcagattatatataggtttagcacctaggctttgtcattgtttggctagtttagcactaccgcagtagtgtcaaaactatgtagacatcatgtcatgtcatttggtagccggtgaccaaccttaggttcgtctacaactgggacaacagatacataagtatcatggcccacaagaccacaagttagttgtgcccaagaataccaaaacaacagagagaaaagaacacggagtaaagttgattgcttgtttgagcgtatatgtaggattttggcgttgggtacagggtacttggttggtggattttcaaggttgaaatgaagtagtgataatgttcatggaccacacaactagggattagcttctcaagtcaccagcattaatttattagtcgccataaaaccactcgacaaagtaattgtacaaagcatcatccatgcgaagattagataaagagatagcagtgaaacacgtttgggcattttcatttttaagaagaattgggtaccggttagatttggaatgatttatggtcctgtgaggtagttagcattaaccatgccctcatgaatataatgatttcgaatcatagaatgacacaactaacatgaatatgtaatatgttcaacaggagctagacagctagcggctagcgctgcattataaacaagtgaaccttcaaggtgtcatgcagatattatagacgtaaaagactgcaacttttagagctcagttagtctgatgaaagtaatgccagtgtgcaagttaagttagcaagaagaagagcatctcaagaaacttgtagtgagtaaaagaagataccaaacttaactaggtgatgtatggtgtactacgcctttgcatgaaagcaggaaccgtgttcaccattcttgcttggaatcagcttggttatgttttctgactaattccatatccgagatccagaactgtagttttagcaaaacgaacacagcagtcaatcaaactgcatttatcagaacgcatgaggcttctccaggtcttcatcaccagtaaacactaaaacagagcttgttaccttcctactccagtaaatttaggaagatttttgtacagtgtacgaagtttcgattttatcaccaaataatacaacatgcaaagaatggtcacagtgtagaacaaacttaaattcattcatctaaagctagacatcactgaaatggataagttaggagcaccccggtacacaatcccctcatatatgttgcatcataccttcacagctgagacagcatatgttctttgattttcacataggctctgtcagaatttcagtagtgtttaatccattggatagcaatgacgaataaatgctgtagtagagtcatatcctcagttacaatctgcaggccagagatgtatggtttgagaaatcagatcaaaaacacaaacagtgtttcagaataggtgtctattagaactggtaaattcaatatatgcatgttgtggtgatagttgaattttctttcttaaaaaaatgtgatatttaactatttatatgtgtaaaatgaaaaatattcatcagtaaccaattgaccatcaaagccttttctgatataggacatgctagctctggtcatctgtcaactgtcatcatgaaacgtgtacatatattgtaaggtagtgagtaatacctattgtacaccatatgtgatctctactccagaaactcttccataagaccctattgtaagtttgatagaacattattagcagatggaataaacacactgagaatatcacaaaagtaagatagcaaacctgtgatataaattgttcagtatcagtgcgccttaggaaatgaagtgagttctttgtcaatgatatggaatggtcaccaagagatacttcaccaatgtcctcaagcacccgaacctggatgtagggatccttgggaggcaccatgtcctatagaagtggtacagaaaatctgctaactgtatttcatccaaaagaaagtaaataaaacagaaaaatgctgtaccactgttaaatctatatccatctctgacatatatgatttaatggctgctgagtggttcttgaagtactctttctcagaaaaatggagcttttcttgtatttcatgaggaagcactgggccgattttccatctaaagctctgaataacctctgctcggttatacctgattgaactcagtgctttcagttccatactcaaaattagtgcgtgcatgtaaaatcagcataaaacatagaaagtaaaaagtttgttcagctgtgagatttcagtcttgtacatgtaagccatgagacatcttttgttacgaagcagcgaaagatgatggacggctgccccatagtggtcgtcatttctggttgtttcaatgtctaagttctgctccaccattttcctgtcataaacacaatgcaaatcaggcaatcaaaattaagtaaactgtaatggtgaagaagtcaagtaagagttttattagtttgatatagttctgtgctgtttttcctgtgaaatacatcctagaaattgattaattgatcataactcttattgcagaactagatgaagatgatcaattttctgataggaagcaatttaccttatcaatgactgaaactgtgtattgtgttcattgcactctctaataacctgatcaaacacatcgctctgcacatccataagaaaaagaagttagggaccaagcataataactaaccgaactaattaaactatgctgccacagtcacatcacaggaacggtaatcttaacttacattaacccccaccagaccaccagccccagactttatgtgctttcatgtgattgcaatttgcaagctcagtatatttcagaactagatttcatcatcaagatagacaaatgaaagctcacaaattacatacaattttgcaaaccagaccgaaaagccaaatcgtttaaatttaaactgtcgcctgatagttatacaccatgcagataacattccccccgtaggattgaaaatgcacatttatgaactcaatttcaactatgcagctagaccaaccataattccgccctaaaaatagccacaaacgaaacctaatcaccggccactcagatccccagagctaagaaacgcgagcgcttaggggggggggggggtagaaacttacgttgaacggcacgagctgtccggcctcgcaggagtcgacctccttcagcagctgcgacgcgcgccgcccgtacatcctcctccagcctccgacgcgctcgaggtgttcgacggaatggcgctaaagcgcagggccggatctgccacggcggggagaagcacgagaagcgggcggcgggcacgcgcggctggcggtggacggggggcgccgccgtgctagggggcggtgcggggcggagtggaaggggaatttttggtgcggccgcgcgggaaaaattttcgaggaaatttgggaggcgggagtgtacggctgaagggaggggaggtggaaggtggcgggttggtaacggggccccgcccgacacccggtcgggcgtgactggctccgacgggaaaagtagataggagaaaagatgagaatgaggatgacatgtaggtcccatataggctccctcatttctaatactccctccattccaaaatataagcatttttagctatgaatttgaacaactatatagctaaaagttgttctattttaggacggatttagtagcaacttaggatggggtgagactatgtccagattcgttgtcctgaccttatcccatcctaggttgctatattctgggacggagggagtactaggcgttttgttttttattttttttatcgaattatcacgttagtgccacattaatgtcaacatgggacgaacacctagttaaaagagccacatagaccaatgaaaaccggggattattctcctgagggattttttttcactgattttataagttgacggatgcattatatccaattttatggttcaaataacagttttgtaattcggtgaaagatttccgtgtactttttcctagctacgactagctgggagcggtggaggaggtagtgccgatgctcgtgaaagggcctgtttagttcacgaaaagaaattttttgggtgtcacatcagatgtttaaccgaatatcggaaggggttttcggacacgaaaaaaaactaatttcataactcgcctggaaagcacgagatgaatctcttgagcataattaatccgtcattagcatatgtgaattactgtagcacatatggctaatcatggactaattagactcaaaaggtttgtctcgtgatttcccacctaactatataattagtttttataatctatatatttaatgctcaatgcatatgtccaaagattcgatgtgaagttttcgaaaaaaaaattggggaaccatgctcgatgggccaaagttggtcgatgggccagtgaggtggagccatgctcgggatgggttgggttaattggtaggaccgtaggaggcgttatatctagtaggccttttgggctggtatgtctagtgatatttttttttggaaaaagtacaccgaaggaccctcaacttatcatcgagttacaaaatcgatcttgaaccgcaaaaccggatacaacgcatcccctaacttataaaaccagtgcaaataatgtttctcagtggtttcgactccgattttatcctctgaggcggctgaattagcgtgggacccacgtgggccccacatgctagggtggccacgtcatcatccgcccactttcctctctcttcctcctacgcagagtatcagaagcgcgcgacggagacggcgaggaggtcgacgagcgacgaccggaagtcgaaaacccacacctgcgcgacgacggcctccacgaacgacgcgtccctggcgcggaggtacgcggagaggagcacgaacgggagcgcgaggtcgagtatcacgacgagcaccgatttttgatttggcttggattgctgggctacgttaaggccgacggttgaaagggacgaccgccgcggccaccgcgcgacgacagccatcggcggcgctgcccgtcacatcggccctcctcttcgctgcgctcctcccccaccgccggccacgccggccctcctccccgccgcatcgaagacgccgccacccaggggaaaaaatgagagaggaaggagagaagaggggaaagagagatagaggggtgacgtggacaccctgacacatgggtcccacgctgacttagccaccacgtcagacaaaaccggggtgaaaaccacctaagaaccttaagtgaacggttttgttgtctcatgtctttctatcattatcagaaattttgaacacctccccccaacacacacacacatgcacgactagtttaaattaggtcataacagtataaatggttgattttactgacgtgacatcctagctagcaaggagtaaaaaaggtgggacccacacgctttctttttattttagttttgctgactagggtggcacgctgacaaaactaactattgatactatcatgagatctaatttaacccaggtttgtaagttgaggggttagagatttccgttattacgttcagggatatgagttaaactcggctaaaagatgagggatgtatagtggacttattcatttccccaattcttcttttccaggcccaacggattgatttgccataagcaatgaattatccttcctttttttttttgctaaatagctggatggttttgtacggtgtgccgctaaatggaacggaccaatactccaatactacggcaagttcagtaaattttcccataaaaaaaacctctcaattttgtttcagcactctctctgtgcacttgttgatcttttctgtttttgttctggtaagtagttggttctttgttgcaaacttgcagccgttgtggtatgtgggctttgctcagattgatgtcattttaaatattcctttttttttagagttatcaaatatgtgcatccatttaattttttagtcaaactttaacaaacacataagaaatcctatcaaaattttagcaatattgctaaattgccaaaaattaggcattgccaaaatttggtaaagtttatcttggctacaatttaaacatcccttgtatgtttatttttcttttacttgtacagaatttggacttcacagagttaggtccaacaaaactaggcatatgaaagtaaaacctcaaattcggtctatatatataaagtgattcacatggttgagcacacaagcatggactgtttgcaaagtgaactgtctagaagaacctgggaaggctgcaacattacaaacacaaaagaagttccatacacgctttattcagatacagtagcaacagtaacagtatatccactcaagtcgaatcatcgatcacttccccttgacgactgttacagggcatgatgcgtttgacagcacgtagtttgtcacactccccagaagaatcctgtaaaatgttggcagacaggaaagttgcagatgaaatcataacgagctaaaaagtcgatgagactattatatggtgtgctggattcaattcagaagctagagaatcactaaagagttggtttggtttgtggtctaaataggccttaccaaattctatcagtaccaaaatttggtaatttttggtatgactaattttggtaagacaaagttgtgtttagattgaagccaaaatagtctaataagttcattattgaaatgacctattttcttaggcataacaaaatttggcttcaaaccaaatagacactaaacactattgaaattgccaaatattggtaagactaatttaggcatcgaaccaaaccagccctaaacaaatactgccatatgcgcaaagcgtatactcccaaacgttcattagacatcgcatcttcaaacttcacaattttctgttctgaatcaagatgacaatagtaagtttcaagctaacaatgcatatcatccactcaatatgttatagactaaatagttatagtctttggacgtggacactaacctaagaggctaaaaccaagataatcacgttcctgtatataaacttctgtatttggatattgaaatagcacaagcattctagttgttgaactaactctatatatatacatcattcttatgctcaaactgtacatgggaaacatttgaatatgaaaaggagtttcacatgagaacataaaacaacgcgccgaccaagaatcaggatatacatgtctcaaggatgaacatgcgactttagagcaagtttaatagtatagccaactactagctccaattcatctatagccaatctaatagctcatttatacaataattacatactacactattaatatttggtcccgcctgtcatacacacactgcgtcttggagttcgtgctatagttggctacaaatctgtagcccactacccttctctctcctcatttatcttcttaaaatatatttacagctggtttatagccagctattgtacttgctcttacaatttattaatcgtgaaggcaacaagttgatgccttggcggtcccacagaaaaaacaagtgcaactgaaatgctcgataatccaatctcattggctgtaatgattcaagttgcaaggccaagtcagatacgcatttggcccccaaatttccagtgcaatgcaattatgtgttgagattaaaaactaccgtaccacggaactggacacagtatgtagtttaattatcgatttaagcagtgcatcgttctcgacagagcttgtctatctgaacaggaatattagcaactggcccaaaggcaagttctatggtcaatgcctgcaattttgattcttgattgatgaggcaacaacattgcaaacagaagtaggagttatacctctggatcgagccgaggccgcggctgcccatgacgagcgtgtcgatcttctgctcctcgacggcgtcgcagagcttctccctggcgtcgccccagtacagcttcgccactacggtaagctgatcagaacagcaacaaaacagcggtcattttcgtctccgatccagccccaaaaccgtgacgctactagtactacacgagagcgcacgtacctccaactggcgcgccgccgtgtcgagcatgtcgagcacctcggcgtcgcagtgcacgccgtactgctgcatcgccgtcggatcccggaactcggagagagggatcagcgctggaggaatggaatccactacattagtttgagccgagatcgatcgagcaaaagcaagaagcagaaagggggaggagatttggttcgcggatcttacgggatccggacttgccccacagggcgtgcttggcctcctccccgccgtgatgcaggacgtggaggacgacgaggtggtcgccccggcggagcaggttggcgatggcccagtccagcgccctcttgctgctcgccgagtagtccatcgccaccccgatccttcgctcgtcatcggccctgccgccaccggccatctccgtcgtctcgcgatcccaaagatcaaaagttccaaatcctctcctctcctcacctctctcgctaagcctctcctctctcctcgcttgctcccttgctcgtgtgacgcgcgcggcgaatgtggcgagatggagacattggagtagacgatcagcgtggtataaaaagggaaagggcggggcgcggggcacgagacgcggggtggcgtcacgactcacgactcatcagggaggcgtgtcgcgcccaagccgctgcgcctgcgcgccgtgggggagcagcgtgcacagcagcgcgaggcgaatcttcgcacgctgtgcgtgacgccgcggcacggtgcggcgcggcggatcggtgggtggggtttggtctgtggatgggcgcgttggtttggacttaggatttgcaccgcgggagtcgcagccggtcgcggtagagtcgccacgacgacgacgtcgatatccacgaggtttccgcgtgaggcgtgggaaaaggtttagctgtttcgggttcgcgtgcgggagaacgttctcttgccctggcgggtctcccggatttctctcggtttcctttctggtcatgtgatgttggctcgatggacattgcttgcttgctttagagcagaacgagataagcgcaccttctcagtgtgcttattcaataggctgaggttgcttacactcaaaccacgtacgttactgtagtgctgtaacagatggacgagtgccatcttttcgtttactcgtagcaccgagtgccatcgctactccagtcgctacgcaccacgcaacaagcactggacaagtcggcattgtcaaaagctttgcgataaccttttttttttctcagccacgtgcctgcacgggtagggtgtgtcagccgcagcctgcagcgtttcagacaactacaggacctgatcacctgatccatggagtgtaaagcatgtgtcgagggctttcaacatctctgaaaggccaggcccatgcactgcacactgctctcccatcgatctggctgctaagtacggaataagttcaattgaggtcccttaacttatcaacgaatccgattttcgtccttcaactggaaaaccagatataacgggtccctcaactactaaaaccggtgcaaagctcttaataaccaaatttggtaattcaactatcggaggttaaggtaaaactgaagcggaatccaagatggagatcgtttcggaaacagagcaagaatcggctaaagtccgaatcggccgcgatcaggatcggcagagtgcgagtcggacaaggttagccgattaagccgattccgacaatatgactcgttacacgacatcgggttaggttaaagtgcttcatatagattgccatgcacagattgagtcctgaaaagacaattgtatctattaattaggatattttatgtaatttccttagagataggtttgagtaaaagtcagccgcaaagacttatggtatcttagagtttgttagagataagagtcgtgttcgacattgacatattttgtaatctcgagtataaatagaccccgagccccatataatcaatttaacacacgttcaatacaatcttggcgcatcgccaccctttactttcgttttgtttcgacgagttctttctttcgggttgagctgcatcgatttcgatcttcaactagaggtaaaacttgttatggcggcttgcgttctcgggattagtgctttcatttttatgatactctaatcttgtttatgtaatttgtcgagttatcatatatcctatataatctctggcaatattgttatttaacccttagtcggctaacatttatcgctagaaggcagccgatcaggttaaataccaacgttgacttagattatatagggtatccaccactctatgaaacatccaacagcttgattgtcaagatattgttctttttttcatacttaatgctgcatcagttgagtttgatctattaagtcgtgcttagaatctcaatctctagcctgcttttggttgccgattagggtagtgttggggtttcagccgatcttacctgatttagctttaaatcttacgtgcttaattgatatgctagatctgccctttatgttaagatcttactacaacaaagtatattaggcttctgtttgatatatattttacttgctttaatatcttaatatagagtagtatcggagtattagccgatacatgctagatttatctgatcggctatgctataaatgtttataatctttttgttaatatatattttgatctaagtgatttatactgtctcggcatggcgaccgatctatcccaatcacttgatttaagtatatatcgacagaagtattatataccattgatatctacagccgatcgaatagatttaattcttttatgcttatttatgattgccgatcgattcatatatgacatcggctcaaagataaatgaaacgtcatcggcagctaaccgatcgactatcgtttgtggatttaactactacttttctgtttttatttcttgttgatggcaggatcaaatcaactggcacgctcacgaacctaaaggcaagatttttggaccagcactggagttaagcagatctctcacgcctcgtgtttttcgcatcagcaaaagcaggtcccttaacggttttgatggtggttttggctgatgtggcgcctacgtgaccggtttgacttggtcctcgtcctacgtggtggtgatgtggcactggaagaaaaatataaaaataaaaaataaaaacaaaatgtggggcccacatgtcagttagacaaaaggaaaaaatagtgggacccaccatcctccctatccacggacgacgggagaggagcgaccggcgcgtccttctctctccctcccggccatccttcctcgccggcgagagcgcacggagagggaaaaaggcggcggatccgttggtcgccgccctccgttggtgttcggattggatccgtgcgccgtctgagtgcttcatggctccggctgcggtggctgcgacggaggcggggtcgaaggtggcaggaggggggggggatgttgtggcggcgtgggagcgtgacgcggagaagctggagttcatcgaggagatgacgagggggttctacgcggtccaggagcgggtgctggcggcgatcctggcgcggaacaacggcaccgagtacctccgccgccacggcatggaaggacgcaccgaccgggaggtgttcaaggcgcgcgtccccatcgtcacctacgaggacctccgcccggagatcgagcgcaccgccaacggcgaccgctcgaacatcatctcctcccaccccatcaccgagttcctcaccaggtgtgtagtactagctaacccaaacaaaattcctttttcaattaatcctgcctttcatttgccggctcggctccgccatctactccaactaattgtttgattagttttggttgcttggttgatcattcttgctaactaattggcgtgcgtgtgcatcctttgatttatttcctttttctttcttgttttgttccttgcagatcatgttctgctgcttcgagaatcgcaagttgggggcggaggaagaggcgcgcagcgggcggtggacagcgaccgtctctgccctcctcgccggccgcaacctttttctctctccgtgtgcgctcgccggcgaggaaggatcgccgggagggagagagagaagaacgcgtcgatcgctcctctcccgtatagatggccaaaaggcccaaggcccgacggtccggaccatggcacgatattttggcccggcccaagcatggtacggcccgacggaggtcgggcccgtgccggcccggcccaaccaccaggttatgcctgggccctccaccggcacgttgggctgggccagcacgaccggaccggcatggcacgatgggccggcagtcaggcctgatacacacaaaaaaaaataggggagtaaaaatacacatattatatgccatggacgaaagaatagggatgtaaaatatacttattttatctatacatatgtcagcccaaagaggagggacggaaaatagacttattttagctatacatatgtcagcccaaagaggagaggcggaaaatagacttattttgatatacatatgtaacagcccaaagaggagggacaaaaaaatagacttattttaaaaaagacccgatgggggcacccgtgccttcgggcccgcacagcacggcccgacagctagtgggccgtgcctgggcgggaggtgcagcccatgggtcgacacggcccggcacgaagtgccgatcgggccgtgccagcccgatggctggtgggccgtgcctgggccaggccatgccggtcgggccttttggccatctatactcccgtcgtctgtggatagagaggatggtgggtcccattgtttttttccttttgtctgattaacatgtgggtcccacatttttgtttttattttttatttttatattttgcttgcagtgcctcatcaccgccacgtaggacgaggaccaagttaaaccggccatgtaggcaccacatcagccaaaactaccatcaaaaccgttgagggacatactttgcactggttttgatagttgagggattcgttatatctgtgttttttcagttgaagaacgaaaatcggattcgttgacaagttaagggaccctaaatgaacttattccactaagtacagaatctagtacggcccaacatgtttgggccagaatacctaactgcctggtgcccacttcaagtccattgctaacatcaagaacatgctaattttcttttttttttctttgaacacaagaaaaatgtatctgctcctacccaaaaagcaaagtatctgctgtgaaaatatcaagagcaaaatatctgccgggtcgctttcaactcttccacccagatcgagctctttggactgggccatgtttgggccactttagcctgtcacatggtgtggtggacgcacctaaagtgggtcacaccgaacgctgaaatgtggcatcacgacaaaaataagaactccggccttatccatcacagcttctacgtacgtctcgagtcggacgttttgaccaacatgcaccaccaaacgacaacggcagaatgcaaaagaggatgcgtgtctatgcatcgctgttagagtaagaataataataaaatcaagtggtattattatctgaaacctacgtgacaccttaaaatacgatgatacatgatacatttataataccttcatgatacttaaaagataatcgtgatatgtcgatccggtattcggaagatattcaaagggatatggtgtgcatgtctacgctcgtaaggatgagtatacgtgtgttctgagcacatatactgtgttcctaaaaaaaataatgtcagaaagtatcatcaaatcataatacatgaaggagttgcggtatccgaagatatcaacccgataccttcattagatatatattactccatatcctctttcttatttcacttaacctagatagtcagattgcagcttagtaaaagacatggtgtgccaggatgattcaatatagatggtgcggcgcaaaagagggatcacagttcaagaagggtgcatgccttatgtgggaggttagcgtgcaggaggggtttttctttccgggagggggagttgaatagaaggaatacatattgtgtaggcaatggggacatgatcctgacgttggctctcccaacatgttactatgttaatacctaactcatctcattctcataaagtttgttaaaaacaaccatgtgcatgtggttatagatgtggatacaacttctcttcgctcgtcccctctctcctctaactcaacacttaaggtggcaaccattataacccatttatatcaccttatcatacacgctcttatgtgattctattattagaaactatatgtaacgtagcagtgaagtgggatacacatagaagagcaaggtcgcgttgtggtatttatatatataagatggtccatcgatgcatcatatatgatactacttgttcacgagaataaattaacacaagactttatcctattggacccgtcgccttgacatgtcaaggtaacattagatgtatctatacctaattaaaaatgcgcaaggtagcactagatgttcaatcttcattttttttgcctcccactaccactggcccaaaccctagtaccgctgccacatcgatatgtttacccatgtgttttctcctccaattaatagcaaaaatcaattatcactcttccctcatcattttcgtcatgatttacctttcatttcagttttaattcgctggatttaatctcagtcgctgatgatggccagccggtgagcttcctcggctgtttttatccgagttttgcatattcgctcggattttaggaaaaacataaagaggagatcaagtggatcaaaagccttcaatcaattttaggagatcgagaaagattctgccaaatttgattgggagggtcgcttcggcatgcagtaacgagactatcttccggaggttgaagacgatagtctactatacaagttgggcatgtggctcaacttgtgggctgggctgaagagataggccgagcacggggagatagcggtctgggctgatgttgaaaatgaagaaaaaaaaaggctttcaactgaaaaccaaggaatatttttcattaatcttttcaaattataacgtatagctattcgaatgttttaatttactgctcagctcctaatagctattgcatcactggaaaaacatttttacctgttacaacacgcgaacatttttttctagttattacacaaatctacacgccatatacatagatggtggctattttttccctatttttttaatctgacttataaacggttatacgtgtcatgagcaaccaaaataatacgtgttccattctaacaccaccaagattcagtaaggcttgagaccaagcatgtctcaaccataccaatacttttctttttagaaaaaatactaaattttgataaaaaccaacaaaccagataaggtttaaataaatgccggtgcatagtaacgccaccttgtacaatacctaaagaaaaggatactcgtcctaatgccctatccaattcgacaaacacacgatccacatctgaagaggttgggggagattatgcacatctgaagaggttttgggggattaagattctaaaaatctattggttggtatttagtttttgagatatgactttcctaacttattgcttcgggactatctacaaatttatccacaaattttctcctaaaaaattgtaaatgtaaatataatacaatagtagtgtaattacattgtaactggtacgtaactttcatgtaattatgaaaccattaaatttgctttaagattcatgtaagcgaggaagaaaacaacacaacgcacacagaagtgagaggatttggtgttgtaacctccgcttcacgaaaaaaacatgttatcacaaatttttttaaggttacatacaagttaagttatattttagttacatgcaaattacgaagtaattatactatatttacatctgtcgatttttttagaaaatttgttgataaatagatagcaaaattttattgcttatacaactacatattcaacctgggcccctttgaatcaaaggatttatgaggaatttcataggattaaaatcctataggaaaattttctatttggccatttgattcaaaggattgaagtttttcaaatcctatgattcctatggaatgacacattgcatgcggattttggaggaaacttagaaagacctccaaccttttaaaaaatttcctttgagtctatctctctcatccgattcctacgttttttcctgcggtccaatcaaacgatcattcctgtatttttcctgtgtatcgcaatcctctattttacacttcaattcctgtcggaatcctgtgttttcttattcctttattttttcaaccctgtgattcaaagtggcccttagagtgctaacctaaatttgaactgtttcgaggaattggaaattatgtatgaagatgcagctactaggccccatttgaatcaaaggaaaaatcataggaattctagaggattttatcctatgggaaataatcctataatcctttgaaacaaaggattgtttcttatgagttcatttgaaattcctatggaatgtattttactggtaaacccagcttttccagattctcagaagccagaaactggtaaacccagcttttccagattctcagaagctggctaccaaccagctgtttatcagaatattaagctccccaaacaggattcatgtatttttcctgtgtgctaatcaaacgatagtttggaaactttcctgtgtttcaaaatcccatagttcggccccctttgaaataaaggaaacatcataggaattctagaggattttatcctatgaaaaataatcctctagagccctttgaaacaaaagattgtttcctaccaattcatttgaaattcctatggaatggaccttgcttgagcaattttggaggaaaataagcatgaggtctctcacctcatgttttcctcttcatgtgtctcaaaatttatgtgttttttttgctaatcaaacgacagtttggggactttcctgtatttcaaaatcctataggattctaataagtatgacattctgggcatgttcatactatagctaaaataaaccttatcaagttttggcaatgccaaaattttggtaagatggtactattatcaaaattttggtatgatttcttatgtattgactaaatttggcaacagaataacgtagacattttttagcaactttaccccaaaaaaatagtatgattgaaaatgacaccaaagtgaacaggccctctattcctatgtttttctttttcctgtgttttctcaatcctatgtttcaaaggggcccgtgtggcattctattcctacgtttttctcatttatctgttttctcaatcctgtgtttcaaagggatcttaagtgtacattctatatcatatgttttttttatttctctattttttaatcctgcgattcaaatgtggcctaaaacttgtgaaaacagactctcggtgtcggtagatagcgattagttatgtcctgcgtcatccttatcatcgaaagaaaaaagagaacaccacaacaaaaggcaagaattataggacaaatctcctcctgttccctaaccaaatcggtaccaggtcctgacccccctgaccaatcccggcccctccgcgagcctctcgggttatactagatcgacatcaatccccaccccgcccggtggccgatggatagagcaaaaatcctctgccaatccctatcctctcttttccccgacgcaaacacacgctggctgcgctgctgctcctcctcccaccggcaaaggccatacagcccaacgacacctaaaaattacggcggcttctggaaggcgaggcgacgagggcccccgtttttttttttaaaggcgccgcgctccggcgctccacatccctccaccgattcttctggtgacgcggacccccgtttttttaataatcccaccacgcaccggagcgagaagaagaagaacccaatcatttccctccctccctcccaccgtcgtctcgtcgcgaacccgcgagaatcccaacctcctcctccgctttccctcctttctccttcccacccgcgctaccgagcagagcactgcttggctcggctggctcttgcggttcgaggtcagtcgcctggcgccgcgcgcggcgggcgagggggtcggttgatggtgccatgtggcccctggggttcttctccgagaggctgttcaaggtcgcgggggaaggggacggcggcgagggggcggacaactcgccgccggcccctgacggccgtgtccctctagcccgccgctcgtactacgtcgatgtcagttcctccctccttccctatctctctctctcgcgcgcgctcgcgcgctcgctctatggttgcgatcaattattgtctctcggggtggtgtcggttgctgatcctgtgtttccgcggcggtgtcgtgtggctgtgtaataatcgtcgtgtttactgctgctgttaaatctgacgaatttttttgggttcgtggcgctggtgatggatgcttgctaggttccgcatgtccagcaggccttcacgtgggactgcggcctcgcttgcgtgctcatggtgctcaggacactcgggatggattgctgcgacggcattgccgatctcgagaagctctgccgcaccacgaggttcctctcttggactagattattacttcaaatttgagtttacaactaaacacggggggcgcaattctccttagttaatgaaaaaaattgataccccgaatcatttgtttattcatggataattattcttcttttctttatgagattgcgtggataacgaacagtgattactctgtcagttcatgaatgcttgttactactttgaccacttgattgttcccacattttgcactgcataatcacttttatccggtgtagttaaaatgctctttgcaaataattccatcttaggtgaaaattaatttggaagagaataaaaaattgtgcatttcaattgtaatatgacaattatttatgaggacataaagtagcttagacgtgagaaatattcgtggatatattatattgcaatacaatcattccctagatgagctggacataatatttaattctctttaattttggcctattaaaaattttaatagcacgtctggtgtattaacaatctgacatttctgggttgtgcagcatatggacagttgacttggcatatctgttaaacaggttttcagtttgtttttccttcttcactgtgactctaggagcaaatccgcaatattctgctgaaaccttttatagggtatgaattgtaatttaatgttaccgattcctctgaagttcactgtagtaacagtttcaaaaataacaatgtcgataggagcaattgcaagaagacattgatcgagtggatgagctctttggcagagcccttgaagctggaattagtattcaagtaagatcacagcgcacatcataaaaattgtctatttgatgtacttctcactttcaattttttttaatttttcaatttgtggttattctcagtgcagatccatcagtgcgtatgatatagcttttctactgttatctgggcactgcattgctatcgcactagtggacaaaacaaaattgaagtaagggatttttttggtcatagcaagtgagatgaagtatactttgttctgtatttctgtcaatacttttactcctttaagacagtcttacatttgtcttcggcattcagacatcgcctcataagcaagttgtccaatggtaaatgcaatgggtggacaatgttacttgctgtacttgtctcattttaatatctcaaattcttttgatttaacgatcataaggtgattattagtttaatattttgcaaccgtgccaacattatgtagtaacaaactgataatgttgatgaagcagttgagtaatatacagttggcactaccctttctgttcccaaagttacttggtaattgagagaatatctcggagaagattacagttcggaacaaaatggttcatggatgtatccatggatttttatatgcataatttttctacaaacaataaccattgttccttgatttcatttttgaagtggctgcatatcatttgaaatgggcaataatagtgtgtcagtaacttgatttttggaatgcagttcctcatggagcaatgatctacaagatatgcaacagttcagtgaggattcagattacatgggtgagtggccaagctcgttgatggattggttttccatgaatccatttgctgtctgcaaaagtgcccataaaaaaggattcattctgatggttaatactgtcttccattgcagggcattatgttgtaatatgtgggtatgatgctgatgcttgcgaatttgagataagggaccctgccagttcgaggtacctaatattcaccttttgttaatgacatcttttaatagcggacacttgagttttcagatggataaactgtgcttctttaatagcgtcatgctgatatgggcataacactcactagaagcaaggatcatttagtttcttgtaacgaccagtaaccgagaacattcaccttctgctttgaacatatttatatgctacatgtcagggtccatttatagctatgtatgattatcaagtaatggcgccatatttgactgagaaacctatcgctgtacggttttctgcttaatttccttcgctagaagaaaaaagttttccgcttaactttatgtgcatgacagcatgtccctattgacaagatttaacttagttacagttgtttgttgattctttcagacagcgtgaaagggtgtcaatgaagagcttagatcaggcccgcaagtcctttggaactgatgaggatattattttggtaggaataatactaggtgcctgtttcaatctgctattgttcatatttaaatcttgcatatacttgtcactcttgagtttacattaacttctagtcttaccattgagcatattgcacgtttcgctatttatggatgcagttcacataacatgttaatgcaatcccagcccacttactgagtactcgtttgagcatagttcacaagccaataatttaagcattgatttgcatggtgttttgcaggtttctttaactggaaaaattggaatgaagctctcacgtaaactcctggtgggctccttgtgaaaacctcaactccctggttccatgtgtatatacgttgtacatgccactgtagttatgattgtcatctgttaagtcatgtatgtagttcaagatcattcttacagctataggaactgtgagctagtgaagtacccagttaggtttgttagctcatggctcatcacactgaagctgcaaaggacgcagcaggcagcagcaacaatgctgcgcaggaactactcttgtaagcaagagcagcttctgtagcgagcaaaagtcataccgttatagccggacagagatgtatcatatgtacatatatccttgcatctgtggccatgtgtatcctactccctgaatcctcttctgtaaattccaaaccatctcgcgtgctcgcctgcctttctctgaatgattcttaatgcaatgtaagaagggatgttgcccgcgtatgggtgtgtttagttcacgctaaaattgaaagtttggttgaaattggaacgatgtaacggaaaagttaaaagtttatgtgtgtaggaaaattttgatgtgatagaaaagttggaagtttgaagaaaatttttggaactaaacttggcctatatctattgaacttgcattagagaaacatgcaccaaggccgtgtttagtttcccctattcccaattttccattacatcatatcacatcaaaaactttcctatatataaacttctaacttttttttttcaaattcccaactttcttcaaactttctatcttttttcaggaactaaacacacctaaaacagaagaaaggaggacaaaaccctccaaaattcattctgaactactgcgcgtggaaccatatagtctgaactctgaaggaagtacacgcgaatcggcacaacgcacctgtgtccaaaaatttagacttgtcggtcatagctttagcttggagaatctgaacgctgaagctagtagtacatgctttaagttgtgtccaaagttcagacttgtcggtcatccactgcccttatcccttctctattaatagatatctgaaccacaaacttcacaatgcgcaagcagttgagatcatatacgcctttgctgaataaactccattattattccagatgtttcccacccgttcctcgtatcgaatatccaaattctcgctagtgatttaacttgcaagtaatgatctttaaccagccatgacccctacaaagatacgggcagatggaaccaaggtttggtttggtttgtggcctaaataggccttaccaaattttgacaagttttggcatgactaattttgataaggcaaagttgtgtttggattgaaaccaaaatagcctaagttcactattgaaatggcctattttattaggtatgccaaaatttggcttcaaactaaatagacactaaacactattgaaattgccaaatattgataaacctaatttagttctcaaaccaaaccagccccaaatatcttaaactctgaagccgcgcaatcgtgttcacgatttttgacttgtcggccatcgcccgggcagttttgcttttaacctgcaaatcttcagaacactgaagcagtccgaaagattcagatacctgaaccacgagctttatagaccgcgcagttgggacctgggagtgtcaagaaatatactacgaatatttccggccgccgtcgctgccaccaccgtgtcggcggggatctgaatctcccgactatttgagctcgcgcttggcatcagcgttaggtcgcagcgagcgagctctcaccagccacacctgcctgcctgcctgcctacctgcacgactggaacagctgatccgggaacagccgtctcgctgtcagtgaacattcgcacccgcagccacgacacctttccccaacacgtaaacacgccgcgaaagcttcactacatactagtacacgtccatggctgcgtagcaattatacctgacagtgatgcccccctatgcattcttcaatcttgatttcttgtacaggcaaagttcagatgatagtggcgtcgagcacactgcagcaacggtttcccctctctagcagcggatggacaaagccaaagccgatgggaaaaatcaacgaacacgtttcggttttcctgccaccccagctgatccggcaagacgaggtgctttatcgaatgatgaaacaggtttcgtttcgtggttgagctgagcagttcccgtctcggattcactcacctaacatgcaaccgcggagcaaacaacagacgcaacgggccaaattatttatcgctgcggtgtgacgcgggtggaaaacgacgtctctgagttcatgcgacggcgaccgatcggggctcgtcgtttttcacctttttttgggttcgttcgtgagtgatagtgccgtcagaacgaacgtgacagccgcgcaagacttggagttggatcgcactttgggaaaatagaggtgacggaaaagcattgccgtcttaaccgtctctcctccttgattaatccttcgtggttgccgaacgtaatccggaagtaactggcacgaatttgttccttttctaatccggctttccgaaagggtcgcatcacatattcacattcacatcagagcacttgttgctaccgtgaccgtactactgtactagtagcaacagcccaagaaagggaccgactttgcgaacgagggtgtgcagccagaggcaatcacgagtacgatcgacaggtcaggtaggctatttcggctagtgcccacccatggtccgagtcacacagcgtgatcccagccttaccttgagcttgtggttacaatcgtttcgagcccccggaaaaaccaacgccggaaaggcaaaaacacccctcggcttcgttcgctctcgtcctctaatgcaaaaggagatcgataatggaacgcatagtgggctagtagcagcagtaataccaagcgaatcccctattatctctcgttgcgatcgatagttcggtgcgcgtccggtcgatcgaactttcacccgccgacgcgacgcgacacgcacgcacgcacggcgccgtccagtttgtggttgtggtgttgcgccgccccctcgctgtcgccatccgtcgcgtggtcggtcgggggccggctcggcagcaatatttcaccgtgaataagctagcaattgcaccattccgcctcgtgctgcgcaagcgtgcgatgttttcgtcgagctcaaggctttgagaggttcggaaacgagaaacggagcgacttttttttcatagcacataagagtgcgacgttgtgtatatcgattgaacagaaaaaaaaataagactacagctctaaaatgctataagcaggaaaagaaaagataaccacaccacgtgtcttaaccagaaactcgctaaaaaaatagaaacatgacatcctgaagaaaaagaatcatctaaacgacgccttcattcgagtgtgccaccgccgtctatcatagggtgcaggacatggttttcacctagaggaatccatcaggggataagagaaatcactcaacaacacccccaaggagaaaaatggcgcagacatgcgtcgccattgctggcccaaagagacaaagatgctaggctttcactcataatcttcctgcactcttgtgtcgaggtctcctgctggacatagagaccaccaccaaccacacccctttgatgcacaatcaccgcaccggtgtctcgtcgccggacggccattaagtaggagctcgacatccaatgcactccaaattaatccatgcatatggttaagttgaagagggagagggtgagagagaagaatgcatcccctctcccccacactagcatgccaacgtagtcatcttgtggaggtaaggtgccatcaaaataggacaggcgtttggatcaggaccccgtcatcgctgccttggccagactaccatgtcgccataggctgcccatccgcatcgccgccaccttgtcctattgtctcctgccgccactgaaactctagccaaagcgccagcaccgcgccagctgtgctgtagcctattgctgcagaggaagaaagttgccatcacatggcctctctccccttctgcatagaccacggcaccgccgccatcgcccgtttgtcgagagccacctcactaggggacgccaaatgtaggcggtcactgtatcctccctggccgcatgccatcgccagtcgtcacgccgccttgacgccgaccaccccaccgcagctttggtcaggagcacgccggatctagacgccatccccgcaaccgccaggcacccaccgtgcaaatttggaaggatccgatcttggcagctatggctagccacggtctccttcgccgcctgtcgtccagccgctcctattgcctcgcaacctcctatcatggttggcgcagcgcctcccaacttctcctcgcttgatccaaatctgaaacatcttcacctcgacacataggtactctaaccacgatgccaccggtggaagaagccccgtcgccaccgtccttgtaggcagccgtttgccatgggctggtcgggtggcagcgaggcgaaggggaggaggtggaggacggcggcggccaggccccgcgtcgcccctgaggctggagtgacgcggggacatatgctgtgcggagtgaatttttagtcgaaccggtggcagtaaattgtagccacacacgctcaattgctcattcactgcccgacactgggtcggtggtgcaattgtgcaagccagtcgatgacaagagaaacagaagtagtactagcttctccgcggactgacggcgagtagttccatctcctgttcaagccgagtacgaagtagaaacgagcgaaaccgatcgcacaaaaggggtcgcacaaaagtggtcgaacaaaagggggcctttgcacggaggaaaatctgtggagggagactgatcacctttacgaccctcaagagatatggcgctgtgcgcgactggccgacggcgtgccgtcccttccgacccattactcacttgtcactagagggtcgcgcgtgcatatgcacgcaggcgcaggcgcgtgacagtaacaggcgtgcacgggcgacggggtaacgtagagttcatccatccgcagtggttccgacccaccttgaatgcaagatcttgtccgtcccggcatggccatatctccgcgtatctttgctttagatccgcagtagctagcacagtaactgatgaaaaaaaaaaccctactactactagtgctagaccatgcaaatacattcggcgcacaaatatatacggattggctgcggttggtgattttctcggctgtgcacatttgccagtagcatgttcctacagtaacacatatgtagggatcattcttggacctgcggtacacaaaggtttattgggaaccatttcagaaaaaaaaaacttataaaatgtgtgttataaaagatagttaatatagtggaacgacgactagccttcccgattgtttatgtcattgatcactcaaatacatgccagatgacaacgtatgagcacacgatctttgttaatgaagttcaatcctaacctaattttcggggctttgattatggacgctcctccccaatcaacgtatatacaacctaattgctacgagtcaatgatcttgttgccattatcttcctgtgtatctacgctatattgcaatcaccatagttacattgtgtggtgtgtcccctctgtatttaaagggttaccaggtgttgctataaaatttttctaacatacgaaggcatgagagatctatttaactctagtgcatatccttaattttgacgaggttcaggcatgttaattaattggatcttacaactaacaagataaattggaagaattgaactaatgaaccaatcgaccaatactgatatagtgtggtaaatgtagatccgatggttttagcattcatcggttgaaggcctggtgcaggtacattaaaatatatatcgacaaattaaccgatacatctgacaattgatgtttagaataatgatatctcattggctacaactccgacgaatgttgtataaaaacctaccgacttagtagaaataaacttattagcagcaatctaatcgatcaaatcaaaccgagatagtataagatcgaaaataataagaaaaatctatttaaccaatagatctatacacatatgatggatatactagatcgaactagtcaaagccatatatcaagataaatcgataaccaataaatcgataaccataaaaactagttagaatatcaagcggaacttgagaaagtcttaattgtgctttgctgggtttacaggacttaccacttcgccaaaaattgaacttaaccgatacaaccccgcttgagggcaagaacatgtcgaaactacaagggtgatgatgcgccaaaatattattgtattgatataaggagatgattacaaagatatcgagtgtacatatttatacctttgaatttgtgcaagttcaaatcgaatacgagataaaaattcataacaagaaaataaaaatgactaatcctgcctatttaaaagatatactaagaaaatataaaaatgtcttgtcatggtattcatgattcatccttgaacttggccttatctagataaactttcatctactaatcgatttctttccttaaccaaatccaccaaagagacctaccaaattttggtgttaacaccgggttacagtggccgaatctaactctaccccctaccacctattatacgactatggttcaccaaatcattttgggcgtggtaccgccaccctgtggtaagtcggttatcgcgataaccacgtggttaccgtgaaaaccgtgcggttactgcgaggtttatcatggttttaaaaactaagaaggttatggcaaatgataaccacatgattttgtaatttacaactccaaatctaactataatcaaatagaactagtatattcgatacttattctaacaatatggaaatgcataaaaagagttgtgtggccgaagagtaccggcaaagaagcaatagtagatatgtcaatataatggtcccattctctcttttcccgcaggaaactctaccattaggagatgatgacggttgtagttggttcttcacatggaactaaaatggagggggaaagtccccattggccatcgggtctagcggaggcgggtatgagggcaagtacaaaggtagagaccgatatggtctctacgttaattagaggctatcacgttacaatagttaagacaatacggtctctaatcattaatgtaccaaaatactttcttactagtcatctttcctttattagactcaatgcaataaaaaatttcctaataaatgctaacagtcgattctatgctgttgtcatgcgtagcaaccatctttctcttttcttctttctctctcttccacatcaccaaatatacttacatgacaataaagagagaccgctaataaagaccattgtacatgccctgatcctctgtccatgttcctcgcaaagacccagttaacgggcataagagtataaatccaatgcaaattaatgcggaggcttagcactttcacttatttatatacagtatatatttattctggtgatggattctttggtgctaccatgcatgtataacttgcttggtgttattcttatttttctcccacaatagttttaatttacatttgttactacgtgcattgcacgtgcacggttactcgttcatgtctaaaggtagaattatcctatgactagtgaatgagtggcactgtattgatgtcacatatgaaatttaactattactagagaaatttgcaatataatagtcgcgcaatctacacatgactgtagattttgtgatctactaacatgagtgcttagcgtaaacatgatcatcctaatgcggaatttttagagttactgaccgttgtttgaagccaatgatgtggttctccttgttccctctgcaatgtcgtcaacctgagtggaagtagaggacgtcctcgaactgctccggtgagcatcggcgtaggggaagtagtcgtagcagtgaggacgccggtttgatcccgaaggggttgccaatgatcactagcagggtagcggtggccttccggtcgccacctacactcctggaacagtcggttttggttttctcagggagaagacgatcgtggagagattgtcatctttccacgacaccggtctccgctattaatatggcgctgagggagatcgggggcaattgaaaacatggaaatgtttggtgctaccgatcaatgcgcatagtcatgtaattatggaaataatcacaaattaaatcatgttaatcctgtagacaacgggtgaaaaattgctgtgcgggaattctctagatttccatgccgagaaataaaatttcccaacaatgccaccacgccagtttcagagtttctctaatttctccatgggtgctcatgttttaggtcaagttgatggcttgatgcttatgttcagcttgtttaattacactttaacagattttggttcccattcctcgtaagttggcaccgtacattgcacatggtcgggaagcgcgaagacatccgtactagtaactgcacacgtctccgaagatgaacaattaaatgtagtgacccattcatctccaatcacctccatcctaaaaactcttcgcttctactcaacaattaaaatctagctgaccagagcatctgctcgtgcttttagcacgtaagacttgtaatatcggcatgcatcatgcatgtacctacaattatatatgtgatgatttaatcaagcacactggattgccgttcctgtagcccgatcacttcagttgagagtaatcgaggaacaatccatgcctccatcatctgcccaatggaatacgcaaaacacaatcatacgcatgcagtaattgctagcaatcgtcgttacgttattagcaaacaacgctcgtacacgcacctgggggcaaactatgtagcacgcatggtctattggcctctctatacctgccacgtccgtgtggtcgcttgcgagcacgagagttcggcgtacgacgccgacggcgcgcgtcgatcatgcttgcaaattgaggcctttgacactcgagaatttcgcggcctcgcgaggttgtacgagcttcaagggacaattcatgtggttgacgtcgttggtgggctcgtggctagtgcctacggattattattcggacggccggtgttggcgtttgattggtagtttgacatgccgcgagaaaaccacagtgcctttcgtaggagtggttgactagcagaaggcctgaagcgaactagctaggtacagtgtacacaaaagtgtacgaaggataatattttctgtagaatactagagaaaatatcttttctcgccataaaaactgattttttttttcatgcggttggactaccgtctgtccggagatatatgtaaaaatcaactatttttgcatgccagtagcacaactgtataaaaaagaaaaatcaacttttgcggttggttagttaagccccacacatgtgaaaagaaaaatccccaaaaccaacacctaacatcgttgccgccgtagtccaccatcgttgaaaggcttccgccgctggacctgccgtccttcaggtcaccattcatcgttgtggaaacccctcctcgccgtcatcattgtggacaccccacccctcccattgtcgtcatcatcgttgtcacccctccaccaccaccgaatccgccagtcgggatgcctccacttccgtcatcgtcggatctgtgaacgaggggaagaggcgaggggggttgacttctttcgatggccggcgcgccagatccagtgactccatcgttgctcctttcccaccacgttgctgccaacaccaaatctgcgcatcgaggcacctccatcatccttgccgctgaattcgcgcatgagggggagaggcgcggccaaccgctcctgaggccggcgcgctagatatgtcacatctaacgccgtcgccacctcttcttgtcatcgtcgtaggaggaagggggagaaaggaatccgaggaggaagagagagagaggaagcctatgaggctaagccgttgtcaccgtcgatgcgtgcctcctccgctagcctcctcgcccgccgctatcggagtcgcagtttgccgccgctccctgccgtcggcctcgggtgtggaggggataggagaggggcgccgggggaggagaggagaggggaaattagatattttaggatgatagcaggcaatggtgggttggtggcaggcgggtcttttagcaggcctgcctgcgaaaataggtttctttttacatgtggtctgttaataggctcgcctaacaaaaatgattttttgcatgcgggtcttgaattgtcctcgagggagcgatttctgtatagggaggcaattatagttcgcctgcaacctagaggagtgttgttcgaaaaatcgattcttgagtagtgttaaaggcttcgagagttatattttcaggcaaaatagaaagaaccttgccccttccttatgttttttcgtttttcctgtttgagcttgctatcatgtaggtgtcactcatattcttttggtaaaataaggagaaccttcccttatcttttcccatttgagcgatcttatcccttcaattcaactgcgttctaagtgtacatcggctgaagtattcgatggcccatagaagaagacaagaattagcgcatgcttaatctagtactaattatcacaagcttgaaaaacatatttatttgactttttaaagaaatttctatatagaaaacttttgcacgaaatgtgtcgtttagcatatcggttagtgtgcttatggaaaacgacgaagtagcccaacctaattgctaaaatgaacacaacctactttttattcaacttttcaaagaaactttgatatatgtattttaaaagaaaaacacgacatttagcggtttgaaaaacgtgctaatagtaaaaggggaaaaagcttttctatgtaagtatgtaggttggcactcttttggtgagagaggttgtggagagtggatgccacgttcaacaggtgaaaggtttttgaattttaattgaaatattgattttttttagttgaacagttgaatattttcatataaaaccctggtgaattcccactttgcttcgactaaccaattaggagtaatttctaccaattgataacttgttaaattgattatactacaagtttctcttcaaggaaaagtacacgagacctccaatttttcacaaagacgtcacttacaaattcctcatgctaccaaatatttagatactgtttagcacaattctagataccacatccacggtaaatttaaagtttatatgcaaaactgtagcggttaaaaaaaattaaatatcatctaaaataggaacaaaattatttatttgcatagatttgtggaggtgaaaatacccaactctaaaaaaaaaatcttacatcactagctaaaccaaagtccaaagagggccttatagtagttaatcttcttctctaggatccatttttctacactctgcagttatttatcatgctatcttttctctatatatgcagtagttgaccttttattttttatgtacacttcattccattgtattgcaagtctatttattggtcctgttttcattcacaacagtgatgaaattagctttggggttggtcggcctacctccaatcatcatctctgggatttatactactatcttcatcttatgatataaaagattctgatgaccctgtgattatattgacaaaattccttatgtctaatgttgacaacgacaaacaaatactccatctgtttcaggttataatccatctgtttcaggttataagatgttttgactttggtcaaaatcaaactgcttaaagtttaactaagtttatagacaaatatagtaatatttacattaccgaattagttttattaaattaataactaaatatatttttataataaatttatcttgggtcgaaaatatcggtagcgctattccgagcgctagagcgcggaatattattccgagcaccacacatcgcgcctagagtccgcaaaaactggtgttcggttgcccatgttcgatctgtctagattagttctatttgaattcggggtaaatcaattacagattcgtaaaatcggtggtcggttgaaaataatcattgtaattggtttatctctatttccaatcgaggtagttacgatatggtgtgcaataaactgagaccaaatcttgtagtaatcaaattactatcaatgtaaatgaaaattgatggtgcatgtgcctgtagtaattggattaacgacaaccatgctaagtaaaatcttgtagtaatcgagttattgtcgacctaaatgaaaatagatggtacatgtgcttgtagtagttggattatgaacaacattggttgatcaaatcttgtagtattcgtattactatcgatgtaaatgaaaattgatggtgcattaacttgtagtaattgcattattgccagccttggttgatgatttcttatagtgagtgcatcaagcaagaaaaaagggaaaaaataaataaggagggaattactggggtctaattagtttaccccaaataatacgtgaatttttttttccttatatattgaatcactccatcctaaatcatgggacaaaaaataaagattttacatgcacatcatggtaaaagcacaagaataaaaattttacacacaaatacaacaatacacgccatcgccagttcctcgtgacggctaaatgaagtttctgtcctgctagagagagcaagaagacaaagtggtggagatgcaggctggagccaatgcaacaccaagtctggccgctgcgacctcagtaggagccggatccggcgacggagccaaagatagaggtcgccatcgctgttttcaccgcctcactgtcataaactgggcaacgacagaggtgatgaaacaaatcacagtttcttgccgatgttaccaaatcgattgaccatcacaaacatgatctccgccatgcaagggataatagagaagcacgtcaagatgagcgctcaacccaatcgaagttagactgcatagaatcaagaaagataaagaatttaattaatcatagattgtatacaattcttgcaagaaatcaagaatctcattaggaattgctgagagaactaaccgtccccatgacgtccacctcgttcgccatgggccagacgtctcttcaacattgatctgaagcagatgctgcggcggcgagtcctgaagcaatgccttcgcctcaagcgccgccggccaccgcttgccggtcaccgccatcaaccgccacggtgttgtcgtcctcctccatggtgcgtcgccgatctgtgggctgggatggtggatcgattcagatccgaaaaaaaagaaaaaataaagtagggggcgagagtggttggttgggtacgggaaaaatagaatatataccagaagtagagaagttgtttttatcggagtaaatcaaaaatggtgggagcacgatacgggacgtggggtgggatcgaaagggaagttgtttttattatcgaagtaaatcgtttactccgataacagtaggagtgggatgataggacgtggggtgggatcgtaaccagtaagttgtttttatcgaagttaatcgtttactccgataacggtgggagcgggatgatggaacgtggggtgaggtgggcctggctgatacacgtgcgcttggaatatgggagcgcgcaacgctcccaatagtagttctacgaaaatattactatttttttaaataaactttatcaaacttaaagcaatttaactttaacaaagccaaaacatcttgtaacatgaaatggatgtagtattgattatacatggagattgatggcatcgcagatccgcactgattcgtaatgttcatgagagtcttccgtacgaaattaggagttgtaggtcaacaaatagttggagtagataagagcagtactcgtattttagaaggtgatatacggccctttgttggaaacaaggatgatgcacatttcaacctgttcttacattcaacttcaatttagtcgcaagtagcgtgagctagctaccgtatggcagaactatcgctatagtacaatactacctcaatacgaacactcagcgtatttacaagtctacgacatttggaacagcaaattgcatattggccaaatctactgcaaataactgcattacgcagcccttgtttgttggtgaaaagtatcatacacatcaccttgggtgttatacccatttgatcaatactgggttcatgtctttttctcaaaaaagttgtattccctttgtttctatttagtactcgtcacccttgaacgtacaagttgaaagttctcattgctctcaattaattatcagggctatccattcggagtgggacggagctggaccgaaatagagggtggtgtcacttacttaattcactctattgtagatcaaatttaagctgatgtgggtgcctaaattcgtattaagggggtgcatatatggtaaaaatagacgaggtatagctaaaaaattttcttgaccgggttcctgggcaccctctaatatactctatctccgcccctgattcggactggtgaaccataaaccataacaataacgtaagggtatgtttttctttagctaaaaccaaattatggaatgagagaataaaaaaaccgtagtaagtttttttttctaaaacattaagatgtatctacagtataattgatttataattatattatagctgcattgtaactacattgtaattgtattataactactgactacaatataatttattaaaacttgcattcaacaatgctttgattaggtagcactaggatcttacgcctgatgcgtgtgaaaaaaattctttctagcaatgtttttctcttcatgcacaaatcttaaggtgatctgatggtcacagatctggaagttttggaggcaaaaaacttgcgaaaattttataggaaatccgttatggaatattgagcttatttttacatttcagcttgtaaaaatattagtccaaaaacttacttcgtcagtattgcttatatattttttccaaagctattgggtaactctacataaaactaggaacaaaacccacgcatctatgcgagcaatttattattgtttgtaaaaagaaaactagtcatatctcaccatatttactataagaacaatagattatcttataatcatacaagaaaaaaaattatatcataaaatataccatagcttttgacataaacaaaaatcacttttttctggttatatgtgaacctatcacaccatccttcgcaaacatacgagttaatatgggttttgatttttttttgttttattgtaaatttgtaggtatatgatggaaaaaatatacatttgtcgacgagtgatgctcgtagaccggatgagtagagtattggggtacgttggaacgagggtctacgtagtatgacatcaagcagacaaaagataaggattatactggttcaggccccttatcaggtaatagccctagtccagtttatatgggattgatgatgatgagaacagattacaaagagagtagtcgaaacagacgataccgacgagatcatagtcgatggactcgacgagatctcccggcgacttggctccgcgtactccggcttcgtaaactttggtgggtgtgtcggagatggaattcgattcccgaaacccctcctagggggtcccttttataccatggatcttcttgaccctcaagaaaggtttgaggggataggacctggtacggtataacagaaattctatctcttgcgagtaggacttcggaattacttgactcgtagagatatttcgttccatccgaaacggtttccacgtgatatttatgggtacaatccgtatatgttaagatataccttatcgagatattccataagtcgtaggataggaggtataccttatccgtaaccctgacaatattgttaaaattatttatgctaattataaacactatctagatgattatgacacaattaaaagatataatgtggtttatgtgatattttttattgtacacatgtatgttttttggcgaatagtagtgttccatacgtacataattttacctcttcctgggacatacttttctctcatagggtaggtgtgcatatgtgtacttatatgacgagtgtgcacgcgtttatatgatcacttgtgattgtcttttatatcactagtaaaaaaaatactttcaagagaattggcgggatggtttgaagcattgttgatgtggcttctttgacaacatcatcaggaatagttgctatatatgcacaattcgagaaaaaagcgtagagctttcaaagaaagagagagaactattcgatgggattgatcgcgtacacacactacttcttcttcttcttcttcttcttcttcttcttcttcttcttttctttttgacatatctttctgtacttacatacaaacggagggattagccggtttttaacaatgaatgattacttgatagatataatctaataattaaaataatagatcatcagtttaagtgtaaatcaatggttaggtgtttttttttcttataatttttcttagattttctctaatatattacaacgtcatatgccatcttagaagagtttataagagtgtaggaacgatattactaataatgtatccactgatttaagtgtaaattaatggctatatatttttattttttttcttataagtttcgttagatttttcctaatttattagaacatcacgcggtatcttaagggtgtttataagatgtttaatagacttttagtatatatagtagataatattagtatactcttttcaaacttgccaaaagtcaaacaaaaacacgacaatacgcgccatgtccatgttagcccgtgcccctgcaaccgggagcggcgagcaggcgcctctatttgcgcgggaaagctccggcctgtccacaaatggcgggaaagccagctacagaggcgccaaactgggtttgaccgggaacagctggccctgcgaccgcagcaaacgcgagccgcagtgacacgagttgcagacgccacccaggcaggcgcaggccctggccataagagcaggtacgatagcaggctataagccatctataaatatattttaaaaagataaagaaagagagagaagaacagtgggctagccagctgcagcacggacttcaagacgtaatatgtgtatgataggtgagatcaggtattaatagtatagtaaacaactattgtatgaattaactattacattgactatagatgatttggagcaagtagtgtgttgcactattgacctcgctctaaatacaaataatcgatctttcactgactgctgcctcggtcaattcggtcacaagctccaagccaagaaatgctctcggttatcttgaaaaccgtacggtctccgtctcctctgatcgtcctatcaccaaacttcgccagctttggagctctgttttcttcggtaaaacccctcttaacaacgtccatttggtacgaccaccggcagtccggcactaattatccgtctaataaaaacacactactagcaggagtactgtacttcattacactgtagctacgtgaaaattatatcgatccatggacgctagcgggcgccgctgcagctgcattttctgacctgttcgcacggcacgcgcatgcgatgcagtgtagacgcaacagctactactactcacgagccaggcagccaggcagtagcagcagcagcagaggcagagtgcgtttctttcaccgaagcggtgcgctgttgcgacgggcgtgtcgctgcggcggcgcaggcgagtggcgaaaggttggccggagcgactcccagaaaggggaggagctacggctgcgctgcgctgccgtgccgcgtgctgtgggagcgtgcaggccggtctggagacaaacgccaaaacaagaagaggaaaaaaaacactctactactcgagctactgaggttcaaaatgctcgtcaaaccgtcgagtctttgtttgcgcgttctttatcgttgttttttcgcctgtctcctggttggtgttcttgcatgtcttggcaatgtagagacagggttagagagtactccctccgtcctaaaaaaagacaaaccttagatttccatgctaatgtttaactgtccgtcttatatgaaatttttttataattagtatttttattgttgttagataataaaacatgattaatactttatgcgtgacttatctttttaattttttttataatttttttaaataagacggatggtcaaatattggacacggaaaccagatttgtctttttttttttgagacggagggagtaatgtatggttatagtactagtactactactgatgtccatcttttatgaactgtgctcgcttgaatcggtcgggaagaacactcgggcccctcgctgctctcttcctccactcgaaacaagatcgcttttggaaaaagttgcgtctttctcgcagcagagagcatccaatgcacacaccaacatttcgtttttcaaaaaagaaggcaaccgtgcatgacgcccatccgattcaaaaggaaaaaaaagcaaagaacttgtagttgtaagcaagtctaatagtataagctaactactggctctaattcatctacagccaaatctaatagctaattcatataataattacagtgcatactacattattaataactggttccacctgtcatacacacattgtgtcttggagtccgtgctatagctggctataaatctgtagcccactgctcttctctctcttcatttatcttcttaaaatatgtttacagctaacttatagcatgctattgtaaatgctataagagcacccgcaatggtaaagtaaggtgctctctataaaacatgtacatctcagcaatagactagattaatagtaaaccacctcaatagtatgtctacaacagtatctatagctctctcatgtattgcctcgtttttctctatagactatctctaagttagtagatagttttgctctctctcttcatttaatatctttcaagtagaaaaatatgctgacatggatctcttgtagagagcctatagataaccattgtgggtgtcctaagtgcaagtactactaccgctaccgtaatcagcaactcatcggccgctcttgaataaaaaggatcacgtcgctctccgggcacgtcacgaaatagcgggctcacccaatcgggatccgacacaggacaccccgggcttgcatcactgcaggttcatgttttcatttcgctcgtatagagtagggcatctacaatgtgctaaaaagtaggtagtaagaaatcctactacctagtttactattatgaggcatgtaataaagtgagcaatagtatcatctgggtagtagcactactatcatgtaacaagtaataaacaaatattaaaactctattatctctcattctttctctctacctcacccatccactcctcttaaatgtgggacccagcttacctatacattgtgagaatcaaaacacctactatccagttttgtgggtctcatcttactacccacttagtaaatatacattgaggtaataatatcatccgttgtcatcgtcagtaatcatcgctaaaagcaacattagcaccacgcaaacggtggaaatcatgtcacaaccgtattcccctgtgtgcatggggctctcttttcctattcaaccatgcaatcaatcgttctggttatcttttattctttcgttttttctttcttttttatataccagatgaaaccagtcattttctggtgggtgaacacgtccccacgtccaccgcctcaacgcctcaccctcctgatccggatagcgttttttttccagaaaaaaacccgagaaaaaaaatgcgtaaacacttgaaaaaagaggggcaaacgctagcgtagtttttttcgtggcctcccgaatttcattggacacgataataacagcggcctacgcaacaaacactttttcttgtaaagaaattttatgggaaaaagaactacagaaaaagctttttattgagagggaaacgtgaaaaacttgaacgaaaggacgcgaaaaaactctgggtacgatggtttcggcgagttcgcaggaccaaaagggtcccaccacgtcggccacagcggttgccgtggaccccaccgaccgcgacaaccgcgccgccgttataattgacggagagggagggtgacgtgcgtggcgcggggcccgcccgacagcgacgtgggcgccaagccgtatcgggaatctccggcgtggcgcgcgtcagccaggcgcgcggagattcacaggaatccgagaggccgctctcctcggtgggacccacgcactggggtgcggctcactgacatgtgggcccacggagagagcgacaggtgggctaagcgaggactacatggcagcagtttgccgtttgcttgcctcgcccttatccgcattgccaccacttccacggaagggattctgacacgccactggaaaacctgctgcagtttcgatcagtacttgattttaaaggcaaggcttcaaattcaaacaaaaaatgagaaattattttttcgaaacggtgcatgcgtaggggcaaaaaaacggtctccccagaaatcaaactcccctcccgccacacgaagcaccatcccgatcaccagaagggacgcctcgggtgggtcccgtggtcagttaccgatgcagcggttcgtcgccgtcggcgtcgtttcatctggctcgtcgccgaacgggccacccggtcccggttcagtttcaccgcttttcactcgatttatggcgggttatcgggcgatgtgaaaaatgcaatgatgcagtggtgcgttacggtgcgcagcatttgcctactactgctgctacgtgacatgtgcccgacaccacacacacatcataccactgcctctttctcttttccactcaccgtagtaccaaaactccccgctttaaagcgctcacgactttaatgcgctgtaaaaaaaaatcgtcctgagaatatgcaattctcgtgaccgtatggcgctaacccatccctttacccccgccgacgtggcgtgcattcaatggagcaataacaatctcactaggtacacgcacgaaacacgccgtgaatacgccgtgattgggcactgttcggtgtgagattttcacaactggggattgacgagaggtggtgcgtacagcggccagggtagagtgggtgttgtatcgccgatgtaaaagaaattaagcttttgcttctgctccattttgggtccatttgggtggtgtgatcttctctaaaatcggttgaaccaccatttagcaaacggtgtagtgggtgaaatgcgcttgacatgatcgccccacgcacacaaacatccggcaaaaatataggagtagatccgagatgaattcgtaccacaactacgtactgaccccataataactccctcggtcttgcattgcacggcccaaaaaatacgcgcaagagtactcgaaatccccctcgctgacgctgaacaggggagaggcatttgggggcgctacggttcaccggccgtcactcaactcccacttgctcaccactccaaaaaaaaaaagaaaaaaacatttgatttaaaccgcttaatttacgcaaaaaaaaaacactgagagatgataatccggcttccctttctctctcctctcgctcgcctcttttatagcccccgtcgcggcgaggccgagcagcattttgactcgcggtgccgccgtccagcgacattctcacgccccccatctccttctccgcccgcttcttttcggcgacaagaacctctctactcgccgccgcttgcgtcgcgctcggcttcgcgcccttcgttctccgcctcctttgtgtgtgggggggaccggccggatagctggttgtggccgctgtccgtacggttcgaagctgtcactagttcttctcgtcgtcctcgggcgggcagaggttctcgcccaccaaaccggcacgccataactctcgggggggaaggaggtcaggattgttgtggtggggaattggagggaaatggcgacggagtggtccgacggtggcgaggagttcttgctgccggatgagttcctcgacgacgacttcttctccgaggaggagaaggccgccgtggccgcgaggagcgatagcagcgacgaggaggattgcttggccggcctctcccgccgcctcgccgggcttcttggtgacgacggcgagcgcgacgcgcctcccaaggtggtttgatttttcttggttctttcaaagggggatgatgtgtcgtggtttttgattggtttttcgtgtgcaggcggaggtgacggttggttcgccgcagtcgacgctgtgtgggctgcccaagtccggccaggagagcccgaacggcggggcgtctcaggtgagctcgccgccgtcgtcgccgttggagcagaagccggcggacccgtgggacatgctctatgaggcggcaggtcaggtggcgcgcatgcgggtcaccaacagcatcccggtgccgaacaatccctacggcttccccgcccacggtggctttgccgctccggcgcgcaaggcctcgccgccgcctcccgtttctccaccggcaacaaaggtcgctcccgccgcctactaccatccgctcgcccagttgcttacacagcgccagattcaagccgcacaggtacttggttcatgcagagattcttcagttgcaccgtcgttttccgcggttttttctccccgacatttttctcctgtttcagtttcatctcctcaagcagcagcagctgctgaagttgcagagggatcggcatctcgccgcggccgccgcgtggggcgcgaggcagacggcagcggcgaagaccgccgggtgcggagtcgccgcgtcgcctgtcgacatgaaccctgcggcgtggcctcccttgcagaagcagcagcacgcgccggcacccggagtcgggggtggcggcggcggcggcatgcgcgccgtgttcctcaccccgcccggcgccaagcgcgagcgcaacggcaccggcgtcttcctccctcgcccggccggcgcaccggcggagcccaagagaaagacaggtgcagtgtccgccatttttggccgtttgcttttgccggcgtattcccctgttcttttggctcaatattcttcccctttggtgttttccgcgaccctgcaggctgctcgactgttcttgtccccgcccgtgtcgtgcaagcgctcaatctcaacctcgacgacctcggcgcccagcctcgctaccccggcggtttcgttctcgatcacggtaaccaccacatgcggcgaaatcctcttttctcgacggaaatggcaagcaaaagcttatgtcgagttgtttttttttatgcagacgctttgattaaccggagcaacgccatgctggccagccagaagcggcgcgcgtctccagccgtgccgtcgccggcgccggcgcctgcgctctgccacagttcgtgaacttttttgtgtcggccggagcagacgaaggatgatgcaccaagattccggcggcccccttctggctttgcgtcaagtttaatcatattaattaaagttagtaacagtacttcgtctgttaggtggtagtattagccaaagagggtagtaggaggcagtagtatcatcagcgttaggtttgtttgtttgattggtgatatattggttttttggtgtggacggaaagcggcggagatggagacggagacgacgtgcagtagaggaaatccatgtcttcggtttggtggtttggcagagtggtttggaaggaataataataagtggttcttttggagggcgagagagaaatgttagcggcttgtgcagcttgcaagcaagaagtgacaaggtatcatcaaagtggtttatggatgggtcatcttgggggagccaaaaataaacccatttctacatcatccatggctttgcttgctttgggtgcttgccaagaagtgaagtaccagcgcacacccagctataaggtctctctccctcctccctcctttttgcagtcttttacttgcaaaagaagcttgccgtgggctccgtgaataagggcgttcctttcttaaggaaaaaaaagaaaaggaaactatgaatttaattgccatttttcttgtactagcttataggtgccctaaccttctgttttggttcggtacaataagattcttatttaggggtgtagtagttcggtgcttagccgcagcagcagcaaagttgggctgggtgttgttaaacaacagttgtatttgtaccatcaaagccttaatatatgaatgatggtgagtatttcttactagttgacaataaatacatgattatagagtggatggtgtagtacacttgcacaatggaggatgaacagtttgtccggcgactaaccgcctaggaatctgcctggctgtgggtcagcatctgactagatctccggtagtcccctgcgtgctcgccgagaaaacgacgcatccccaaagagagtcccaggcttggctcggctagctcgatcgcaggatccagcgtgggtctagctggaatgggtggctcagccgctggagccatcaccatccgtccgtccgttccgtcatagtagctctctgcctctgccgattttaatggccttgaagagttttggcgggagagcctctgcttgctccgctccgctccgctccaatgcccgccataaaagcaattttggattggatcatgtcatcatcccccgtcttcctcttggactggccctggcatgcgtattcatgggcgcatgagttcggccggtttatattctgctctctgtgttttgcatgcgtcctctcctctcttgacccggtcaaaggcccaaagccctcctctctttttgctcgatgtttccgtccgtccgtccgtctctcaccattgcgttgcgtcgcatggcgcaccaggcgtgtttccaagagaaagcgccctcgggttccaccgactcgacccccgaaagtagaccccctctcttcctcgcctcgggccgtgttacgatgatcttgtccctttttcccgctggggtaaaccgcacggtatcccatcccagtttttacctccgccttgcgggctcgggtggcgcgcacgacggcgtgggtgtgggtgcgctgcgccgagccgagcagacggggatgggggagcgtcgtgatcggtggaaaggtggttgcgcgcacctgatgggggtgaggagtgagctggtggattgatcgatcgatcgatcggtgtggggggcaaccggcacccatgtggccgtcacgttggggacgagacggcggggggaggggcaaaaagagccgaggtgaggcgctggtgaggagggccaccaccaccggccggtctcggcttgctactagtactagccaatgaaccaatggcgatactgggttggcaacctaaactggactagtgttgtggggccaccaccctgtaatccgttttaatcagctccgaccaatcagtttagaaatgcttgctgcctgcctagcttaagatgtactcctattctctcgagcgtattactagcctgtatggtgctagtactacttgcatactggtcacttgcacatattctacatctcaaaccacaagttgagtaatcacagattattagtatccctacgccttgttgcaccttcactatggacatcggatgcgaactacacactccttgaacgagtggaagtaaaaactttcggagactcacgtaggggcccaaatccaattggcgagcttccagagcgaattgacatgagaggaggatacatgtcgctgccgtccggtgcaatttatcctgcaattttcatgtacatgaaccgtgctttgtgcggacgtaatcaaatgttccggctataggggcacataaataaaggagtagttctccgtatcacgaatgtatagtgctgctccgttggtcaggctgatggtgggcgttcattatctatctgctctaagcctaggtcgtcacatggatgaatatagctgtggcaaccatcgaattgttaaatcgaaggtgaagtttcagtaatctgtataatcgaattgttaaaaggagtaatcatctacacagagccttgcctctgctagcaaatggagggcagagtgctcagcctgcactcttttggtctccgctgtctcttactagattctataattagggccttaacaaatcataggaaggtagtacgactgggacccccgttttgcagcaagctttgccactgattgtgctcagttgaatgaactcgaatgtatgattgattgcctcagcacgcactcgcaaccggcctacgttttcattttcttttgcagaaaaagaaaatgtatagggcctatttcgtttcgagagacttagaataagtcactgtcttattgaatgtttggatactaatttgaagtattaaacatacactaattacaaaacctattttcataaccttggactaattcgtgagacaaatcttttgagtctaattacgctataattttgacaatgtaatgctacaataaacttttgataattatggattaattaggcttaaaaaattcgtctcgtggattagctctcatttatgaaattagtttttttattagtctatatttaatactccaagttagcgtctaaacatccgatgtgacataggctaaaaaggtttagccccatctaaacacccccatagtatggcgttgttcagatacatacagtgacttgttcaatggtttgttggaacgtacagctctcttctgctctgtgttgttcacccaccaatccctcgataaccaacatctgctgaaacttgaaagcatgtgtgaaattcggttgccgtttggcaacattatgtatgaacatacatacgtctgtataacaacaaacaccggagagatcacaaccaccctgcaaaatttcgctccgacgcgcatatatatatatgataagtggagtatatggttgcacacaccggtaagagcaagtttaatagtatagccaactactagctccaattcatttatagtcaatctaatagcttattcatataatagttacatactacactattaatacatggccccacctgtcatacacacattgcgtcttggagtccgtgctacagctggctataaatctgtagcccgctgcttttctctctcctcatttatctgctttaaatatgtttgcagctggcttatagcatgctattgtacctcctctaagaagtcgtaactaatccttaataattttgtcggcaactaattctccatcttgggagaggaggaggatctgttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttagactttgttcagcaactagattagtagatggcagatggctctgttcatcgtatgaatgaaaattttcaggtatcacgttggtggcggatggcggcaaccgagacaaatgcgtatgaacagggtgtggtagatcgatggagtagacgccgacaaagcgaaaagagaatgtccctggatctgggcgtgatgacagttcaccggcttgctggggcagcggttagctgtttctagctgttggaccagcaggtgtgtagtggctgggttattttttttcccctcctcgtcaggactaaaccgaggaaggatgcagaggggaccgagatacacaaacacaaccactgtcagcagaggaacagctaggatctagtaagacaaccagttaattaactctggtgcctttccctttgaggaccctgcaggggtccacactattgtctttggtgaccaaaaaatatctacaggaggggcattgcattatgggggtgaactatgttttatatctcctccccatggatttggtttcttttggatcgtcaaattagattattggacgagaatgtaaggggaattgcattgctctccaataccgatttttgtctagttgcaaagcgcgtaaaaacgattatagatgattatgaatcggtggattctacttcatgtgtggctgaaaaacatgataaaattggctcttcacaaccgcctactcattggcgtcgaggaactgttgattcaagtgagcaggtagcttgttgatagcttaaccacctaagaaagcatcagatatgagatagagtaacacatgtaaccaaacggatttatgtagagtggttggatatattaccgaacttgccgaaatgggttactctatgttaaggacaagtgttcatgttctctctgtatttttaacacatagtagtacagatattgtcaagaaagacagctgtgcgtactagagggagggtgatttcttaagctaggacagtggtcactagtgcagtaacaaagtactctaatgatctaatctactcacagactgtagctatgtgcctatgtatggtctactgtgcaaaaagggtttgttttaagctttcttcaggatggggtttgaccgtttgacacaattggcaggcactgctgtccagagcatagctgaggaatgcaactgagaggcccacctgtcggccagtgtgatctcgagcacgcggcaatccattttccgaacatgggtttcttaacttctcatttcgatctgctgtcgcagaacatggcgagccacccccgacattaataaggcaactctacgtgccagcgcgcgctaagctgccgtcgacggacgctgcaagcaacacaagtcggctcgaccagcagctagcgctaatcaacgcgacgcatggaccatggcacggtgcacggatgggctccatccagcaatctgcttatttaaagatggcttccatttcggtgctggattgatcatcagagcaggtacaatagtaggctataagtcagctacaaacatattttaagaagataaataaggagagagaatagcagcgggctacagatttatagccagctgtagcacggactccaagacgcaatgtatatatgataggtgagaccagatattaatagtgcagtatataactattatatgaatgagctattagattgactatagatgaattggagctagtagttggctatactattaaacttgctctcattaatgcagaaagcaagaaaacacaccatatattgccaagacgcaactgataaatggcctcctctcgcggccatgccggccggcggggccaacggtggcgcaagagtacaagccacggattggccccggtcggcggtcgctgtcgtgcacccgccgacggcatgtcgccggctttaagaaatcgcgcgcgcgcacggacgggacgggacgggtggcagaggacacgcgccccgcatgtcgcgcgcacgagcacgaggaatcggcgcgcgggggcagatggatggatgcggcccgggtcgcgtctgcttcacgcctcggctatcctcgattccctgcgaagttgtgatcgatcgagtatggcgtgctgcatggattggcttgtcccgttgttaatttgctggaagcgtcgtgcgtacattacgatcgatagaaggcgacgtcgcttttcgccgcggtgttgctataattatatcgacacattttgtgagtaatcacagtagatttcttgttcaattgatctcccttgagattcgtgtacgattgcaataccatgttgtcacgccccgaactagtcccgaacggaactagctcgtgacgctccaaattaacctgttaatcgataccagtcccagaaaacattgttggtatcacaggaaaacagaatatcacaacaacagaggtctctttattacagagtaggagtacagtcatgttgggttgcggacagatcccgagctcataactgcattacaaaagggaaaacggaagccaagacttggaccaatcatcacaggcgcgacttgggaactagaccgaaaccctaaaactcatcgtagccgacttgctcctggaagaactcctcgtcagcgggatccacttcatcttcttcagcaaccggggggattatttttatagagtaagggtgagtacaggagtactcagcaagccgtgggaattaagtgtttaatgcaggcttcaaaggaaaggctgttgtttttgcaattgattttatttaaactcctttttaaaacaactaagtgagtacttctcaaacgacacggatgtgacagtgtgtctcgtctggtcggagtatgtgcaatgtatcaatctttgaattgattcaaggttggcacccggccaacagctttcaaatggccacccgggcctggctgaccccatcagccgcagattttccaaacatcgaacccatttcacagcaacaatttcacaaagcagtagtcatacaaaactacgctaggaatcacctcacatccgcccatgaccatgggcacggctgttcgaacagtttaataacctctgcagagggggtacactttacccacacgacattactaacccggatcacccagcccatgcataacggccacgtctagagaccttgaggctttcatgacaaggcattttgaaagccgacacaggttcaccatatgccaacgagaggggtcccagaccaacaccaggttaggtcccacaccatactgtgccaggaaatccgggggttctccccggcaccaccccgttgaatccacatgtcttttggcatcatggttcccccgattagctaattactcaaccaggggtgtcccattacacccatgtggtcgcacttgtcttatgttcggatgaaattccaaggaaacgatccttaagtgcaagagtgggaaaccgtactcccggtacgttccccggtccgcgattttggaaattcatttagttcgcaagcaccgacccaggtgtcgggttttccaagtcttttgtaaaaccccaagttttacccatcgttggatattttaaatttgaggggaggtgttccgatgcgcgtgcccgaaggcccgtgcatcgaagcacaacagtcgacaaaggaggtttaagtgttcaataattcaaggagggtaattgcagcaattagggttgaggccggcaggctatctcgcaagccgtggccgaaatacttgtgttaaacatattcatgcaatatttgcggaaaagaaataattagatttaaattataggtgcaagatgatcaaaggtgacttgccttgcttgagatcttgagcttgatcctcgaaatcctcgcactgcgggtcttcgggctccgaaactacacacgaaacgggacaactcaacaaacggcgaaaataaagctctattattgacctctatgcgtgccattggatagatctcgagaattgaggatttttggaagttgaacggagtcaatcggatgtacggttaagaagatattgaatttctaagattattggatttttgatctaaaggaaaaatgatttatttaaatccttttgaaaagaaaagaaagagggaggacgagtagacttccctcgggcggctagggcgcggcccgagagaagaggcgcggctcggccgagctaatgggccggccggcccgagaggactcggcccagtagggtgcgcgggaggtgagagagggaaccggtggaccgggctcacctcgcgtggtcccgagtgggacccgcttgttggtgacacggttcatcgcgcggagggagcacgcggcgcgcgctagggtttgggggagggacgcggtgcacgcgcgcggctcgcggtgggtgcggatgcggcgggcccacgcgcagccttacggatcacggtggaccgcgcgcgagggcggggcggaggggagcggcggaccaaggttagcttgacctggtcgcggccgaggtggcgccgacgtggcgcctacatggctgccacgctagccggcaggaggttgaagaaggcgtcggccggaacggacgacggacggcggctgcgaacggcggggagaaccacggtgatacaggcgaaagcgagcacaccgggaggtagcacgggacgaggggagacgagccaatggctcggattcgccgagggatgctcgacggcagcggattgctgcggcggcatccggtggcgagaaaaggggaaagggtgacgggagttcgatttctccggaccagcggatctacgcggccaccggagtccgttccttgcgctggattaggagaaaaggcaccgagggaggccggcgatgagaggcgctaccgagctcgggcggcgacggcggcgagcacatagcgggcggcggcaaggcttagggcgacgccagctagctacggggggtctagtcgtgctactactcgagtctaaggggaggagagggaacgaggagggagaacggggagtgcactaccgcgacggggtgaaggggcgtagtgacgatggccgacggcgcga

SEQ ID NO: 19671 - DNA, 26915 bp, Oryza sativa
ggcgcaggcgcagcgtggcagggcgcagggccggacggcgcaggcacgggcagcaggcggctgacgacggcggcgaacgcgcgggcacgcgcgcgcgaagcaacggtgcgcgggttcgaaattcacgggcggggggtcgccggggagagagacggggagagggagagcgagagaacgagagagaggagatggtgctcggctcgactcggcgtcggctcacgcgcacacgcgtgctgcgcacgggcagagcgaggggaaagctgagggagagagacagagagagagatgggccgagagggaaatcggcccactgaacctgagggaggcaaactagactttttcagagggatggaatttaggagagatttggacttgaaatttgaattcgacgatggatcggggattcgagatcagagattggcacgcacatagacaacaagcaaagaaacgactttcgcaaatatggtttttagaatttaattttcccgctaggcgccacgacggaacgggcgctacacatgtgcatggaacgtctttacgtgtttcgtgttgcatcgtgaagccaatcaattcaaatttctcatctcgtcagcatgtgttttcatgaaaaaaactactacatatataattttaggacttacatatgtaattttagaacttacattgtaaatatactaaaattacatatgtaatttagagacttacatatgtaattttagaatttacattgtaaatacactaaaattacatatgtaatttagggacttacaatgtaaatacatgctgactatttgttggtgaaaaatatggcgctataaatatagttaccccctttcgccgaaaagttttcgggaagggtgcattttcggatctgatgttgaagagccggcgcattgcacgtataagagtttttccgaggcgactacgaatcggacgcccgattaatcgggctctattccaccaagtagatcggaattatttcactaagtagatcgaaaatgttcaatcgtttaaaaaaatgaaatacaaccaaatcacctcatggaacattttgctacaatgtatgaaacaaatggttttcaaaaaatcgggtattgttttaccatatataaaaaatgtttaagcaaatagcgagatgttttaattcactgcaacatttgatctatacgtagtgtaacatcatgagtacaacaaaaattgaaacggattctcttaatagagcgtttccataatatgtgagtaatttgttgcaaaaaatacaccgtttagtagtttgaaaaacgtgcgcgcggaaaaggaaggagatgggttggaaatattaggggaataacacacggatccggagcgctcctgcatattggatgcgtgggaccggcctctctcccacatggcggatgcgcggactaccgctgccatacgcacgccctttcccaactcgtgaatacatgtccgcacggaaaacggagcagtacattagcacgtgattaattaattattagttaatttttttaaaaaatagattaatatgatttttctgagcaactttagtatagatactttttgcaaaaattacaccgtttagcagtttgaaaagcgtgcgcgcggaaaatgaaggagatgagttggaaaaaattgggggattaacacggaataacacacggagccggagactggctcgataccacgcgctggaaccgcgggaccgcgccggtgccgcgccgccgttatgcagtaccgccacgctcccccgacgccatcgctcccgcgcttcggcgccatggtaccgacttgatcccgcagtgtagccatgcgagaccggctcagtcgcgcatcccggttccgcttgaccggctcgagtctgcggttcgccctcgctcccgcgcaaccattccgcacggattagatatatttttataaaataatcttatacaggtatataaatgcaaaatatgataaataaaagtacattttcaaattcttttcgtctatcgtctctacgtgggcaccatgcgagcgaaaacccagaacggtaaaacaccaaacggcagtagtcggtgtcatggctcatggtgtgcgggcccacagcacgtcttcactacaataacaggctataagccagttataaacatattttaaagagataaaaaaagagagaaaatagtagcggactacatatctatagccagctgtagcacgaactccaagacgtaatatgtgtatgatatgtgggaccatgtattaatagtgtagtaatcaactattgtatgaattgactattacattggctatagatgatttgaagctagtagtgggttgtactgttactgtcaggtcatgcattccccgtcgggcacggcacggcatactgctcccgaacccctactgctccggtccgggagtacacgggactacgagagttcgtggcaaagctccgtaacgcactacgacgctgcctgtctggctggcgtctgggctctggccctctgctacgcatggccgcgacttggacggctgtcgtgttgctctgatgagtgaatgtacggtaagctgggcctgtaaagtgattctagaacagaataagtccaccttgactccctccaatatagttgcaatctcatccgtattcttgatctgcaataccggatatcttcatccttagcctattaaaaccgaactaatttgacttcctcagagtctgcttggaagctctgttttttgcctaatacagatgtaaaataccaacccaaatcattttcgagggtaaatgtagaaatggtgaatggatggtccgtaggccaaatatacctccgttttgggcccattccgctggtaaaactagtgtggactcaggaggccacatttttttagacagatgttggggtcactgtcgctcgcagccccctgcccttcctccttacctcgaggatgtcgacgcgacaatgcctccttcccaagccttcccaagccctttgtcacacccttccttctccccctccacgatgccagcattagcggctcttccacacgccgtgtctcccccctcccagatactagtgccatcatcagtgactcttcctcatgctgtgtctccgttccgtcgtcaccgatgccgccattattcatagtaaaaaaaaatgaactggtgggtgacccgattgactggtggcctaggcggttgaaccgcggttcacatatatacatgtatgatattattcccttctattcacaagtcctgcgatagcctgattagggcatggcactctgaactcgctaatcatgcactcatgcatcgattactaaatacacacatttctttccatttttgctaaaaagaacaccagccacaaccagacattgatcaaacaccagccgatccaactagtccgggatcgcttgctaacatatcacattgacttggtccatctgtactgacgcaatagtctagatacaaactataagtgtggaccacatgtaagtgacaagaaaaaaaaattaaaaaaccacagaacccacttatcaacgctcttccccctctctccttttccctagtcaatctagtttctccttcatgctcggcgcaactacacaactcaggtttggccccgatggtcttgttatggcatcgccaccgccggaggagggagagggatccgttgcggcggtggaaacgcgctagtcaggcgtcggtccgtagggagcgctgcctgtggtatgaggaagaattgggcgggcagcctcaccctgacatcaccgccagcggaggagagggagggatctgctgcagcagcggtggaggatgtggtcagcgaggagcattgccctgtggtaggaggaagaagggacggcctgtgcggtgtccaccgttggacaacaccacaggacgtggtggcgaggctggtgagcaccgtggcagccatttgctgctccctcgtctccaatcgattgggcgagaaccttccaaaagctttgggaagcccacctgatcgagccatggagaagcagaagccaaccctcgacggcccctcctttctctaagctgctccaaggtcgagctctgcttgccccacgcgccgccaggaaggagccgtcaacctcacggcttgagctcttgctggggtgagatcgagggagaagtcgatgctcgctactgctagctccctactccacccaccatcgtgatggtgggacctgctccgcgcgagctgctgctccttgctgctcgggatgtttctggtgctaccactccttgcccgtggtggctacttctgcttctccttgacatgccagatcaagggcgccatctggagctcgagaacttcacccagagagtaacgcgaggagcggaccggggagataacggcgatgatcggcgagggtggaaagaaagaaagaatggaggaggggggctcgtatgctgactctgttgattggactagtcaacaagccacgttagcgtaaaccgctgagggagttaaattacaccagttctagttctaatagttagggtgttataatatctggtattgtggaaatacaaacaagattaaacctatatggagggaggggcttattctttttagaactgctacccaagcacaaggcctacggaagatgaggttttatggataagagaattttgttcggaccaattactgtctcacggacataactggcctggtaatttgtcttaaaaaactaaggttacgttgtttccgaaacacaggactggtttggtttaaggcctaaattaggcttactaatatttggtattttcaatagtgtttagtgtgtatttggtttgaagccaaattttggcatgcctaagaaaataggtcatttcaatagtgaatttaggctattttggcttcaatccaaacacaactttaccttatcaaaattaaacataccaaaacttgctaaaatttgacattgacaaaaattggtaaggcctatttatgccacaaaccaaaccaacccacagtcttttttgtgcattttataatgcattaacctgattctaaactaacgtcagttttcttgttcgtaagatacagatgcttacacaaatacgggttttgatttttgaacacattcacacgtactctatccgttctaaaataaataaaactagaacgagatgtgatacatagtgatacgaaagaacaagcttaaatttttctttaacaacccgcacgagacggtgcgatattctattgatagagcaggaaaaagattacaagattacaaccctggagggtcgtaaccaggaaaaagaaaaaaaatataccaccacccacgcaccggcagcgccaacacacacgacaggagaaggttagcactagaccggccgctgctaagcgtgaccggccgccgctagaccaacaaatgaacacatacgagatcgccctacagcaagggggtgccaaaacggcgtcttcaagaaaagaagcgacggaaaaccgctgccaccgtccgtcagggctcaaaggagccaagactgggctttcacccggcaaccacccttgaggggtgagacagcacgacaacaccttcaggagggggaattaaccatcgttgtcggtccggcaaaggccgggctgggttttcacccgccgctccccacctgcgaatccacggctgacgcaccaatgctccaccaccactcaaactctgccgacatgtggggcccctgcaccgatgccccccccccccgctggccaaccttcgtacgccgaagaccgtgccacacccaccagtagctccaccacgcaccgaggtcgcctcttccaccgccggccgcgcttctcgcgccaagccagcctcctccaccggacgcgcctctcgcgccaatccggcctccctccatcggccgcgcctctcacgccaagccgacctccatctccgctactcgcgcctctcgcgtcgagtcggcctccactgccatcggttgcgccactctgcgtcaagctggtctccgacccctcctccaaacgatgctgcgccggtccgatgtagccgtctgcgacgccctcggcaagccgtccgaggccgccatgcctcctcccaccaccgtcatggtcaccaccacctcactgtcgccgccgtcacctcacacccgactccttccctgcctccactgccgcatctgccgatgtcgccgccgcctcctcagtcatggccgccgcaagccggccgccgttgccgctgctgctgtcatcagccaccgacgccagcagccgccgatgcaaaaccgccgccacctccaacgcagccgaggatatgttgtttgtttatttggagatgaagtgagcatatttcaaggccaaacgtgagggttaaacgtgagccatggagattggagaggacggtataccagcggcaccaactcctttttctaaagcagtaataaggttgtaacttacgaaagtataaaaacaacagaaatgtggcgagcgtaccgtcgtaccggccagaaaaattgaaaactaagacaccagcagcaaaatctggatccggtgaaatcgtcccgtcagcgtatacttgttccacttacagttacagacagggcatgataggatttgtgctagcaaaaactcggttgtccattgggcgttaaccaccttatcatgcgagagaacatgccatttgttggaacgttggcttttgctatctgttactcttagctgaccgggcaatgttggatgctgataaggactgtcagaattaggcagacaatttcgtgagctgaccttttgtttctttgtattttcccatttttcccctctatccaataacactactttgtcatcgtgacatcaagaactattttgttataccttttctcatgcttcaatttgttacacatgttatcagcatattactaaccaatacactaaaaaaacacataaaaaaaacatgatacttattctgtttgaagcagtgtagatgttggttgggcattttgcactgtgttttctcctagcatgtgttcgatttggagacgaagggaaacaggttagagtactcatatatgtttttaattggatgtaaccatttatccttttcgtatgagatagtcttgtttttaagagatgacccatatgtcagtaagagaaaactaatttgaatcgatccatgagtttgtaagagacaagaccaacctagattaaaggagtattctcttttaggtcttgtttggtcaattggcagtaaaagggaatggagtagattgagggtgaataatcttagactataataggtttagaataaatctctttcagatcctcttgtagaaaggattaaccaaacgtaacctcagatataaactcattcaaccggtcgctgaaccaaacaccctcaaaggtgagcacgcctcgtctcaccctgcctcatccatgacccaaacgcatatgcttatagtcgggaaactattttgattactcgaggggaggggatatcccctcgttatttacatgtcactcaaatggttatgaaaaaataaaataaaaaaaattgagaagatgtattaaaatgtgatatatcactccacaaacatgcaagttcaaattcaacttctacgttcttgcaacgaaaaaacaaattaaactatagctagttaacatatattcagagtcaaatttgatttttttcgttacgagatgtggaagttgaatttaaacttgcatgtttgtggagtgatatatcacatgttaatacatttttgatacttattttttttaaaaaatttataactatttaagtgacatgtagataacgatgggacatccccttatagattgaaatcaactccggcttatagtcctgtgtcttgtgatctcaccctttaccaatgctgaaacaaatactgggattcttgcacaaacaagctcaagaaaattcataatgcaaatacactggacacggtatcctctgataggtcaaagctaaaaacctgttgacttcgatagaaaaaaaaaaacatactgggattcttgcacaaacaagctcaagaaaattcattattgcagttttgtccttgtagtagcaattggcattggcaacataggagattgggagggccaggccaccaggttttgttggcatggcaccagtcaaagctgaccttttgccgtggcatcaatattttcctatttcaacatcacatgggtaactctggcatttagaattttgaccaacctacctctatcctaactgtcacagctaaattcccactggacgctaacatgtcacagaacaacctaacatgtcacttgttcttgcgagagatccaagattcctagtgctctttataccccaagccacgaagtaattaatcaatacacacctctccatttgctgtataatccttcattaaaccgtcgaatacaagcatctcatcgtggcgtgcaaattgcccatcacacccggcataagccgttgcaaccatcgaacatgtactctcacgccacatagcccatagccttgcatctgcgtgttgcgcaactagcagatcatgcgctcaagtgaaccattgcttaaagtcaacaaatgcacgtttcatttatatgtactgcaagcaacacatcacttccgtccagactaaataagccctgtgcctccatagcaaaaaaaaaaaaaacgaccagtaccaaatcaccaataatttcaacttttcaagacttattggtaatcatttttcaatgtatagtaattcatctatacgcaagtttagggcatacttcctccatcccaatataatcatcgtctaaaaaaaaggtagggactaaggacaacaagaccttcatcattcgaaaattaatcatcatcaatcaaggtgctacgtcgcttttatgccttgtgaattgcattacattttaaatattacatgaagttgcaccaacaaaaactaatattggttaattccatgcaacacatttactcgttgcacaaataataaacgaagagacacttgttagagaggacgattattttgaaaagacctaaaaatgatcaaactaagatgaatgtactattttttttactagaaggaagaagaaattaactcatactagcgatacaacatgtaacaaagacaaaaagaaaaaagaaatacattcaagcagacaacccatgagtattcctatgaattcctatgaataaaaagggggcctaagattcctttcaattccaataggaataaaatcctctaaaattcatgtgaatttcctttgattcgaagtgggtttaagatgtctgttcggttccgattaaaaattcaattgagtagtaataaaaagataaaaccttttactaagtattatatgtatggagattacaattatgtttattttgtttagaaaaataataaaaagagataaaataggtttttttagggaggaatcggtaattgaggcatgactgatcattattcagtctgctacagctgctaggagatacagtatcgatggcctttttgctctgcatcactgcatgtggcagatactactatacggtagtattaaaatacgcaagcacgaatctgtctctttgcgagaaggttagcactgacttgtcatgtagcagcatgatccggccacccgtcgctcgggtcggtatccgcaactaggacagggtatttgatctggacctctatcaacaaaacgccgtggggcctcgtgcaacagccgactccactagaccaggagagttgcatctgaatcttctactacatttcgaaaggccggtctaacgaaaagtttttgtggtttgtggcttgtgtttcgtcataattcaatcacggtgtttgttacgtggactgaataagttctagtagcaccattataaatgcacaaaaatacggtatacggcatgagaagagaatggaagtataaacgattgcgtttttagagtaacagtagaagagaagagcagagcagagaaattcagtaagggcttcggtttaaggcctaaattaggcttaccaatatttggtattttcaatagtgtttagtgtgtatttggtttgaagccaaattttggcatgcctaaaaaaatatgtcatttcaatagtgaaattaagctattttggattcaatccaaacacaactttatcttaacaaaaaaattagacatgccaaaacttaccaaaatttggcattgataaaaattggtaaggcctatttagaccacaaaccaaaccaaccctaaattaagaatcttaacgagacacataaggatgtccggatggatttgagggtagtaaaacttttagagcacgaagtcatgtgttttgctccactccacgtcgtccatccagatcaaacggcctcctcccaaaaggttcagttaaaaccccccacgaccttcgtgctccatcctcaacacccccctttttttcataaaaccccctcatctctcccatatttccaccatccatcgctctcctctctcgttttctcgatctctccacaactccccccccccctccagctctctccaaagtccaagtctctctcggtgctcacgccgccgccggccaccgccgccccccgtccgtacaccgcgtggcccgcccccgcgcaggtgagggagctagcggccttcgtctgccggcgccggaggcggagccagattgttgggaaacgagttttccgcccgcttctctggtttctcggcggtgtcttttactcctggggcggcgatcccgacgcggggatgcggcgggctgtggcgtgatgtgtggatcggagcatggacttgatcgcgtcgcacggtaggagctgcagcggtcggggtgggagcaggggtcgcgcggcggggtgcggccatgacgatttacatagcgcgggaggcttccaaggttttctctctgttttttttttcgatcttgtgctttttttagtgtggatttctttgtcgatcgcgtcgtgtgaatttgcgatttttatttttttcacctcttgttgtgtaggtatggaggaaggtgaccacggagacgtcggtggagctctcgctgctgcgcgagaagtggggattgctcctcgccggaattgtgtttcaggtgagctcgtcagtttgttactagtagtactagttttcggtcgtgtgcgtggaattactgatttcgcgcgtgatgtggttattgctagtggtggagtgcgttacagaattttaatgccgagttgatgagaggttgccaaatttgcccccccctgttgcaacgcgatttgcactttgttatcgttgataatgttgccgttttggggttttttagtagccatgtgattagcctttggggtttttttggttgctaggcgagaccttaaatagctatactaaatctgtagtcagtaacatttacaagtgttctgtgttgtatattggagtgcattctttgtagtctgtgtagattagggattcagtgctgctctttcaaggaatgaatgaatgatgccctgggcacagattgccttttcggttttgaaattgcaatggaatgtcataataaggaacagtcctgctgtatgcatggcatgaaaaattcattggccgtgagcagtataagaaaattgagcgggtaaacactttgttcaaatgtttgtctagctagtgccgcgctcttacatggtatatgccattgtagaggtgaattgtcgccatctgtgtcaattgatactcttgtattcatctgtcttctgttttcctttctgagacatgttaaatctatcctcattgccttgttttaaaaattaatataggtttatgtttcttttaacagtatatcgcctgaactatcatgtcatgcatggaaataatagttactatgcatgttgtgaattttcctagatgtattcttgtaactactattactttctcataaatccacaataaaagttcatgagaactatttttaaatgctactcaatccaacttattttgtctgtgatacagtcttgctgatagtagacagtgtcttctgagttctgacccaccactcactgatccaatctctgattcctatattattttgacatttgggatataagtgtgctgtctctctgaacactaaacagaatatttctgtgtgtgcactcaagtcatgtgacttgcacattcacagcataacggttgaaaatcttggtcaataagttcatgcagttttagatcgcaattcctaactttcattggaagaccatagttctgacagatcaatattgtttgttgtttccttttctttttggcgtgatggaaattttctgtgttcagttctcttttttttttctgcatttagttatataggattacttattcttctgtgtttgtcagttgattaatggattactttggagattcatacaatattttgcctataattagtatattcatgggctggctgctcgaggagtgcattacttgcatcgacctggtccacttctgcaggaccttggatttatggcccttccagtaagtaaatcacttatcctttttgctatcgattaatttgcatatgtaacagccaattattaccgttgtttttaggagtttgggcaagacaaaggttatctaagtgagagcatatttgcttccatcttcgcttcctttgttttagtatgtatccttgtactctacttatttctgtttgtttaattgataactgataatttgtataaccaagaaaaactagatcattcagatatcaacacctaagcataaataaaaaaataataggcgtgatctatcatcattctctgttgagagatgggtcatattcctggtcatgacatattgaagattatagttcctttcatgcatttatgtgattcctttttatactgcaacttatcaagctgggtctcacaagtatatttatgtgcagtggacttttcatccttttatttatcatagcaaaagattctacactgtcctaatctggcgccgggtgctagcctttttagttgtgagtgcattcttcctatttttccattgatatagtttatgcatgccactgaaaagtaactgaatatttcttcttcaggcttcgcaggttttaagaatcattacgttctattccacccagcttccgggcccaaactaccattgtcgtgaggtgcctttttcattttagccaagaattttacatgcactcttgctctgcttttggacatgtgaaaacttgtaaacctgtcaattactcattttagcactcatccgaagcttttacctttatagggctcaaagttggctactcttccaccacccaacaatgtatttgaagtgctcctgattaactgtaagtttctattgtggtttgacagctgcgcaaggaatttttcctgatcacacaagttcatttttctttttcagttcctcgtggagtactttttggctgcggtgatctgatattttcatctcacatgatttttactcttgtttttgttcgaacataccacaaatatggttcaaaaaggtatgttcttaccaatgttttctggtttgaacattaccaagttctgagacccctgaatattaactttgcctgagtgtattcctgaacactaaaatttaactggtggaccttttgttacaggtttgttaagcttcttgcttggttcatggccatagttcagagtcttcttataattgcttctcgcaaacactactctgtggatgttgttgttgcttggtatgataagtttagctccttgcttgttattgtcataatgtggccactacctctcttttcacatacttttcccatgcaggtataccgttaatttagtcgtattcttcgtggacaacaaactcccaggttatatttttgtcacatttgttgccttacgcctttacagggatttgtatggcaaacactttgtaacaagctttgttgagatatttacagaaatgccggatcgtacaaatggagtacctttgcttccattgagtaccagggaaaaggatggcaggttgaaggaggagaaagacagcagactgaaggaagagttccataagctattaaacggaaaccatggggatcctactgatcgggtattgtagaagtcttctccctatatactccctgaacaagcctagcttagtacagtcagcctgtctattagatgaacttgcctatactttatactatgctggatcctactttctccgtcccaaaataaacaaacatattatgagatgcgataacctgctcagatcattatactagaatacgtcacatctcatgatttgtttattgagacggagcgagtactactaaatttgtttacaacccttgctagtttaattactccctccatcctaataatatactacctccgtcccaaaatgtagctatttctagcacagtactttatcccaaaatgaagctatttttctacctaccttctcctctcaaccaatcacaaccattttttttcacctactttctcttttcaaccaattacacaccttattcaatcattctcacctactttcttaatacccgtgccaacctaaaaaatgcttacattttgggacggaggaagtacttcctagaatatacttagataatctggatttgacgtaacctagtagcagcttactcccttcgtcccaaaaaaggcaaatcttgggtttccgtgtccaactttgattgtccgtcttatatgaaatttttttataattcgtattttcattgttgttagatgataaaatatgattaatattttatgcgtgacttgtctttttaatttttttcataattttttcaaataagacggacggtcaaacgttggacacggaaaccagggtttgtcttttttttgggtcggagggagtagtttagtatcggattgtattctagtactatgagaatctggatatatacgttcaatctggttttaggttagtattatattttgggagagggattacaacaaaaacctcgatcttgattggaggagccatctactaggcatactggaacaaactgtcacattgcactttttttttctgacgtgtctgtttctatcaattcagcgacagcgcgcgcagatgaacgggaggcacgatgaagacatcaatcacgcccacagcacgctctccgacgctgctgtcaatggtggtacatgagccgcggcatctgctttccaccgggagtttgtcttctcgcgtcgaccccgaggagaatcctctgggggcggattgagaacaaccgcccggtccatctgcatagtgcatgcacatcctgaacaagattccagcggcagaggcagcattacacatggtttccttgtcgatttctgctcatccaccatcctggtactatagcatgatcgcagataaaacgaatgaaatgaatggatgatttggtgctctaatcaatcgggcggtagacgctattcaggaatcaggatcttggccgccgtagtacgttcttcggagtcactagctgtcgctgtacatagtggccagcttaatctttctgatcaattgtttgttcattcgtgtattggcacactcaccgacggttttggttgcccaccccacatgcttttcgcctggagcgtgtcgctcacgcgatgtggcacggacgcgcacggcgacagcgtgggtgagcggagcgggagaccacgtgccagcgcgtcgcgcgaacggcgacgtaggggagcgcagagcgatggtgtgcgcagctcggctatccgcgtcgaggtggaggcaacaatcgcacgacagagagcctgtgtgcagaggcggatggaggataaaaattgatcggggcacgggattacatcgaatcacaacttaataactaaagccctatttagttcacaccaaacttcccccactcaacttttcatcacatcacatctaaaacttttctacacatataaacttttaacttttttttttcaaactaccaactttcccctaacttctctctaatttcaaaaactaaatacagcgtaatgcgaagggtgggttttataggtacactaagaattagcagaccagggcgtggcgcagagatcggccacaacatgcgacgtcacccggtgaataggaaagtacattgctgttagacggagagtagtggaaggaagtaccacaggccgccagcgttcatgagtggcgactcatccggcatctaggtggctacttgttggacacattgcgggctgtggaagcgcaagaatttttcggcgagcgtagaatgcatcaaattttgttcctcatcttgattttctgttgattgccaattagatcgaggggattgggagtgattggtttgagtcttggtagtaacgcctcgatgcacaaacagagattgcaagaatagtaacaaaaactgagagtggaggccttctttccagataatgtggggactcaggtcatacacataagaatatactccacatctcataggtaaagattgactaaagtcctagaccccatcagctatatgctaaatccgcccctgcgtgtgtgattaggctttgttcacatcaccggcttggatagagccactggtgatgatcgtggagtgacacgggtagagtgagatcagagatggatggatgaacttggaagtaactgcaggagggaccatctgttttttcggtgttttaaacgagtggacgatacagtctactgaaaaaagtgaaatttcttcaccgccgcagggtggcacagcacgcgatctcatcatacgcgtccatactttcaacctgcatcaacaattcaacatcaacctgtagccgtgtcttggcaccgtggccttccagcaaccaatttgcatttatatctgggcctggctgcagcacggtgtaagcctagtttagtttccaaaataaaaatttttacactgtcacatcgaatatttggacacatgcatagagtattaaatgtaggaaaaaaaactaattatacagattgcgtgtaaattgtgagacgaatcttttaggcctaattacgcatgatttgacaatatggtgctacagtaaacatttgctaataacagattaattaggcttaataaatttgtctcatggttttctggcggaatctgtaatttgttttgttattagactacgtttaatacttcaaatgtgtgttagtatatccgatatgacaatcaaacccaaaaattttccgcaactaaacaaggtctaagtgtgtaaactaaaagacggtggtggtggtagtatgtactccagtatacgtccaccaagtatcgtgcaatttattgcgtgtttatgccagacacgcactgaatcgaacactcacaggagttccaatctctagtcgcaagattgtaccacgtgtactttgtactccatccgtcccagatataagggattttagatggatgtgatacaaatccagatccttatattttaagacaaaaagagcagtacaagcttcgacatggaccaaatgggtttcccccgctactccctctgtctctcccaaaagaaaccaaccttgtattaaaatataagaaaccaatcctgtattaaaatgtgatatattttagtataacgaatctagaaataatatatgtatcacgtacagtacgaggccggcttttttaaggacagagagagttgggccacaagtcagtaatttcttcaactcaacagttctcttcgtggtcaaacatatccacattagtaccacgaaaaagactgatgaaatgatatattgtttagaatgagcatggataaaaaaattctactagtactattctgtagtactccatccaacaaagagtactaacgtccaacaaagagtgacatttcatcatgtactccatccaacaaacaaccgaacacggagtcacaaacgtcgaaaggaccattacaggattatctccacaaaatcgacaatttcatgtgcggcgatatgcccaggaacttcacaatattgtttattctttctggcgacatgcttccgaactcagcacatttttctcctggaagataacacttacaccaaatcagcagaataaatgataaattgcctgagaagatagggaatggatacagcacaatctcttcctgaaaaccatgacagcactattgacggaacaaacacattctccattctttgttttcatctccatccagacaagggaaacaggaggaaattgtccttccagcttcttgtctaatggaatcttggtcgttgtgaaaggaggcaattgccattgacacagttaagatcaacatgccccacccaacatttttgtaccacttcataactttccttcacctcagcctgttcttcagatttactaaatccaacccacaggtgtgtagtaatggcattggagcttttattgaggaccatgtgtttcaaaacttagcccgggacgttgaaatgaaagagccatgagataacaaaggcgaaaaccatgcaagcaagaagaaagttcaggaaccgatgcccttgccaaaatctctgagtttcagctggtggtgcttgtgcaggtgctgtgctgttcgattcattccattgctcaacggattctgaatcaccaatgcctaccacattgcatgcggtagagctacagatttcacatatcctggcaaacagaaggatagatcatttagtttaaatgtactcaaaacctatcaccttcgcacttgaagtaagattgaaattattgagggccattcaattctattttactgaaatttgataaggtgattgacaggttatgtcattaaatgagtgtaaaatgttggggatatcaacttatcaagtatgatttaagcagtgtaaaaaaatgatttaagcagtacaagtatgattgatgcaattttgattgttaagagtacaaaaggtgtggagataaggagggatctacagaaaaggaagactacgatataaatcaatctaacaacattattgctctaaccaccatatactctaacattgattattgggcgagtaaggataaaagcctcagtaaatatagatatatttgcaagaattaccgcagtgttttcctatagccttgtactgcaaacggaaaaaaggtaggagctaaaacttaaaaattactaattgtccaaaaagatccaagtgcagacaaacacagtgatcagaattcagtctattcttctcagcatgggagcagcatagaatttcagggctcactattacatctcatagtgtgaaaacaataatcggtgcaatgaatattgctgaagctgatgtcacataagtaaatcattattaccaccaaggtctgaaatttcagactcatttgagaaatttggctctagaaatagaatcgaaataattttataaagtaagagttgccgtggttcacagtttccaattacaatatctgtggttcaaactttagtgtaattatattgttgaactaatctcattagcctaaactgcattagtcagcaaatgttcttgttagtagtttgagcaaatcttacagtgatcaagctgtggcaacaatatataagcaaaaataaagtaaaaaataatatcaagaacaaaacaggtacttgtgtgtcggtttgcgctaccgatttttatgagaaagaaaacaccaaccactaaaaaaattagacttgcagactagtttgtattgcccaacaccttttttacactgactagcaactaagccatgattattaaaatttaaaaccaattttgtctataaccatcccctgtctataataggccattttcctacgctggaagcggttatcacttcagagtctgagactatgtggagcacactatggttgattctcttaacaacaattttattaagtggatcaaggctaagtggagcacattatggttgtgactgagactcagtggatcacctaactacaattgtgttgaaacaaacactttcagaatggaagatgacacaatcacacctccctcgcaccatcaaatcgaaggaaaaaaaaaggcatgtcacatagactggcgcatcatagtatcagaccatgtcaatctatcaacaaacaaacttggtcaacacaacactccagaggaacaatcagatgccacggagaatctgtgagaaaagcagattgaaagaacgaatcctacctttatcctctccaatgatctcaaccttcccgattcctacaacactactaattaatccactacttcgccttttcctccccatctgctcctttacctttgtccgcccaaagaaagcaaagggaaaaaaaaacagacacctatcaagattccttaaccatgtgttcatacacccatatgccctagtatatatatatatctgaaataaatcttgtgttacttcgctcttacgctgatgcgtgatgccttatccaataataataaactaattgattcatcgatttatccgagctaacatatggagttcgacttcgaacattgcatctaatcaaatagtaattgagagtggattagatgagtgagtctggagcttacttgttgcctctaatcttgaaccatgtctcggcgcactgcttgtgggagtaggagaggtcgcccttgcaggagcagccgagcgtgatgccggcgccggactccgccgccgcggtctcgaggccaaggtggcaaatgcggcagcacctctccgccttctcggggctgcccttgatgacctcggccagcccggcctccaggtcgacgtcgtccagcgagcactccgacacgcacgacgacttcctgcggtggtgctcgacgccgccgccgccgccgccggcatcctcctcctcctccgcctcgccgtcgtaggagctcgcgcggacggaggcgcaggtggagatgtagtcctcgtaggcggtggagttgtggcgcgagtgcgacgcccacgactggtggtcctccgcgtcggtgaagtattggctcccctcctcctcctcctcgtcgcgctccgcgccgcgctcgaggtcgtcgtcctcagcggcgatcgccgactgcccgccgccgcccgccattgctcctaatccagacaaaacaaaccgcaactcaatcaaaacaaaacaaaatcccaatttcagccggcccaaagatcaaatcccaactcaccaagacgcgaaattcctcctcctccaagaaacaatccgaaccagtatctaccaacaacaacaacaacaacaaaaaaccgccgccacgacacgccactccgaatctacaccaccaagaaccaacctttgaccggacaaaaaaaaaaccaaaaatcaaagaacgcggccgcaatgcgatcgcgaggagcgatccaaagagatggctagcgccgcgccaccagacggccgaagcgtcggggttctcgtgaggtttcttgatccataaaaccgcacaaggccacggccacgcaacgagacaagcaggagagggaggaataaagagaacggattgtactggaatggccaacacccacagtcccacacaggctcgcacagtgtgactgtgtgtgagtgaaggggaaaagagtgaggggaagaaaggaaaagacgagccctgtgcttgtcggggagaggagagagaagagagaagagaagagaagagaagagaggagaggagatggttggaactctctctctctctcagctcatcgtcttatggccatggtgattggggttcgggagaggaggagggtgtagctgtggagaaaaatttaataatttgacattttttcgttgtctaattactttaattaacatttgtgaggatgatatatgagaccatctgagtgaatgaaaatgggccaggatgtcaaataatcgaaacccattgaaaagagtgttaaattatcaaatctctcagctgtggatgatggatgctgtggagtaggcaaacaacgactcaaccaaacaaaaaaaagatattttttttcgtgaaacagagaaaaaaaatcatatgttctgtcaatttctcatgccagttactaccaaatactgtgtgcaattagaaggttatactcctttcattctaaaaaattcaaatcttagaaatgaatctggagttctggacattcgtagcgtttaattctttttgagacggatggaacatatctcatcgtgatttcctgtccatgttttggttaaagaaaatctctatttttcttaagactgcttcagaaaggttcgattaataacaattttgttttaagaaattaaagaaatgttcatggcttcatataccatgggacctgttaattacctgtcaggtgaaaattaagtgtttgtttcatagcgtgtttttgtaaaaatcaagcataaatcataaactgctggtagcatggtagggtaaaatttctgagaaagaacagcagggaatgggcaacaacagaaaaaggggagatgttaaaggaagacacctatcatgtcttggccctcctagattatcaatgattcaccaattttaggagcaaatgtttgacccatggccattccattataagatcatttacaattgtgtttgtcgaattctgggactcatttgtaaggaatacatcacagagccatagtttatgagacccatactgttatcatggaaaagaagctccggttgtggatgagtgaatggcaagccttccatgatctcatttcgggaagaaccagttcatgatttcagtgaagcatgctcaatccgtactcaaaccagcaaacaacgaagcagaattgacagccttatttctcagataatgaggctaccagccttatgaattttttttttaacaaaatgcatccactttgattgattgtctgcatgactgcatcttaattttgtaggttattatacatcacagatttcacagggtgcagcttaacacatgcatttaaacatgggtaattgtagattcccctgtacttagcagggttgaagatagtaacaaaagatgcaggtatttttttggaggaaggagtacatattgtcaagtactggcctgtccatggttttactcggtacatcagtacatgatcgtatatcattatgtgccccaaagttgcatacgttgctcgatggatcggcagttcgatcgccactagaacggagtactacttagtagtactcgatccatcgctccagcacgcaatggctagctttggaagggaggcaggcaggaaggagtccgccatgattcagttgctacagagctctgcactgcacactaataatgcagcagctggcttcgatcgttcgtcgggagaggctggctggccccctggctaaacttgtcaggtcttgttgctatactagagtagcttgttgcttaattcctaaaatccaatttgatgttgctatctggtggtgtgttgctgtcaggggcatggagtttctggtagatcattcgtaatcatagaagaaatcattcagggaacagtgtttaggttagggccctttgatttagaggaaaaacatagaaattttggtggattttaaacctataggaaaatttcctatgaagccctttgacacaaatgattgaatcctatccaatcctttaaaattcatgtgaaattgacaatcctatatagatttttggaggaaatttagccagagctttagggcccctttgaatcaaagaaattacgaaggaatttcataggattgaaatcctataggaaattttcctatgtagccctttgatttaaaggattgaagttttccaaatcctataaatttcctatggaatggcttattgcatattggttttggaggaaaattagcaagaggtccaacctcttggtaagaatcctttgagtctatttctctcatccgattcctatgttttttctgtagtctaatcaaacgatcattatcgatgatatgggcccgggggtacccatgctaaggggaaagggtcctttcccctagccacgtggctgcgcggcctgggccccatcgagaggggggggggtcgggcgcgcaggtagtaagtagccgaaaggcgcccgtaaccgcctaggggtctcggggtatcccgttgcacccctcgggcccgaggggctgcgtcgccccggggcccacgctcggctgccacgtcgcagctgagtgggtggaggaaggggcgctgccaagcgcattgatgggcggcgtcccaaccaccaccgccgcatttaatacagcgtggctggtcgtgcgacgtccaatcgattgacgtgcgtcaatcgtccttgaccgggctaagaccggccgcaggtggatgggatgggcggcagcgcacccacgccccgccttgtgtcaggcagcgtgggggcaggtatgccccgtcccatcaacgctcggagaccaatgtacaattggtgcctctcctgtgcatgcattcgccaaagtctccatgaatttaagagggaatgacgggggatgtccctcgtgtcagacgaaggatagcgctgggacccacctgaggacaagctgccaccttacttccggcctaaggcatggttggctactcagcccgggttgatgtgggcccccctccaaggacgatatgtgtagagacggtgcatgtggtaaccccttgaactataaaaggaggaccttgcccaccgagcaaaacaacgacttttggaagcttgacccctaggagaaagttagccgaccatctccctagggtttgagaactcttgcaacagcataagcttgaatccacatacagaagtagggtgttacgcttctcagcggcccgaacctggataaatcctctgtctccttctcgatcgccatccaccacgttagcgtaatcccacggcgaagatacgctcttgatcatcgcgccttattcccctggccgaactcacaaagggggttctcacgtcctcccgctagagaggttcactccttggcaattattcttgtgttttttctgtgttttgcaatcctctgttttacacttacattcctgtcactaatcctatgtttttcatattcctccgttttttcatttctacgattcaaaggggccctcaacctcttggtaactttccttttgagtctttctgtctcattcaattcatgtgcttttcctgcggttcaatcaaacggtcattcctgtgttttttctgcgttttgcaatcctctgttttacacttacatttctatcaaaatcctatgttttctcaatcctaagattcaaaggggcccttagctttcagtaactctttgatacttcctatagttaactagtgtagagtttctcgaaggaaaaaaaagagaagatagtgtagagttcttggtatcttttggtacctcttgttgctaagcagtcataacccttttatatgtttggatcatggataacttcacacgaattttgaagaacaaatatctcaaaattcattcagaattctactctgcaaaagtaaggaccctttttattaggaggaaaaacatagaaattttggaggttcaatcctataggaaaatttcctatgaagctctttgaaatattcaatcctttgaaatttctatggaatggataaacttatagagatttttggaaaaatttagcaagaactttaacctcttggtaactttcctttgagtctatctttctcatccaattcctttgttttttctgcggttcaatcaaacggtcattcctatgtttttcctgtgttttgcaatcctctgttttacacttacatttctatcaaaattctatgtttttcttatttctacgttttctcaatcctgcgatttaaaggggccctaaatacgaaaattggctaaaaccatcccataaaggttgctttcggaacttgaagtagtggcatatttttcattgtgtgcgttattgcctcctgttccacgtatccattattattttagaaactagttaaggggattgtgaactactattgtatattaaaccaacaaaatcttgatggtactgtactactgttcaagttcaaggagttcggagcgcagatcccatctagcaccaacaaagcatttataattttttttcaggaaaaaaaaagacagacaatcaagcttaaacttttttttgaagataaaacaagcttaaacttaaacaatcaattatttaagaacgtaagacgtaccagctatccaaggctataatcttgctggctgctgctatccaacgaacataagctcatgttttcgtgtaaaaaggggaaaaaaagaaagaagttcatcaaatttagacgatactaactagttcagtaacatgcatggaagcacaacaggaaactgttaaaagcatggcaaaaccggcaaaggcaaagtagagggaatctagcgaaataatagaagcagcaaaatgaccagaacgtcatgctaactgcttaacaaccaaagacgcaaagtatcaccaaccctgctactatccaaacggcaaagttcaaaaaatattttatgttttcgtgctgtttccattcagctatccatatccccatatatggtccattcccggagacacatatacaatactcctacttctaataaattctctaatttctccatccttctgaagtacataatgtcaccgaaagtggggcccaaagatcataggaccctccgtccagtgactataagcaggggcatgcgatttgcttgtatagttcgaaggcatggcatctttgattgagttgatctcaactgaaagctagaacagtagggatgtgagtgactttcttctgactaaagcaagcatgatgctaccctctctttgaactttgaagccctgaaagagaaaaggggattagctagcagtggttaggcgtcaaccgtcccacaatggcaataattaacaaaggaacaatccatacactgtactgctagcatactaacaacatcaattaagtcctagatagtctttgtaacctctaagcaaggtgtgattaaggccccgtttagttcgcgaaatgaaaatttttgggtgtcacatcgaacgtttgaccggatgtcgg

SEQ ID NO: 19672 - DNA, 6009 bp, Oryza sativa
tcgtctcgcaatttcgcctttaactgtgcaattagtttttgtttttatctatatttaatgctttatgcatgtgttcaaagattcgatgggatgtttttgaaaaaaactttctggaaactaaacagggcctaattgttaagtcatttctagctaacaagtgcctttggagccaggcttgatacctactctcttggtcctaggctgttagctgcatgctcagtctttctactcccactgagtattgaaacactcctgctgcatgcacagcaaacaaataatcagtccaacagaagcatatatgtatagtgaatgctagtagtgatttgggtgcagtaactaaagatggtttggttggtgacctctaccacactttcctcagacatttgttgcacttgatatgtattgtaaaagataagatagcagacaattactggagctttgcaaccaattattaatggaaagcagccaagcaagatggcaaaaggaaaacaatgacatgcatgtatgaacaattgtgtccatatatgtaatatcagtgtgcagagcagaagaatcttccgaattataagaggaagtaggaactctagctagcttgcgtctccataaattcagacagcaaccaatggaaggctataaattaacggagagaggcgaggtgtgtactagcaaccgatattacagtctataatggctagagattttctagcaagtacgtacttgcagcacatttagtggcgatgacagtactacatgtgtacaagcacgtattgatgcaaaggcacactgtggatgtcgtagcagcagcattgtcattactaaagcgtgaaaagaatcaggtcgagttaatgccatggctgatatataggtaggctttgcaggatagaggattcaatataatcacgcagaataaatgtatgtaaatagggccatatgttgtggcgtcatggacgtcgattggcgaacactcaaaccaaatgttgtggtaagaaattaatgcctcaaaacatgatgaataagatgagtaggagcagataaaaacaggagcaacattattaccacaaagagacgaggagacactagaatcatggcaaggattaggttgcaggttagctcgatcgcgccatgattgcaacgcaggatggcaacgtaccggaggcagacatgtcgaagacgatcaagctaagacctacattaaaactgtactgacggcgcagggctgcaagcaagatcatggaatcctctagatttatttcactatacagggctagctacctatagctttgtactccttctgtcccaatatatagtaatttttttatggatagaacctatcatagtactacgaatctagacaagaggcatatccagattcatagtactaggatatatcccatccaaccaaaagttgttatattttgggacggagggaatagtcgtcatgaagtggcatgtgcatatggcagctacccaatttatcatcgttcatcgttgttgtaggcatcattttaaaaggggattacctgtaaggatttgaagcgaaattagaaaacgcgtactctttataaacagtggatggtgaaatgaaactgagtttactcgagggaattgcattttgtaaagttcataagttaattttgaaaagttctctaagaaatacgaacgaagaaaggttttgcaaaaggtgtaccgtttaaaagcttgggaagtgcaccgtgataatccataatacataagctaccgaaaacatgcgtgtgttgcaattgtctcggtgataattgcgttgcatttgttaaaatgtaagtagataatgccgcagccttttaacaagatatgatcatttactgattgtgaactgtagtctctgtggtctctttcgtctcggtctttgtggtcttggagtccattcttcaggaagtctggttgtggtctgttgttggcaccgtaggttttgaagacttgttgggacattagggtggctccaccgttttttcctccctctatataggagcagttttttcgttagcagttcttttttcgtttcctttccgtgttcttttttttttcttccattcccctggcaaatgtctccatggcctgttacgttgtatattaaaatcttgctctcttctaatatgatgacgtgtaatttttttacgcgtttgcgaaaaaaaaactgtagtatttcagatgtccaggaacaagatgagcatttcttcaaaacaaaaacaaaaccaaggtgagcattagttctgcaagtctgcacctgtgatacacagcctagtcttgtcgagctcccacagtttagttggattaatacattatacatgctgaatatttttgaaacatctaaccagggccaaccaggcaaccaccattggagaaattcactaaaagatgaggaactactgtactaccatatcagatgtcaatcgagcactacgaggactaaagacaacctagggtacccaaaagaatgctgttatgtgctatccactttgcagaagtttgtagtttcttttgggtgaaattgtagcagaggttcaagtgttttcagtcaggcaaagtggtccaggtcacacgagcggttgctgttgcagaagaaagcataagctaagaccaagcccaattaccaggctgtaacacgcccggcaaaaggaaaggcccaagtttggccctcctttgaaactaggaacccgtcgctagagccagattctgacattctgacgagcgatttggtccaccactacgaatgcttattctccaggaaattcttctgtttctttgttactgtctaactgatcgattgaaatgtttcattttgtttggagtaacaaggtttttgagctaaacaattgcgaatttgtgttgtcccacaagcccaagacgatacaagaagccttcggtacaggagctttaaagcaaacggcccacacaaattctagatgcgaacggctgtaatttttttcgatagagcaggagaaaaattacaatattacaattctgaaaggtcgtaagcacaaaaagaaatgtaaatttgcaacactgaaacgctttcagcaaccatcgacgataaaatccatgatcaaaatgcagcaatgagcaagccaggtccagtgatccgtgtgatgaagagaagcccggagaagtcccagtgttgcttaacagcagatatcgccaggtcaggtaaaacttgtggagcagctgaagtcctttatcttgagttcttgtcaaacaagttcagattgtagagtctaaactacttctgttacaacttacagtacaggttgcagcatattcaagaagaataccaggtcctgccaatcttacaaatcacacatgtttaggctccatttggatcggagaattttacaatgtttccaaaggaattttgtagtgttttccaaaccaatgttaaaaaaaagaaggtacactgaatcatttgtctcaatgcagatcatggccaaattcaagataacttccaggtattgacaaacatgtttaaaggaatacatacagtcaaattcagtatggtgaatcctatctacaagttgccatgatagaattttgctttaacggggatatggtaaaacaatcaaagcattcctagtttgcaggcttacagcccattccaaaaaacaaaaccaacatgcataacatcagaattccagtgctaatcaagatcaaactcatacttgttgaaattgtctgcataaaacgctggaaccagaacagggtgataaactgatcatagcattcttaacagtagacaggttcctgaatcctgacacgagttttttttgcaggttattcagctttgcacattgtggagaagatttgcccagcaccatctcacttcatctttgcttctgtaaagagaacatgcttgttaactcgtggatcatacttcctaaattcaagcttctctgtgatccgacgaggattcttgcgcttcacatagaaaaacccggttccagctgctgaaacaagcctgataaaaatcgacgcacgctttgccttccccatctacctggtggctatcaagccacagaaagaagctgaaatcagtattcacgagaggaacccaagaagcataaaggcaaagccaaaaatcaaccacaaatccacgagaggaatcaagaagcataaaggcaaagccaaaaaaaatcaaccataaatccacaaattaaagcagaatcgcgagaaaggaaaagcaggagcaactcagactacatattcccccaatgatttcttcactggtaataacctcatagtgcaaggatgagtgtggatgtaaacatcactggtgctctcaggcttcagaaaacgaaaacaaacagcagctgaaatctccagccgcgtcatcagctcagtagaaaagaatgatccaaggagaggatcaacagagcatctcagactacatattcccccaattttttcttcaccggtgacctcatagtgcaaggatgagtttagatggatgtaacatcaccgatgctctcggagaaaaaaaaggaacactgaagaggaggaggagggggcagcgaacaaatacctcgtcgggcacggaacttacgttgtcgccgaaccggttcttgtacagcacagcggcttggccgcggcggcgcgccgacgaggttttggaggaggaggcggcggcggaagccctaaacctaacactcctacagtaaaggcggaagaacgcggtgggccagcagtgttttatactaataatgggcctttagtttagtatcgggcttatgtcattttaagctttttgagtgggaataagtctattttacctccctcatctcttgccttcgtcgaactagtaatctgcccgtgctaacgctacggtaatatttaacaatacaaatcaaaataacttttgaagaaacatattcaaaacatgtctaaaatacaaatatccaagcaagatatacatgtctttatccgaatgctaaatgatctgcccatatttatcattaaaataataactcccctttatcacaaatttattgtattttataaagttgttgaaatataaaattgtagtcaaacgcaaaaccccaagataaaataattcaaaaatcgcatgttttaatttttgtgaaagagagtagtaaattaaaataattcaaaaaatcatatgttttaatttttgtgaaagggagtagtaaatttagatggagcaattaatcgcatcttatatatgcacagaatataaattaattaaatatttgcataaaaggtatatgcaccaatattataacacgaattgtttcatgtcttctccaaaacagaacatttgacattcttttatctacaatttgcacacagatacattcggtcaatatcaaatttttctccataaatttaccatcagaacttcacgcctaacgatatacatatctctccccatatttccgtcctagaactatatccccatgtctctgtcctagaacctcgcataacctgtcaacacattttccaggaggatatggacaactcccacaactcatcacccaagaagtgcacctaggtaacacattgatatcctaggattgttgtagcaacaggtttcattgtaacacaataaattttaatgcacctgtgaaacctcatttaacaggtcaacttttaaaattgaaaaaataattaaagtaaattactattgataatataaaagtatcgtacaatacaaatatgcatttcatcactgcacaaaatatctcaatgataaaattgcaccagaaggcccaaacagttagcaacgtaccatgacaaagcacaattcattattggaccatttgctcaggtgaacagtttggtgccatacagacatgctctcgggaatatgaaaaagtttgaagccatataattaaagaggtaacttattgaagagaactaaagaaaactcaaacaagcctcgtccagtattgcagttcctaattattcaattgaaccatcatccatgcaagagtattgatggtctcagcaaacaatgggaga

SEQ ID NO: 19673 - DNA, 5582 bp, Oryza sativa
  unsure (1)..(5582): unsure at all n locations
gatatgatgtaacctctatgaatgaaaacaaatatccaatctctacagacaaaagaatacgctgttgatgtcaaaaaggggaaaactttgatcttacctatgatgcaatcccatttgacttgcttgatctggtttcatgaagcctctgtttcatgattaaacaaaaaatagtagctagcacttatgtctcttttcatcaccacagggtagcaacatgatccatgggtgttttaatactttattggatcaccttgttttttttacttagttgcctataacaatcgagtctagtacatcgaattcagggctttctcagaaacttatataattaatcaaacggtcaaatagtaagaccatgtactttgttttttttttcgagtaagagcataaactaacctgtatcaatatgaccaggaaagaagagtaaatgaatagttttatgtgtaccactgacagttaattgtaaggcacattctttctcatacctaactattgcttgctgcaaaatggatgaaaataagtgtgtccagaaaaagaagcaaaaccacaagaattactcatacctgatttcatatctccctcacaggtgaactggagagacacaagcatttgtaaatggaagaaaaggtcatacagattagtcaggattagtcaggacgtcacacaattatgcggaactgtataactgaaacaacaacctcattaccaccgacaccccagccatttcttctcctccttacccaaacacccaaacatgagcagatcacctaaagtaatgcaaatcttcattgatcatgagggaagcatcatatctcaaagagcaaaaccatgttcaatgccactgtacaaaaattaaaaaaacagtagtatttcgtgcaccctactaatttcaggagggtttacctcagcaaaatttagaaggatgcatgccataggagggttaacctcagcaaaattagaagaaacaacttcagctataaacactcttcaggaaattatacttagataggttgtaatgaactttgctcatgcaagaaatgcaagtttaccttatttttttgtaactatcctacaaggaagaaaactaacttgagctatttacaaaaaaaactaatcgcacaccacttctttatattcaactgatccaactgagcctattcgtcctgattcaaagtgcacccaagtttagaaatataaactgaatatctcgcgcataacagatgtacttcaaagtttgcccttaacgaatcagaaatgtgtcattatcctagagaaattagttatgcatgtatgtagagaaagattatctgggagttactaaaacagttgtaaatattccaccatatcttgagctaacaaaacacctttttcaagcaattggttaatgtccccttctccaatcaaacttataggtgtgtttaagaaacaatataaggcataaggatttaatttatctaaattttcttaacagcgtacattccaagaaagctctccaaatttcatatcagcatgtacattcaaacaaaagtaatgtaaaagcagcatatacttatataaaaattgagcatatgcatctaaataaatattgtagtacagtctacattattttagatacattactaaataagagagtagtacaaatatacaggtatagtattcactacccgattattcatttgtaaacagaaactaagtaagtctgctagacctaagattttctgggaaacaaagacaacttgaactttataaatatcgtaccacagtctacatatttagaaacataacttgggaaaaaaacatggccatttactgatataaaccaaatctgtggtcaatatatcgacttaaacactgaatataaatggctggccatgtatatagcatttcccgttgcaacactgaatcactattaaaatttcacaaagaaatttatatagtttgtaaaaatatttatgctcctaggattatacatggccagccatttagctttgaagttacctttagatggcacgaggagaaaagtaattccagcgttcaataaaacaaatgctaaaaatcctggatcctggacagttgatcctcggtgagcacctgagttataattcccctggccatgcaagtgtgtcgatgatatatgccactaactcctagggtcccatcattcctatagcattactgcattacttttataaacaaattatagaacaataatatacagtaaaattttcataagtcagtccttgcatggaattcagaaagtggtaacttttaccaaacggatttgaaaaattgaaggattttgactacactcagatctgcgcccctgatggcattcccagaaaaacactacctttcatttggttgtgaaatcaattgtcaatctctgacaccgggacaattatggaaaacaatcccagattaatgagaagtttagcttcacatttgattaaaaattaacaaaatctctatttgctacaatctaaaaaaaaactcgatagcagaacactaacctttgtttctcaagggggcacatctggtgtagtacaagtcttaaaatgcttcaatcaagaaaagcttctctatctgcagaatgtacatgtacagagttgttgtcatcatgagccaacattctcaaattctaaatcagcttccgcatttgaaaatactgcagaacttatcattttctgattccatcataagcaaccatatattcaggcatcccagaatgtatacaacatgttatttgtcctagtgttctgaaatgccgagctcatatgtagtttgacaccagccaaccggaaaagctcactccaaaagtgcccagtgaaaacaggatctcgatcactgacaacggatgtcggaatcccgtgaaaacgaacaatgtacattcaaactaatttggtatgttcacttataaaatcatatcaagagatttttatgaaatgaccatcagactatatgctatatgcttgagaagatttttctaactttcaggaaggccgtggtcgcacttatattctgattttctatagactttgtgcaaattctcgaaaggaactatactatatattaatagcaaaacataggcagtggttggcacttatgaaaaatctgcttaaaatattctattgtgtggtctagattatgtagataatagtcgcctgaaccattatattgtccatgctctaagaggaaagatctagctagtatgtacacaatcatatatgtgtatttacatagcaggaaatctggtcaaacaaagtatatacgagaaaatgaaattcatcaaacatcagaggtgagggttagaaattacctccacactcagatcagttgatggttacttcatattattagatcatataattatgatggtgcctcccattcgacaggtttctgacaaacaatgcacatacacattacaagagaattgtctgtgaccttgcagatcaaaatggggacatgtggtcaacctaacaaattgggtatttctgaaatgaacccaccccaacagaagaaaagaaagaaaaaaaactgtccggtattcctctgtctgcaaggtagggaaaaatcattaccaacagaaatcatttgtataatcacaccccaatgcatcagctatcaatgtagaccaaaagattcagcaatatgaaagttgaattaaggaaaccattattgatcaacctataacaggaaaagataatctgcagcatatcattgtatacccacagctttttcacataagcattttaacaaacacaaatcgtgcacacacctgatggagacagggaagcagcagtcctccacactgccacaggagtaggcgtcgacggcggtggcgttggcggcggggaggaggagtcactgccaggggtggcggcgtcggtggcaggtgggcggaaggagaaaaggcggggggatcctgggcagcaggggcggcggcggcgctacgcgccggcggcgggggttagggttgggaatcgcgaggtccatggcggggcatcccccccctaatccagagaaggagtaggtgcattcaatgaacgatccagagcaatgcggggaggaaacgagggggaggcgcacggcggcgagggggcgagagagcgctaggacgccgaggaggagatgcggcgctgatggtggaggatgcggagagagcgcgaggagaggagatgcggctctgtgtggtgggagatgcgagagatgcgctgggcggtcggatctacctcctctgttgattttgggccattggatgtgtgacatgatgaatgatgaatgagtaaaagcatttgttgaactatagggtagataaaccaggtataacgactacctcatctccgaaaaccggtgcaaatcgacccccaagacagtattgagtccagttatagcttatgtggcatccacatggcacattgactaattcttcatcccacgtggcatctagatggcattcacaataaaaagaataggtgggacccacgtggggccacctatcacccctcccatctctctttcatctcctcatatcttacagcctcacgccttccatcggctcgagcggcggcggcgggtgttggggaggagctcgtcgggagggcgcggcgggccaggcgcgggggaggggctcgccgggatgccgcagccggccggacgcgggagaggagctcatcgggaggccacggccggccagccgccggggagctcatcgggtggttgcggcccaccgagcgcagaggaggagctcgctgggatgagaagggcgccactgccaccgggcacgctgctcaagagcctcgcctagttcgtcttcgccgccttcaggaaggttagcatgaagccatctcttacaccccctccctggtgacacggggggtaggagtagatgagtcacgtcttcaagccctccgaggccacccccgactaacgttcaccgccatcggctggccgaatcagcctccgcgcgtgcggctacgagaaagagatagaagggacatgggaagaagaagataagaaaaaatagggctgacaagtggaccccaccacttttttattttagcatttgtcacttacatgtgggacccacttctatttcaatcgctttgatgacctggctgccacatcagcataaaccacttacagaaccacatgtggagttgatttgcaccggtttttaaaaaaattatttagttgagggatgttattcgacgaagggcaagagatgtgggaggtaaaatggacttattccttttgagtgaaatttatgggcccaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19674 - DNA, 197 bp, Oryza sativa
cgattattacacagccacacgacaccgccgcggaaacacaggatcagcaaccgacaccaccccgagagacaataattgatcgcaaccatagagcgagcgcgcgagcgcgcgcgagagagagagatagggaaggagggaggaactgacatcgacgtagtacgagcggcgggctagagggacacggccgtcaggggccg

SEQ ID NO: 19675 - DNA, 426 bp, Oryza sativa
gcttagatataagaaatcaaaatgctcccgcttgttccctcttatcaatcacatacacttcaaatagatgaaacagctataaaattgtcaatacttcaaatgaaaaagaagcactataccaaatcaacaagcatttctaacttcttaataatattgcaccagctaatttggcacgcacaagctccaagaaaggcagagaagtggtcaaaagaattgcataccccacacatacaggtggaaaattgatccaaactcctcaacatccgttttatgtttgacaacggtgcgatgaagagtgaacgctatagtggttgtccatagaaaagaagccacacagaagaagtgtgcactgtagtcatgagcaaaacagtagaatgcatttgatgggcccctgcaatatgaaaagcatgtgtgtaagaatatttc

SEQ ID NO: 19676 - DNA, 3285 bp, Oryza sativa
agagtccgcacacccaccgccccatgtactcctcccgcaccgccgcgatgtaccgcggcgtgcactcctccgtgaagccgcagcactcgcacctggctgcctccacctccatgtcgacgacgacgacgacggctactcctctctccttaccgctccttctcccagacggcgtaggcggggacggtgacggcgctcggcgccgtgtggcgctctccctcctcgctccggacggtggctacggctgcggctgcggcggcgatgacggtgtcggcggcgggtgaggccggtgtcatcgcaggcgacgtctcgctctctcctcttctcttgcaccgccgctaatctttcactgcttcctctccaccgaaacgtgtggtctccatgtggtatttatccgcaaaacggcgtggagcgggtggggcccaccacgaaacggtcggggttcctcccccttagacgcggacacgtggggccatcccttggagggcccacatgtcagtgagtacgagtggtgtatgtggcggtgagagttggagagtggaagagggacggggacgcgaaagggaggcccacgtcagggggctgatgagctggaagggtccccaccctttttaatgtgtggaccttgacagctggcgacggcaccgaggaagagaggaggggagggagtggcggccgccgcgccaccaccacttgactagtcgactactctttctctgagctcctgctaggtggaattggtgcaagttcggataccgtgtcgttgtcgttgggccctctcgtcattttcgtgtgcgctatttatcgtttttttttgtttcaattgataaaaatgatttgtcgcgattgctctttttttttatgtagatgcctacaaccataagattcataatgaaacgcatctcaaccaaacaaggaaaaaggttttgtgcccactctagaaaattgaatgacataggagtatcaaagcaacctacattattatcttgccaccaaacataagctatcgtccggttctataccttaattgttttacaaagttaatctcaactacccataaagatcacaccaaatacaatgaggttattcggtaattttgttatgtagctgttcaggctacacgggatagcgcagccactcggctactcggctacaggtctagactacatcctagccattcatctgttgtagctactgatttatccgctgagctactgttgtctgtcgcaggctcgcagcaggcagcgctgcagtagctaactctttcgaacagatttaatatgaaagttcaatctatatataaagattgaactacatttggactacatatataaaggcaaaaaaaagataaataaaaaaacgagtcccatctctatacattacatgcattaatccttcccgcttaccatagaaacaaagtggcctaggtcatgtgctgcacggtgcttatcattgatgcagaaaacctgtgagcaaatgtacatgaaacatggcacgtactcacccgaaagaacagaaaagaatcgcatatccatgggaaaagaaatggagagcatcctgtgataaagccatgatgcattaagacgacgtacattgataggatcctgtgaagaaagagagagaaaagacgatcgtcacatactggtgttcgagtggtgacccaaaaaaaaaaaaaaacaaccaccagatgatcagtccgtgcatgcagggacgccccggacagtccagccatgtgacacggacagattggtcatgattcatcctactacacgttagtacgtactcatccgtaaaaaaaaaactcaaatttgttatactacatgacatatttctagattcatttttttttactgagggagcaggaataccagtactaaccagggttaatattaccatcggtaaacgcgcggttaccgggcttaccgcggggtacgataatataaataccacggtaacctccttaaattcaaataatttttaaaaataatttgaattttttgataaattttgcacggtttttcacggtaaccgtccttaccgccggggccggggttaccacgccccggcggtttggaaaaccctggtactaaccatgtgattgagcaatgcacgtacattgcgcgtgcgcatatatatatatatatatatatatatatatatatatatatatatatatatatatatatatatatatatatatacagagagagagagagagaacgaacaaacaaaacatacacgaaatatattcaatgatagaccagatcatatacggtaattcaggtgaggtgatatcgtagtttcgtataagcttgtggtgagactctgacgtttgttctcatttttgcaaggaatttcgaggaatggatatataaatggacttacggaaatgaatcccgaggtatactaatcaaaactacgtgattttgtaagagtattatatatatatatatatatatatatgagtttatgagatattactattttaaaactgcttttagctttataaaagttaatttatttatggagtatttatattctcgaataattattacaaatattttattcttgtttttttcctttttaggctacaatagtgagctcttaagaggcaacatgatctgttcttgttatctttttattttctttaaggctatgtgcatcttgatgcagagatcggtcgtaattttactgtttaatgaaatataaccattctctatagaaatttatatatttaaccatcacgtagaaaaggaaccaatacagtcaattcgtacagctatgtgtatactctctctgtcgaaaaaaaacttaacctaggagtagggctgtcaatgagccgagctcgagcgagtttggctatgtaggcttgagcttgacatgaactcaagccgagcctggatattgatcgagcttgggagtgagctcgagttcgagctccagcaaacttcgagcctactcgagcttgacagcttgacttggtgaaactccaaagaacttactcttgtataagagatattaatgcaaattatcagtagtaaaaaataatgggtgctacttgtctttaatgaagcctctgcagcttttctcatgaattcatggctttgaaacgttgcaattaacaaaagctagctgctacatctaataggaatagtagtactattattagcaaccggataattgctttattgagaagcattaatgagatcttgaaacttgagcaggtcatgcacgatgacaaatatacattgacccatcaaaaatatattcatacatgcaatgcatctt

SEQ ID NO: 19677 - DNA, 1597 bp, Oryza sativa
tcccatcatacataaaagctttgaggttgatggcattaagttataacttggttatatcacagtatgtgactcgtaagtatagaaggcgcggcaatggatgtgtcacctttatttcaccaccaatatggcatctaactaaactcaaccattcaatattaaagcattgtgataacaaatcttgaagatccttctgagtagatcgtattaagtgaaggtcaagattccttaggtttagaaaaccactgaaatggggaggtagttccaaagatgcaaagctaagctgaatatgctgtagacgggagatgcttccattgtcgaaacgctcaaagggaaatctgtatcgatcaagaagaccaacaggattggttggcactaaatcaaaagccattttttttgtctgtgatgatacaacaaaatcaaccaaaccattgaggtgatcaactagcttgctgtcgaattcaaacttcacctcaaactcttcaacaatcttgccagagtgctgctgcaagattgcattaatattatccctggataccataacaccatcgaatcttagttttgtgcaacaagtccacatgtgcctccaatttcttgacaaaacactggtcctcacaacatccttcagtggcaatttttgagaaaattgtgcacagcaaatcctgcacaagagggacatggtagaagttattttcgataagctattttttgaaaacagaaacctgaagaaggtttctcgtttctaaacacacctcaggaagatctgcaaactgaacttttgccctgctttgtttgaagggctgctgatggcatcgcttcagcctttttgttctacgaatcagattgttctccattcctgttctgcaacaacatagatggccagatttagtaagggcgcagactggaagggaggagagagaaaaatcaagattaagagaaatcctactcaaacttcctgcctagtacctattgtaatcattaatatcctgcctagtacctattgactattgtaaaaagatcataactcactgatgtgtttcaaccttagcattttcttttcaatttccccctaatcaaataaaacaatttctagcaaaacaacaacaaaaaaaaaaagattgttccatatactgatatgcagataggtttgggggagaaatcagagcataattgtggctggcagagagagattacctgcgatcctctagctgctctccgagctggcaaccggactcctctgaactctgcagataaataaagcaatcaatctgctgcaatccaacatatatagtaggcaagcagtgtccggaaacaaggattggttcaccccgaaacctagccggaatcggatcctattctacagagataatcgaatcctcatcgttactcccagtataatcggaaagacaaaaaaatttcacccgaaaacgagagcaaccacagagatgttcctctccttccgggtctttccctggtgcaaataactgagagggagaatgagccgagagatagtacctgagaaggaggctgatgacgcgcgaatctccggacggaccaaggtggcaggggtatgaaccggcggcgcggggggggggggggg

SEQ ID NO: 19678 - DNA, 1107 bp, Oryza sativa
  unsure (1)..(1107): unsure at all n locations
gtctcaggctcaacaaggggggccggccgggacaatgccgcgggagcaggggtcgaacacttgctgtgcatggccgcgggcttccgtgacgttcctcaagaaccatggagtcttcaggcgcaggcgcaggcgccgcaagaaagtgccggcaactcgcaagaaggcgtcgccgccgtgggcgtggaagcggacgcgggcgtccagcacatggcgggccaggacgcgagcgtcaacgacatgccgggcgcgcaccgggggcttccatgacaagccgcaagaatccgccgaggaggctggcggtgagcaagaacgcgtcgcagtgggcggtcccgcctgccatggcgatctgatcgtcgagtccacgagtgcggccgcgactgctgttgaagatggcgttcaggcggcaaagaacatgttggtcacataatccattcttgaagtcctcgctgccttgttgccgcctccgccgccgccgttcagagttgtgactatcagcgggccggaggatattggcatcatccttggcgccagccagcgaccgagccactgcgattcttggtgtcgcgagacatgccactgaacataatctgcaagatttttttttcattacaaaagcgaaaaaagagcataacaggagacgaccacaacctcctcccacctaatctaggtgccatccccttatacatagtcccttaacctgctcaacacacattcaaaacgccatttcagccattctacatctaagaacttaacagtccatactttcctaatagcacccaaaaaaactcagccatttttgctcatattccaaaccctccatgcttgagagacgtcgtcttccttctgtcatccttggatccttccagctctgaagctccagccatgccgagcactgtagaattcagcggctacctgctttaacaccctggccccctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19679 - DNA, 1627 bp, Oryza sativa
tgggggaagacgacgccgagaagattgaaaatcactctttcagtggtttggaaagtggttctctgatgttggcaggttgattgtggttgacccgttgaggatcagaaaagatgctgtacacacagaaaaaaagcatttccgcataagcgaggttttttttctatggcaggtatgacttttggagtcaaatggccgctaatgaaaataaaaaccggggtgaagctcgccacccgcttgcaaaaattaatttttccacctttatttttgcagctctcctccctctcctctctctcagctctactctccctccgcggccggtcgcgatgacgctgacgccgactgcgccaacaatgctgacgatgacaccgcctggatctaggaggagaggggaggcggcggcgacgaggagctgaggctgcggtgcggccggagggggtgcggcggtggtggagcggctccccttcctcttctctccctccgcggccagccgcgacgacgccgacgccgacgatgacgctgccttgatctagggaggggaggggagcggaggcggcggtgtggccgaagacggcgttcgcggtaatgcggccggaggggaggtgtggctcccctccctctctatccctccgtggccggccacgacgacgccgaccccgactgcaacaacaacaccgaccatgacccacctggatcccgggaggggaggggaggcggcggcgcggctgaacgacaggtgcggctcccctccctctgctctctggcagctctactcctccgcgcccggcagtgacaacgacgaccaccgcgactgcaacgaccgcctggatccggggaggggagggtaggcagccatcggctagagggggaggccggcagagccgctggcaggttgggggtggtggcggcggattttattttattcgctaaaaatattttcgcaagcgggtggttctaccgtctatgaaaatagatgccgcctggaaaaatgagtttcacaggcggaccgctgagccgcctgcaaaaatcatctatttttcgtaggcctttgcgtgccggtggtcctttccccgtatgaaaaagctatttttggccgtctggaaaaacgatttttctagtagtgacacatttcgcccagggtttacgattccgacaagcccttccgtttcgggcgctggcggaattcggaatttcgcgaaatccggtggaaaactgttaaattctgaacaaatttaataaatcaaaatttgaatacaaattccctgaatttgccgacaagttctcgaaaaccggtcggttttggtaaaattccgatcaaattcatcgaaatttcgaccagtaagtatttttctttttttcttaattccggtcggttttggcccatgtaagtgtttccttttttttttgccagtaataataaaatccccaccgtcaatcgggcaagaaaagaaattacagcccgagtcgtgcatgttgaaaatgatcgcgagttaattttctttcgatgaaaagataaaaaaaaaaaaacaagaagggagcccacccagctaccctgagcgctccgtcctccggctcgtcgcgccaagtgaagtacacactgtacactcttccgccgccacctacgccccgc

SEQ ID NO: 19680 - DNA, 4850 bp, Oryza sativa
atgtctatgttcctctcgaggtttgttgctacaccgttgaagtcatatgcaattctttgctcaattctttcttactatcaccttttcaggtgtcctcgctgctgaagaacacgtgcaagttttctcatctgaaatatttacaactaaaattacgtctatattatcatgattcgggcaacatcctctctttggcctcttttctcagggccagtccttgcatagagaagttagaaatacatgtgagtactatatgttttcctatttgcaggaaatgcgtttattccatatttcttctttaatcattctggctgttagcaatgcagtactaagattttgatgatctgtcaattaattatccatgcaatacaagtcttcttatcaattcccattttcactcattgcagttcaattcgtatgctttgtcacacttgtattatcagcctatcaggaggcttccacaaggtgaatacggctatctaaagaacatgcatattactggatttgttgcatcgacaggcgagcttgaatctctgctacatgtcgtggaaagtgcctctatacttgaagttttgactattgaggcggctggcatgttagggaaagatatagattatgaaggaagattaaaagttgaggaattgacaagaagataccttgatgggataatgttacgaaatacaaagctctatatggcataagttattgtagtatagaagaggtgtgcttgagatgtatttgaggattcctgtgtgcaaggatctgttgttagctgtgtgcatgtattccatggatcattagtaattttcgcaggccatatccttgataactctatcagctgatggatcatttttgatagctaattgtctaattgattagaaatatatagccataattggaaatgatgcgatatttgttttttttaatattaaatgatgtgttgtttgtaaaatgctatattttgacctacttaattatgttaatggcgtaagaaaattaactcaatgcatgaatttgaagggattggtgagaagatcaatgaacatatttggagggatcgatgattatagatttaagatccttcaaaatttacttggtgcagttcaaatcatttggcctcagtaattttgttgaccccatagttcgttgatgtcttgcttatcacttgttctgcttcatcttttgcttataagaaatgtctttgtgcctgtcggtggatggcgagcgaaaaaagaagttatgtttttcaactgagaaaaatctttgtgcatcttttgctgtccttttggatttaggatctgagttgtgctaaactctaaaacccaagaaatccatttgataaagctggttattttatctttctggaaactgtcaaagaactgactatcttgtgcaggttacttgcctttagtttggtgaaggatcgatacttgcactttggtttaaaatgttctatatattgttgtctcacttgatttattgtgtaaccatagctgctttcagtttttgtaagtgctaatctgtaaccttgctttgcagttcctgaagttgtgagtcatggctgccaagctggcttgcctccatagtctccatgaacgccttggtaccaccttctcatctcatcctaataagttgattgcagtcttttctaggtgaagatctcctttgaatctgctcctggaaatggttgagttcttattgatctttatccgcataattggttagttcttagtaaattgagtagtgaaatgagagcatgttactgactcttagctgacaaggtgatccattcctttgggtttatatagtttttcctgagattgttatgatggtgtatgtaatgatctttgatgagatgtaacatattgattatgagtcatggatcttggatgatgttaaaaatattgtttttagctagaatcagtaagaatctggtctatatggtaatgccatcaacacagttcagccacaggaaggatgtgagatcgaagcattcgttctatttctcaaatatcactctatgcaggtatgttaacaagggaaagggagtgctgtagcatcaccagttgcttgctgagtttgatgaattgatgccttgatcgaagctgacaaagagaaatgtgcttcatttgaagacgttctgcgtgctgcccaagtatatttggcaatgtgcctactccagcatggcgacgatagtcaaatcgaagtcatctaccagcttttctaatttaatttccttgactgcatgtaggaagccattgtgctgcccccatgtgttgcactggccatcaggcggccaaggtctggtgtctgggactacatttgggtgaatgtgagtgagttggctgtggaggagctgagtgttcctgagtacttggaattcatggaacagcttgttgatggacagtaagttccagaaagacgatatgcacattataactgaagcaacataacagtctgaattcaacctctccttttcttaaacagcaccaacagttgttctcgagcttgattttgagcccttcaatgcctccttcccgtgcctgttcatgtccaagtccatcggagatgggtgcagttccttaaccgtcacttgtcgtccaagttgttccaggacaaagagagcctctaccccttgctgaacttcctggaagaccatgaccactgtgggcacggtcagaacctaccaaatgcttttctactgcatattttttcttgtttgaattgcctgttgttagtcctttagaaagctgacattctctgaagttggcgccggacaaaggtggcgccggagccagagcggcagcgtttcccgcgttggcgcgggtctagatggtagtgcaaagggagctggcggcggtgggtcgtcttcctcgttgccggtcggcaccctcgcccttcctggagctcctccccttctttgtggggagtttctaggctggattgaggcggcaacttgtcagcgggggaagcctaggttgctgaagcaatgccacccagtcccgggttctccttcagctagatttggcgaggagactggcgggtggtggatcggaggggtcctgggccagctctcagggatggaggttcgttgaagtcagccgatggcggggcgtcggtgcggtgtggtggtagtcctgtcgttggcaggactggaagctggccggcggaggggcgtcggtcgggtgtggcggaagccatgtgccgccgatgtttagatggtggattcggattgggcgatggaccacggcggtaggggattccgagcgaaagcttagcccaattttttttgggccaacagtgacttcgctttcgggcgtggtaaccctcctgagggcactgttgaggtacccctcctccctcggcaaggagctctgggtgaaaaccttgtccaaggatgacgacggcgtctttcggcgtcgcaaccctcgtgagggcgttgttttagagtcttcgtgtcgtggtggtgttgttggcccggtggcgatcggtctcgcatagcgatggccggttcggtgcttggcttccctctctgtagcatgtgtttgggcggttggcacatggttcggggcgtgtgctctggtgcatatccttcctcgacagccagctgtcgatgtaaaacttttcttgtaaccttttcttcctatcttaattacattgaatgacctccttcggtcattccggcaaaaacattctctgaagttccactaaacgataggatctgaatttcctcaatcataatatattgttttctgttacagaccatgatgctgaatgacagaattcagagtgtacatatgaattatagagtaatgtgcagacatgattttacttgatgcaggtaaccaggttgttgcctgatgttattgggactacatgcagccagtggctggagaaggttattggaactgagcacactgacattcttcgtgttccattcagaattcatctttctttttttctttctttttttgctgcaggatgttgcaaacgaaattatgagggaaatgcaggccaaatataccatttttcgtgccaattaactgctgatcatgccatgacacacagacttcacatcatgaccagcacattccaagaaaatgctagaaggtaaaattttactattgagcagtagaatatcgctgcattgtggcaacaactgaaggagtatatgatgtttgattcctctgtttcttcagcaaggacactgttcggcagtatgaatcacacattgcattcacccttcctgctcttgcaataagacagtcagactcggaccatcgcatattacgctggaagttcacaagagaatgcaaacaatccgatgaaaatggctttcataaagcatatcatatttcaattggcatcaacttgcaaacccattgtaggcttccatcggatggcctaatcagccaaagaaaaagccaaattttgaattttcaaacttaattttgagatatttttaacgtagtttcttttacaacattggcttttaagtcaccaagaacacatttataaaagtttcacgtacaaattcatttttatttcctaataagccgttttggcttattatggggaccgcagtaaccatgtctagagcattttgtaacactagaacaaatttgattggtactaggatatggtgaagaacaatggatcgagtagcttctgaccaatgacattttctatgcagtctcaaaaaaataaaaaagggtctcttcggagacatccgataaaaaaatgaaaaggaaaaaaaaatgaaggaatcgaaaacgacacttgattttggattgatgatctggacttaaatgcagcacccatttcagtggatctgatcaaccaactcttcacag

SEQ ID NO: 19681 - DNA, 2207 bp, Oryza sativa
attgacagcttcatgtagtttgatccacctcaaacatctttgggaatgcaccaactggatttggccaggggaaaatttaaaaagattatgtactgcttcatcatgcaaagcacatacagcccaaaaatctacccaatccatttctcaacaccgtaaactgatttctttctctccaacctctaaccacaaaaaatgcttattttccataggaatgagtgctttccagacatcagacgagatataagatgaaaacgctaatgctctgtacattgatttagatgaaaaacatgtattactctctaaagccccataagatctggtaactattcttacagaaagaaactgatggagtaaaaacgatcaagtaatcaacctaataatttcattctaatagatcatgagagccaaaagatcttcagaaagacagattctctgctcgcctttctaacatctcagagtaagaacatcaaatgttcaagattctgcaaacctgaagcattactggttgcctctcacatggtaagaacatcaagcggtcaagattctgcaaacctgaagcattatttttccgtggtggctagtatgaagaacccaagattgggggaaaaaagagtctaaactgctagcaatgcacatgctcattttcctaaaggctactccctccgtttcataatataagtcattttagcatttttcacattcatattaatgttaataaatctagacatatatatctatctagattcattaacatcaatatgaatgtgggaaatgctagaatgacttacattataaaacggagggagtaacattttttgtggccaacagagaaattagtgacatcagactgtcaaagcacatcgtttggagaagtgaaaccagttttcacgaaatgttcaatgatctcagtctgagtctcaggtgatcaaacattcaaacctatatcttaatcgtacgcaagggataaatggaattacatacataggcacgtagctaagcatcctgaacttacacccatggcacaaatcctgaactaacacatgccataaatccttatatattggctgtgtttagatccaaagtttggtgtcaaactttagtccttttccatcacatcaatctgtcgtacacacacaatttttcagtcacatcatctccaatttcaaccaaaatccaaactttacgctgaactaaacacagccattgtttccttcagattaaaaaaaaatgtaagatgcctgcatacatggctgcatctaccatttggataacatctgaaaataatattttttttaaaaaaaagcaaatacattctacatagaggagatggattttcatgacctatcttctttctatataaaaaaaatataaccatttgggtgggccaaatgcaaaaataaagggatagtgtgttcttaattaagggatgaaaatactttcccctacatatagaacacattgtacacatccattgaccacaaatcttaactagtacacacgaaaagtacgaaagaaagatacccacatcaccatcaaaaattaagcaaacggagcgacgaaccagacacgatataatgctactgcaacatagtgtgcgctataccacaacacgagtccatcaaatccacaagccattaataagtatcgaagagttgcagctggtcacatacaaaatgaccagaaaagcacacttgcagcacatataatccgatcttgttacagcacaggatgaacactaactctcggacaagtctgaacattgtcgatcccataaccagcacagatgactcaagaaaaatggctcaaatcgcttaccagcagtaggaagaaactcagctcgtcgatcagtcggcgtaggaggcagcaaggacggtggaagtgagggtaagaacgaccgtgacaagcgcagcggcgaggaccagcttggcgaggagctccacggtggtcgtcgcgatcggcacgttcccggcggcggtggcggcggcgccggctcccccttcaccgcgttcaacagcacggacatgggtgtagatgagcgtcatggagaggaagaacgtcgtctctgcagcagctggacggagcacgtggacaaccgtgactgcgaggggtatcaaatcttggccgccgttgatggcgcctggctgatgagcctagaatgacgtgaagcacgccggaagacaagaacaggatgaggtaaacgacctgcg

SEQ ID NO: 19682 - DNA, 4017 bp, Oryza sativa
atacgggcgtagatgagtgcgacggatgtgtggaaggcaaccatcgccgccgccgccgccagcagcatcgtgtggaccgcggcgtcaagcggcggagctcgaacgaagcaactctcgccacccgactgcaggtcgacgtaggggaagaatccggtggcgtacatggacaccagcagcccgaagaaggcggtgaccgagggggcgctcgccatgggggatgagcacttgagcagcttgggaggatcaagattctagagaggtgcggggttgcacgagtggagaacggtttggatcggggtaaggttcgcggaggaaggaagaagaaatttaaagtgaagggtctcccacaaaaagcacaagaagaaatcgcgagcggcaataaggcatccgcggcctggaggcaaatattgcggcaaaaatcctctctcaagttaaagccagaggaattgaaagggacgggttgttccgtcgttgggtggggtgccgtgcaacattgcactgcagccagcaggtcggctgcattttcaggcagtggctttatttttctaatttttttatggaatactactattattgcatggcaaccatgataaggttatgctatctttgaccaacacttttgtagtatccatccacttattagatttaagcaaaatttgacagtaacagttaattttggagatttaattgagtctttttctactgtagaacataagcttattactcagatgtacacccttcgttaaaaaaaaaaaacaaatcctgagagtacacagaggcagagtcctagaagatggaatgtgctctttttacacatatatatatatataggcacacctgttttttttttatatatatagagtatacaggctctttttactttggttgtggcttgtttttttctccacgtgtggaaaaatcaattgatgctccgagaaatgactccacagcaatacaacagtacataaagttgttatttcttcccaatacattgacgctcccctttatatgttgggtaattggcctcactacatttaggggttcgtttcgagaagcttttatctttcatccatattaactgagataatactacccgtatgaccactagagatgggtgtaaataactaacttaaagtgattgtgatccactaatatcaacttgtcaattttggctttgttctgacggatttttactccatgaaccggtcactgttctttcgcagaaaggcgcatgacacggtacaccgtacacatcaattgcatctacatgattcgcgtgagaaaggagcgcctggattgagagattcttccatttcactgccgcagaagacatacggcagcaacaaattcctcgttttaaatcagggctatgcaccatgtacgagtacttgacgtttttatcagagcaattggccggatctaaaaggcaactactctccatttccccagctgaatcgtgtcgcatggcagaaagccaggaaggcaaggcaaatcttaacacaggtagaaccgtagaagtactagaaaacgagcaggagatgcagagcgaaaggagcactgaaatccagagaccagagaaagggcactgcactgacctgaaatgtctgcacacgtaacggctgcagggcacgcacggtcagctcagctatagctccggccatggaaaccggctccaaatctgcaaccgagctcgcagattggcgaccccggaacatggagaggcgagagctaggggaaagctcgattgagcagcagccagtggttgacctgaagaagtggtctctcctcctagattaaggtatttagtaaagcaaatggtcaggacgagagcggcagccatctttccccaccacaagcacaccccactgcaccatggcaccacctaggacgcagacagctcagaagacatatagtatgacaaagcatgtgtattttttcagagatccaagtagtagcatcgtactagttcactttagcttacagacaggcagctaaagttcgtttgttaagtttggaacctagaacaaactcatctgggtgaaacacacggagtttcactggagttttacaggcagacatgtcacatgtcatcgcactaggagcagttcttggcaagggacaatcaagcatcagggggacgttcaaacggaagaaggtttcgccaaaaactcattttgctctgctcatctcactttctcacttgacaaaaaacggtggtggtgtccaatcaccatgtgagcatacgaacccaaacgaaaaggagaatctgcaacttttgaagggcctactccgtacatcaatggggggaaaaagaacaaaactaacacgaaagaggcggcgtcgcggcgatggacgctgtcaaagtcgtcctcactcctcagcgcgaagagctctctgaccggatcagggcggcgcggccgtgcagtggtcaatttgcgacacggtctccgcatcaaatcatcttgtgagtgaggactactgtaaccaaccagatgaactttaggattccttcgggggaaaaaatacagaaatttcaaaggatttaaaatcctatagaaaaaaattcctacaagataaagaattgagttcctaaaattcctttaaaaattcctatatatagattggcatgtatcatgaaaattttggagaattcttagcatgtgctgtaacctcttgggattttttgtctacctctcttccaaattccgtgattttcttgtgcttcactcaaactgttttctatgtacgtagttctcctatggttttcattcttttagaatccaaggaccataatattttaaatcaggtgttttatttattctcgggttttgagaattgagaatcttacgtttttcaagaagtttgtaaaagctacgtactccttccgtggttaattggaagaagggggtttttcttttaaccaaagggccaaacccccccattgatataaaaaaaaaggtgcacggtaatccacaaaagtcctcccccattaacacataatgaagagaaccacaattgggtggtgtcgccaagattccccaaatagtccgggtggaattaaaaccaggacttaaaaccacctggtttaaaagccacaggttcctttccaaacttaagtaccggtgggtgttaccacccgggactaaagatatatttgtagtcccggttgataacaccaatcggaaaaaaagatcgccttaccctctactcaccaaccgggactaaagatctatttatagtcccggttggtaataccaaccgggaaaaagatcgacgcggagatcggagaggcgtgcgcgatcggatcgaggtatctcctcctctcctttaactcgtctctcgtcctctcctcaaccttatctcctcctctcctttttaactcctctcctcaaccttatctattattctccttatctctattcctctccttctctctactgccaggccggcgtgagggtggcggggcgcggagggccggccggcgcgggcagcggggcgcggtgggccggccggccggcgcgcggtgcggcggcgcgctgcgaggcagcggctttctttttttcttttttcttttttgaagaatctgagattgttgtgtgatgtatttgattggatatgagattgttgtgtgatgtatttgacttatgtgtgatgtgaatatgtgatgaattttgtagaagttgtgatgtaattttttttaagattttgtgatgtacttgagtatttgagatgatcgatttgtggatttggaggcaatttgaggatgtttgatttgggattttggggacaggatggggtgaaatcaatatatttaaaaacaatgaagaaaagaaaagaataaagagcaaccggatctagcctctttagttccgattgataacactaaccgggactaaaaatgctttatctttagtccaggttagtgttaccaaccgggactaaaaatggatttcactttcggttttttcacccgagactaaaaataacgatctttagttctggatttgtagtcccggt

SEQ ID NO: 19683 - DNA, 2433 bp, Oryza sativa
tactttcctattttagtaaatttatgcacctaaaatttatacacctcaagtttacacatctaaagtttagagacccaaagtttagaagttaaaagtttatatatccgattcaaatttgaatttgaattcaaatatttttcatatatagtatttctatacatataaagtttatacacctaaagtttatatacctaaagtttataagtcaaaagtttacagacataaagtttataagtcaaaagtttataaacctaaagtttatatacccgtttcaaatttgaatttgaattatatgtgattcaaattgaattcaaatattttctatatatagtatttctatacacccaaagtttatagacgtaaagtttataagtcaaaagtttacgtacccgattcaaatttgaatttgaattcaaatattttttatatatagtatttctatacataaatatttctaactttttgtttttttaatttttttttgtgatgtactataataggaagagaagaagaggaggagaaaggggaagaagagagaggagcatagggggaggcgtggggtgatcgctagggcagcgcgggggcgatcacccgcgcgttaggatttctgattacgaaccggaagtaaaaaccctttctctactagtcctttctccactagtgaaaggttcaaatataattgttggttagttaaaaatgtattaaccaacgtcatatatttcgagaaggagctgtattactaaatttatgggacaaaggatgaccagctgtacatcttccaccggtcgaaaatgatatccgtgttaccgagtatgatgtaacaacccaagagatggcaaaaactaatattgttttgtcatgtattagagccaggctatttttttccagagaaggttttttttacctggtctttatatccaaccggatatatgtgacctttttaaatttagaacttagccctcaaataataaatttgttcctatgaagatttaaattcacaaccttaggatactattttggtcactgcaatctctaggctatattctcttttgcactggagcccgtccatatcgctgcttaccgtctatatagtactgtcccttatttgcctacttgtgttcacttgatgtactactgtttacgcttggaccggccggatgtgtgtaatctgccgacaacatctcattttcacaagaatttcttagcagcgattagggactcacaagtcacaatgcgacgccttagctgagacacccgcatcatatcatactctctctatctcataatataagagattttaagcttttacttacactgtttgaccactcgtcttattcaaaaaatatttggaattattattttatttttgtgtgacttactttattatccaaagtactttaagcacaactttttattttttatatttacataaattttttaaataagacgagtgatcaaacaataaaaaaactcaaaatcccttatattatgagatagagggagtagttgttagtaaccccggcgggatcagctttgttgaatcgtgttctcgacttctggtgatcagaagactgaatttaatccacatggtgcagacaagagtgtccccggccttacatatatacggagtatttgagtctctatatattttcctccatttgtattacgaaacgggggagtagcatacaccgtactccctccgtccaaaaaaagacaaacactgagtttccatgtccaacgtttgactgtctgtcttatatgaaatttttttataattactatttttattgttgttagatgataaaatataattaatattttatacgtgacttgtctttttaaatttttttttataattttttaaataagacggacggttggaaactcaagatttgtctttttttttttaaggatggatggagtatttaatttgtgaaatcgacaagatgaatgtgaagggagctggccgtcatcctgtatccggttcgtgctcgtcacatcatcagatgaggtctccattggctgcctaggatctgcgctaatgattccatgattgaaaagagggggcaaaaaaaagaaaaaacttcgaccccattatgctgtcacacgtcactgctgcagtgacagatgactcaatatcatccgcgtcactcaaacgtcaatactacaattacaaagggttcgcaaaccaaacattttcaacttatcccatcgaatatttgaacatatgtatagagtattaaatgtaaaaaaaataattacacatattacgtgtaaattatgaggcgaatcttttaagtctaattacgccatgatttgacaatatggtgctacagtaagcatttgctaacgatgaattaattaggcttaataaatttgtctcacagttttctggtggaatctgtaatttgttttgttattaggctacgttta

SEQ ID NO: 19684 - DNA, 2948 bp, Oryza sativa
tttatctactcccagttacaattattttctaatttcacaaaatctgatataataattactaaaaataaagtatttgaggacaaaccgtaagagccaaaaataaatttattttgaaacggatagagtatttaattagacacaatatagtaaaacaaatctacacattgagtattttttgttaggttgctatattttggaatggttcatcttaaaatattctcttcatgtcaaaataactttatttttcattatcatatttggtccaaaataatttaatattttgagtaatcatttcatggaagtttttggaaacgagggacacagacattgaggtttgtaaaaatggggccaattatactgaggcttgttgaagtgatggacattgtagtctttttctatatccttgtatttgtattcgtttaatgtggaactgatgaaaaatgaagttactttttgatggaggaagtagaaaatagagagatagatggtgacgttcaaatttgtttctaaagtatactcattcacatactttttttatgagatataaaccaatcataatcatatctacttaatttctccgattctttaatcttaaccaattataactatctccttttagtttcacatttatccttaatcctcatgaacaactactttctccattcacaaatatacacatttctagaatttgatatggattcacaagtataagtattttaggagtattatttttcataaatgttcactagttgcatcaatactcgggaccttttctaattaagtaaactctcgtaagcatcaaagtaattgtaactcatccttaaattttgttaaaaactctaacaatacttatatttatgaacgggggaagtaacaaaccagctatcttccataccagtataccaccgttacttgtcagggctagcggtgcagattgtagaaaaatttccgtgccatctttaactagtgctatttttgttgttttcctctcttggtgcagtcacaaactaacaacacattgattaagatggagtgcttgatgaacaattaacacctacaccgttcatgtattttgggattgagatgcagtacatttgctactatggctacagaataagttactgtacacaatttgagccctctattttattgatctaatggttcaaattgtttgctacagtaaattgctataatattttactaatgtacctaagtcatctattttgaatccagtgatactcgtgttattgcttaccttgtaggcacactagccactgcatcttaaccagatccatgtatttgataatacagcgtactaagtgtgtttataatactacttgttaatattgctgataatttagttttatgaatgcgctgcaaatatataacgattggcaaaaagtcgagtgaattttcccttctggtgataatatcatgtgtcccgtcccgtgccttctgggcgaaggtagcaaaggcagatgtggacggcgtgtttttcagcacggggtggaaggaacagatcaacagattctatagagtgctgattgactctggctggcaagcagaattcctctccccactctcccgcggtacaatgcacgaagtacatgtgcagcgttgtcgaccccgattttagaaatcgaaaatttttaatgtttatcagtaccaatcccatcagtagtcggtacatatatatagccgaatcacaaatatcacgaataaattcaggctaagagaaacatatcacgaatgaattcaggctaagagagttaaatgcttacattagagccaggcaggccaacaactatcagaggacaacagcagaagacaaaataatacaagggcccggttgacatgccacaagcagtcgactggggaacgagacctagattagaaccgcactccgatcatcttgttaggtacgcaagcgtacaaacaagggcttctcttcaacactctactaaaagatatatatagagtaacaatgagtacaaaagtactcagcaagccaccacacaaaatgcagtaatgtacaggacaatacaaggagtggctatggttactttgcataaagctgagttttcaaatatcatttcacaaacctaagacctaacataaaccgatcaagttttatctccattattcattaaacagcgacggttctgtccaccatccattgtgttcccaaggatagcttcccgccactggtcgtcatggttttctggggtctaccccttctcgcctctcgagaaaagttgattcaccaatacaaaatcatcatgcatatcccatcccaatcagattaagaaattagagtctagccaagtgtaatacatatctcggtgctcaatatccgcgagcacggctattcgaatagattggtttactcatactgtagtggatgtacactttacccatactccgcgacttgcccaacacataagcctacgtcccaacgaatgagacttgccacgacaaagcctttcaataacctcactttggcagtacccgctccatgaactttagtcctcatgcactctaggcgtccaaggtttctagcagtgagaggagttctggcgctcctgagggggaaagactcacacattcattaagttatagttaagtttaggtttgcacatggcaatcctaccaatggcgacaccactgtaggcacccgcccctcgcggtcctaccaatggctgccccaccgtaggccctgcctcacacacaacaagaaaaccactacggcttgggtaccgcctccgctcggctatttactccgctaggtctatacccacacgagaagtacggttgtacgggggtcgtttcatgcttaacttcatggctcggtccttaactgactagggacgccactagccttttccggacaccacccaagtcctccagccgccccagtcgaaaacatttgtttagttttaatttttttt

SEQ ID NO: 19685 - DNA, 8980 bp, Oryza sativa
taagcaataatcaaaggcatggcataataacaagtaggatattcatcactgcatgcaattttatttgtaaacaaaacaatttcacgattgggatcaacatgctcaagggatggggtgatgacttgcctgctcagggtagttcttattcttgatataatcttgatcaaccttcacctcctggaagctgtatacgctccctcacgactaaccgatatacagtttctataatacatgagaaaaaccaatattcaacaacaagcaaatatgcacaagcaaaatataattgttgaggtcgaacctagggctgcttatactactcgtgtttgctaatggattctaatcaagctaagagccaaggtttcttagtattttatattgtcccgatggctctattggtactaactagcacaatacatacacattttgctaatctgtggtttagtctagctattggcttatggaagagatctgttatgaaggtaaaatggtcaggtccctaaggttatagcatggctatgtcgatggggagattaaggataaaccatatcatcaccatgattcacctacattattattttatcaatgaagctattattcgaattatccacatgatgtatatatatggattttatccgttttcataaaaggttgacaattatgcgctctgtactttagatttatggtttaataatattatagttactgattatgttattgtataactttataaattaataatgaacaatcctcaggtgtggttgaactaaaattaaaattatgtgtggtcaagatttataactagcactagtatttagctaatatactggttcttcatttattacctagtttaatatatgcaactagtaggttatctaaaaggttatgtgtatgcaacagtatattaatattgaaccatttactgaatataggcaaccgacaacataactagtcacactagctctgttatattcctcctaatcaagctaaagatattcatccatatgtgtttatattttagttacaaaatgtgaggctaaacttttatgtaaataatttataagtcatggatttaattgaacattaaatagtgtaaatagtgctagtgtcttgctatacatccgttcatttgagacatcactgtacttaatttacatggttgctactgtgacaaaacatgctagaaacaaatattattacatctactctactgtataataccaattttatttattagcataattttaagttgaccataatctaatcatttgatattaattatttaataattataaatatattttattaaatagtgagttatataccattggaaagcttatgaatttagatgaaattaggttcaagtttcactcaaatccgagttaaaatgagcaagttatactagtttaaagattcaatttcgaattaatccgagaaattgtgaaaagctactgttcataattcatttatttttaatctaaaatatatccttatccctaaccgctgctgacatgtggggtcaaagctttgattttctttttcacaggattaagtttctaaaggaaataggaggagtgggggacagcttgtcagtggctcggctgaaggtcgtctttaaccttcgtcttcttcctctcgaccgagcgggagcagcaggggaacacggcgcgcacggaaggccggccgagggcgacccggcggcggccaggggaggtgcggagaagctccggcgaccacccaccggctgcggcggcgcttggagggacggggcgcatggccgccatggctgcgccatagccgagctcggctacaagtggctaggacgacaggaagggtttccgaccaaattgatgagtgcgtgagcatatacggcgtacgggcgttctatttctccagaaagatgggaggaagagcaccggggatggcctgtccacggtgagctcgtcggcggcggaacggcggctggggcagcacagccataggcattaatcctacaaactggagccgacgctagatattagaggtgtagaggatgctataggctcgaggttttaccccgggatggagagacggcgaagggcggtgacgcgtggtgcggtgcggacgaagcagaggcggctagctgttggtgacgcccgaaagtgttcgacgcgtggttcccggtgtccagcggtcctctgctcccccaatggcgatggcggcagcacggaacctcccccactccctccaacctccagctctggccggggagcctcacaatggtgatctctagcggtggtgagagagtgatagcaaggtgttcgatgaaatgcatgactagagaaaggcagagggggatggggttttgatggcctggcttggcttaggatgtaagaaaactatggaggataaggatgccaacacacaatagctgagctagagccctaatggcaatcggataagggcattgaggttttgtggctccatcatcaccctatatcctatagtctgcgagttttagccctagctggggaaggggacttcgttttacccaccggatacaaagaagggcgccgggacatcattggtgacggacgtggccatggcgatgcgcgcacatgggagctgtggcagagtggcggcttggtgagggcggttctcctgtccaaaggtagttggctagggctaggggtgacgcgggatggcgcagtggccgttatccatctgctccgaggcgacgcgcgatggcgacggcgatgacgcgcgcgcgtggagccgcagcttttgcgcgggatttcggcggctcggtcggcggcgggcccgcgcggcgtggcgtgacgcgatgcggcgcacgggcacgcataatgtggcgcacgaataggaaggcaggcacgcggcatagcagcgaccggaggggcggcgcggcgcacgggagaaaggcgcgaggttgggccaagatcgaacggttggcggacaatgaatagtgcgccaaaagaaagaaaaggggaatagagggagagggtggggctaaactgtaaaagtgaatgtgattgggtttgaattgaaatgtcatctatacattttgggttttgagaattcaaatgttttatttaaatatttatttggttattcattagttcccaaatgaatttgctttccattaaattatccaatataacatataggctttgatatttcttaaaaaaactaattaaatattctaatgtgacctttaataatacaatagcacattggtcaagtttatttgtataacaatgtattttacatggacatgtttaatctattattccataaaattaaattgagacttggtgcaatattaatctagaacgcattttatatataaagctcaatttatttgcatgacaaattattttacatgagtgaatccatcccatgagagacttgatgaacatataaatattaatttaattattctagtgaaacactcctttatatatagggtcgttgtagtggcgactattttcctagttacttagatgtcatgacacttgtcaacatggttcaagtatttaacattcaatttgtaatctacattatagaaactaataattggcttgtgctttatttggctttgcgttcttgtgcataaatacttatagggttaacaatatattgtcgtaaactttagttattacttagatgtgcatcttttaatttgatttttctattgagacgatttacagtttggcaagcaataacaaccataacatccagtatgatgtaaaagttttaaaaagtttaaaattttagtgatttttattatcgggaatttttagggtgttacacgcgtgcactgcaccgatcttgtgtatgcagtgtgtacggtggccgatagctagggtgtgccaagaagtcaagaatatgatgtgccgttcgttaattcgagagcagatcaataaagaaaacaaatacttccaccttctttaaacaagaagactattcctaacattctaacgatgaaattagtggagcataaaaaaaattcaaataaaacggatgattaaagttggaaatgaaaactcatggttgtgcttaaaatgggatggagggagtaagttttttactcatgttgagttcgttaggactagttaggaactaatatcttgtgtatggaaaccggagcaattcattagcgcgtgattaattaagtactagtatttttttcaaaaatggatcaatattaagcagttttcacatagaaacgttttaaaaaaatacactatttagcagtttgaaaagcatgcatgtgaaacatgagagagaggatttgggaaaactggctgccgaacacagtcttagcatatactccccccgtttctaaatatttgacgccgttgacttttttaaatatgtttgatcgttcgtcttattcaaaaaatttgagtaattattaattcttttcctatcatttgattcaatgttaaatatacttgtatgtatacatatagttttacatatctcacaaaagtttttgaacaagacgaacggtcaaacatgtgctaaaaagttaacggtgtcaaatatttagaaacggagggagtactactggtaaaagagcaattgcatcttcggttggtccacatgttgctacgtcgaatgttaaacgtgtcatgatttgttagattagcaaaaaaaaaatgatatggagggagcggcggggttccaatttctccaaattctagcggcacgtagacgatatcatgaatagtagtgtcatttatctaaatgtcatatttgtattggtatagatccaattaacccaataataaataattgggtctctagaattcatatggaattgggtctctaaaatggcatatttcatggaaatcttgagctctaatcatttcgatttgttgtgtgtacctctaaatcgcgtgtattttcttgtactccatttcacttttcattcacaagatctttggcacctatctttcactttttcatccataaaatcttgcattaagattcgtgttattgtatatccaacttgtagttatattgcacttatattcaattacagggaccacacttagctaaataactctaaacggcaaaaggaccccaatgacaacagtcacaagctctaaacacaaccagtagaactcctacagcaactataaacagggaaagcaaacatcacaactatcccactcctgctcttggaggtcttaatcttgtcatcatttgcttcatctgttccaccttttgttttcagcttgctctcctcttccggccgaaaaagcttcctccactgcataaaatttgaaacattttggaaaggtaatgttagtggagagtacaccaatttacttctgaaaaccatgcatattattcctagtaaaccaaagattccaacaaactcaagctaattctagtttctgttgagttgttgttattgttagacaacagaaaaaactcttcgaaactcctaggtgtagcccctcaatctaaagtatccctacaaaggatcttcccggccagctgcttcctcgatcaagttggccagctcgtcgtcgtcgccgcgctacagcgaagcaagaaaccgataaaagggcaccacattgcctaattaccgagaccatcgcgtcccaactcccaaccatcccccaaaacatgcagtgcaatcgtcaagctgagacaaccggccgtgctgctaaagctctctcatcaaatccacaaccattaagcagcactcacagtcacagcatgcatagcctgatcatcttgttacagcacaaggcgagcaccatcttacatttaccaatgcataaccggcacctgtctcacgaaattaaattaaaatgctcaaattccttaccagtagaccgtgtctatgtcgtcgtcgatggatgcgtatgctgatgctgatcagtcggcgtaggaggcaagggcggtcgcggtgagggtaagaacgacagtgacaagtgcagcagcgagtaccagcttggtgaggagcttcacggtggtcgtcgggatcgccatcatgtccccaacggcgccgccgccggcaccgacatgcgcgtagatgagcatcatggagaggaagaacgtcgccgccgcagcagttggaagaagcacatgtgcaacggcgacggcgagaggaggcagaagttcttgagcgccatcgacgatgacgcctggctctagctgaggaaccaagaagacatgtagcacgccggaagacgcaaacaggacgaggtaaacgccccgtgtaatcctcccgttcacgccgccgccgccggcgttgtacaggcgggcgtagatgagcgcgacggcggtgttgaaggcacccatcgccgccgccgccacaagcagccgcaggagcatcagctggacagcggcgtctcgcgacggaggagctccaaccaaggtgttttcaccgaaccggtcgacgtgggtgaggaatccggcagcggcagcggcggcgacagccgccgctagcccgagggaggcagcggccgaagggcggcttgccatggtaccactgagagatttggtttcttgggataggaaagaggcgtgtggggaaactggaggggtgcggttgagcgagtggagagtttggggacttttatcggtggtcggtggtagggtttggaaattggaggaagaggaaggaggaggaggaggagggcgcttctgcaggatcatttaacgggagtttccacgcactttgctttgctgttttatcgcggagaaataataagatttttttatgcaagcaaatccatatccatattaaattctccaagttcatattgttggtatgttctctgttggatgggggcagttggctggatccggactgggatagtagcgcccattcctaaccagttctgaaaaggttcgcatgtgcttggaccaacagcttcaggatattaattagttaattgaaggcttaatactccgtcagtctcaaaatataaaaaactagaaccgggttagatattttctaatactacgaatattgacagatagtatgtccaaatttatagtaatataaaatctcccatcccatattaggtttttatactatgggtcatatactactattggagtactataaaggagaattcatcactcgaaggaatatcccctcatttcgtgcatgtcacctaaatagttataaaaataatccacatcctactattatagagatctgctaaagatgttttcgagtaatcattggcatgcaagggcgtggcttggcgtggcttgtgaggaagtttgtaccgtgcccagaacatgtcaaatccccatatttatcctctttgacctacttcctccgtcaaaaaaagacaaactctgattttcgtgcccaacgtttgaccgtccgtcttatttaaaaaaattataaaaaaaattaaaaagacaagtcacgcataaaatattaatcatgttttatcatctaacaacaataaaaatacgaattataaaaaaaaatcatataagacgaatagtcaaagttggacacggaaacctagagtttgtctttttttttttgacggagggagtattcgtttttaaagtaacagggctgcatgttttactcaaataaatattccctctgtccaaataagttaaatttctactcttaaaatttgaccaggtttatttaaaaatgtagcaacttctatatataacacaagattagttttattaaatcaccattgtaatttatttttcttattatgatatatttgctttatgtcgaaaatgttattattattatttagttgaactaaataatgttagaatcgtaagaaaatttagtagagtaaaaaaaagaccgaagtacctttcattcatagtagaatagtgttgttaggtggtaaataaggggtattaaaaagataaacttcttgagttatgaaataatgatagatacggctagaaatcaatacattttgtgacaaatttagtacttcagaaatcagtataacagaattgagggagtacatgggttgagctgtgcattttttttcttgtacatgtgggaaaactaatgagttcagaaattatcctccaacaagacaactggacaagcagctagggtaaatttattttatcgtccccgctatatttttcttaggaaaaagtcatttcaggaatggaaactctcaaccttgcgtattgctttaagagaacagtccgaattacaccccttaagtattaggtgagtacgaattactccctcggatccaaaaaccagacatccttcacccctcaactattaataccggctaaattaattaacctccctcctctcgacttaaaccggagtggttttggttctacgtggcagtcaaatcagcaattcttcttctttttttaatcatcaggccccacctgtcagtctcatctctccatctccttccctcacctctctctctctactcaatcctcttctctcttctccctcacatcatcttcatttctctccatcatcgagcagccggcggaggggtagccgaggacggtggagtgggtgacggcgggcgaggacagcagagggggagccgaggatggtaacaacgggcagggacgagggaggcagcaggtggggacagcggtggcggcaactcagaatagcggagggggagttgaggacatggcgcgtgaatcaacaaaaaaacatgcagaattggccccttccatctttcactagaacggatgggtaactttactatctttgagaaagaattagaagattttatattttctattgtaaaaattaatacttcctattactacttatcttgagtaacattttgatatttataggtattttctcaagtaccacaaaatccctcgtgctaaatagatagggtggcaaaaaagaagacaacgaacaagggatcaagggtttgcatcgtcaagataatgacatgtatataaaagttttatccatgtattatattttatttgctactccctctgttttttaatagatgac

SEQ ID NO: 19686 - DNA, 3201 bp, Oryza sativa
cggcgtcatctattaaaaaatggagatagtattaaattgtgcagataatcataagcgaaacgggtgaggttgatgatcacgttaaaaatgaacacacttgctcatcaacggcgttaaaatccagctggcgttattattcactggtaggtgcttgtgtactgttttttttcagaccacacgatcgatcccctgcttccatttttcggttgctaattagaggcaaaccaaactgctataacaaaaacattctgccgcgagcagtatatatctacgtgagtgcgcgtcaaaaatgaaaatattcaaacgcaacggcataacaaaggtcaaagccccagacaaaaagtgacgaatgagcaaccagacctcgaggttaagcactagcgacacaactccacaatccacaccagaagctgcgaaccagacaaggacatgtgtcggcgacggtgggccgctaatcctccaccgaaactggacggagctgatgcttcttccggcaagctcgccgcagccgccgccgccgccggctgccgtgccccccgtcgtgcgtccgtgcccacctatttcgtggctaagaacataggccatcgcctcgacgtacggcccaaccaaccccaaaatcagcctcaggccgtcacccggcaggccccacatggacggaaaccagtggatgccgccgccggccgccgagcgacatcgcgggcgccgccgcgagctagaccacctctccaaccgcgacagccgccgtaggcgccggcactggcatggcacggccaccttaatcccgcctcgacaggcgggcgctcaaaacctcggctgctgcactgcatgcaccaaagtgaccaaaccgtcgcgccatctccaagactccaaccggatgagttgagttcccgtaatagatcatgtttttgcgtcaaatccacaatcagattatgcgtaaaagagtagtactcggatgcatacgattgacagcgaaatatgttcttattacaccacaaagcatgaacacacactcgagccattaaagtcgcttacccgaacgaactgcagcggtataggattggatcgatggttggttcgacaagctttgggcaaatttactcggagtagaagacaacgatggcagcgacgacgaggctaagaacaatcgtgacaagcgcagccgagttggtcaccttggtgaggagcttcacggaggtaccggtgccggcgccggcgccgccgctacggagatacgcgtagatgaggatgatggaggcgaagaacgtcaccgccgcagaagctggaaggagggcgcggacgacggcggcggcgagaggtagcagatcttgatcagcgccgtccatggcgcccggctggaggaagaagatgaggtggaggaggacgctggccgacgcccacacggcgaagcacgcaccatccagcatccgcctgttcgcagctgcggcgcggccgttgtagacacggaagtagatggacgccatggcggtgttgagggagccgatcgccgccaccgccatcaccacctccacagcaacgtcgagcggcggcagagctcgagcggagctcatcagggcacccaagaactggtcgaggtaggagaccaatccgatggcccacatcgccaccagcaacccgaagcaggcggcggccgtaggggcgctcgccatggatggtttcggtcggattcgatcgatttggtttctcgagagaggaggagacgaaggagggtggtttcggcttcagtttggtttggtttggtttcttgggacgaagctactacaggctacagcaaaagaggagaggaagggagggtggaatccggggagggtgaagggtcggcacgaggccgaagcaagagttgcacgaaagaaaccaaacctactgctgaattatctgaaaaatggaggggaatggtgattggtgcaaaaagaatggctgaactttttgtgccgtaggtcagagtttctacgaaagttttcgcatacaaatttaacggaagtttctcattggtgttttttttggtagatttgtgtagtatatttcttataggattgtagtccaaattttgggcttgcacatataggcaggccggatttggggcccatctaaactttggattggttccattcaagcagttgtttctctaggcatgttcagatgtgcaggactagcagttgagagagcgtgtgctgttcagagttcagatacggtgtggcagattttttttgccgtgtccaggagaccaggacacgcccaaattcggatgtctcgtatcagaagaaagtttcatgtatcccttcttgggttgcccatgaacagaacactactgttgcagaaacacactgtttttgtattatggaagaagcaccggaagacaacacaagctgcccttttatcaggaaaagaaggacatgggtaagaaaatttgttcctcccaaatcaggctatgggccgcgtcgacagcacatctttgtcaaagcaaatggccagatctagtaaggcaaacagtttttccgttgcctaagctgactcgtttgttcagaaaaggcagggcaaatcggtctcaaaacaaaaaggagcaggagatgcagaggaaaagagagaactgaaattcagaaccaagagaaattgacagtggattgactaaccctggctgacatggctgcacacgtacggcagcagcgcacgcacgctcagctcagttccggccatggaagccggctgcttcggctgctcccctgcaaatctgaaatggacgaaggggaagctcacttgaggcgacagggggttgacctgaaagaagtgaagtctcctcctcccaaatttagattttagtaaagcaaatggacacagagagagacagccaatcactccccagtccccaccacacacacacctgttgtaccatggaattaaatttaaaaatatactattcattcaattttttcttagaaatattcgggatgcaaaactttttacagaaatataccgtcgatctcgcacaaccattacacgaaaatgacataggcgtgacgttgcggacggtatcgcgcggggaaagcgcgagaccgcgcggtctcgcggaacagaagagcgagaccgttcggaatcaaataacgacacggtccaaaggctccatttgattagcgattaaatacttaattaaccatttactaataataatttagtaattaattatcc

SEQ ID NO: 19687 - DNA, 6449 bp, Oryza sativa
accacgcggtctcgcccttcccacacgcgatatcgtccgcgacgtcattgtcacgtcactttcgcgtaacgtttgtgcgagaccgatggtatatttatgtaaaaaattttacatccgaaatatttctgagaaaaaattgaatgaatagtatattttcaaatttaattcttgtaccatggcaccaccacaaaacatgacaacgcatgtgttacgaagtatagtaagtttggaaccttaatccgccctcaattgggtgaaacatgtcactggatttctacaggcaaacatgtcgtgctaggatgctagctaggagcagcagaaattggctttgggcacggtaaaaacatggtcaatggagacggttacccacaactccacaagagctatttttccttttcggtttcaaaagagaactatatttatttgctcgtctcacgcgacagtcacgcagtgacacagtggtgaattggtgatccttgctgatctgatcagcatgttgttcagttgttccaaatcctcacacacgatcccaaaaggaggaaatctgtcagttgtaatgactaatgacaggggaaagaaaacaagtactccctccgtcttaaaataagtgcagttttagcactgttcatgttcaacgtttgaccgttcgttctatttgaaaaatattatgattagtatttttattgttattagatgataaaccatgaatagtattttatgtgtgactaatttttttaatatttttattaaatttaccaaataagacggatggtcaaaatgttaaacaggaaattctatgggtacacttattttggacggaggtagtacaaaaagcattcgaaaggaagcacctttcagaagtggcaaacgtggtcaggaaacgcctttctgaattccgtgggcagatcaccgccgagttgcaacagggcggcatctcatctccagaccttcgccgatgtattacggacatgctggtgttggtggaagagtaaaatttcaggccagcatgcagcaacaacaggcacgaataacacttgttcagaatgccactacgacagattctactccaacttcagtaggtacttattttcgtcggcaatagaccttcagaaagagcggcacgaggacatggcctgactagccttgttcatcaccagccatcatcaataataacatgggatacaaaaaaattatggagaaaatattcacttcacttgtgcctgtcgcttttcggctgcaccatcaatcatctgtgcactgtgctacatgcatactcctactacatgaaacaaaatgttgcaatcagggtttacaaaactggtagaaaccatccagttttgtgaaatctggaggttctaagatcacaatccactcggtaaatttacatttcaaaaaagaaaaaaacaatagagcacattttaaactggttaagttagaaaaaaatcaaactgaatatttaaattttgacataacttggttacatttgaacagtttttttttctgaaaaaggattgtcatctgtttcgtcaaccctaactacacgcttacactcatatgtagaggttgtttagatccagggggtgtaaagttttggcgtgtcatatcggatatacggacacacatttgaagtgttaaacatagactaataacaaaacaaattacagattccgcctataaattgcgagatgaatttattatgcctaattaatccgtcattaacacatatttattggagcaccattgttaaatcatggtctaattaggcttaaaaaatgagtctcgtaatttacatgcaaactgtgtaattagtttttttttgtctatgtttaatactccatacatgtgtctaaacgttcaatgtgacagggtgtaaaatgtttgcatggaactaaacaccggacatgttgttctgagcctgtgctggctgccactttccaacaatcaccacaattttggcaagctgaactgtgatagacgttaaaccacaatgaagctagtgatccaaactcccagagccttcaaatgtaagacacaaatttagtcctttgatgagatatctagcaaagaacaatggacaaaacgagtgcccaaagaaaaggctcgtggcctttccagtttccaactttccatcacagggggaaggttcgaaaggaaccgcacagagcagaagtagacgaaagactcacaccactccactgggcactagcagtagtagcgcaatgatagcaaagtacgaagatttcccaaagaaaaggttcccattccttcaacgagaagatgaccagttcagcccactgaccgagacactgctccaaagagagatgcgaacacgaacccaaatcacatttcacatatcgggttgtgtttagttcagcgcaaagtttatattttgattaaaattggagatgatatgactgaaaaattatgtgtgtatgacaggttgatgtgatagaaaagaactgaagtttggatccaaacttgaatctaaacacaacctcggttctcccagcacacgattaaaaatgcaaaggatgaaacgcacaccacttcacaactcagttactacgccctcaaagagaacagaaaaaaaaaaaaggaaaagaaagtactccgtagcactagtgtcaccagtgggcagtggtctgcacacgatgcactgcagcaggtggtaccgggtacacgggacacagggccccgggcatggtatgtgaggtcccgttcatttctccaccaagagttggatgaagataaaaaattttgtggtacgttttttaaactgttaaatggtgttttgtgcgaaaactttctatatgaaatttgctctaaatatcatattaattttaatttttttaaggttataataattaaaactcaatcaatcatacgttaatatcacctcgttttacgtaaaaaacttaatctccatcttcaggagaaaagaacgccaccgaatcttcatagtcaacaggcgcaggcgaaggcacaacgcagacacatcaggcagcggggggtgggacgacgaggaagaaagcaaaccgccgaggacgcaagggcctgtttagttcgcgaacgaaaatttttagcgtgtctcatcggacatatggacacacatttaaatgttaaacatagactaataacaaaacaaattacatattccgcctggaaactgcgagacgaatttattaagcctaattaatttgtcattagcaaatgtctactgtagcaccacattgttaaatcatggtacaattaggcttaaaagattcgtctcacaatttacacgtaatatgtgtagttttttttatctatatttaatactccatacacgtgtctaaacattagatgtgacaggttgaaaaaattttgttcgggaacaacacacaggctcaataatcacaaccatcctgtggaagcggtccgtggccgccctcggcagcgtccggccggtgccgcgccctgcggaagaaaaggcgagaagcgtggtgccgaccaccgtggcggcggcggcgacatccggtacgtacgtgctcatcatatcatcacaagaggtctccattggctgccgcagctaggatctgcgcctgcgctaacgactccatgattgaaaagagggaggaaagaaaaaccttcaacccgtttggctaccacacgtcactgctgcactggccgatgacgcaatacaaactgcgtcactccaaacgtcactactgcactactccctctgtttgaggaattttttatagggacacgattattaagaaattggataaaattaaatagggaaaatttatgattggacaaaaagtgaaggtgggtgaaaaaattaaatggtggagaattgtgattgggaaaagaacattggtgaaaaatttgtcatattacttgttggagcaggttgcagattgtagaaaaattatgtgccctcttaagtcttatttttgttgttgtcctctgtttagtgaagtcacaaacttgcaaatcacaatatagtaagatctctacttaaaaaataattttactgtacgggaacttcaaaatcgaccttcatttttgcatgtagctacttaagagatccgcatgcaaaaatttatttttactgtcgagtctcttaaggggccacatgcaaaaataagtatattttcacatgcaggcctcttacttagtccgcatgtgaaagtatcctgctcttcttcatagttttttcccctcctctctctttccctcaccacttcaatttttttccacctcgcatcctctctctccccctccgtctactgatgtctctctctctcctctcctctcctccgagtgggagcgggcggcagtgggcagcggctgggcagctcggcggcctcaggtggcgccgtcccgcgtggatccgacggcggggtggcccatcccagcgtggttctagtgccggcgacgatgacgggcggttgggatggagaatgcgatgttggtgacgagcgggcggtgggggtggcagatccagcgctttgatggagacgacaacagcaggcggcgggctagggtttggggttttttatttttatctttttttttgccgaatttattttcgcatgcggccggtataggtgacaacataagatgcgttgctcgcgtgcaaaagtccgattttcattggccgtatgtaaaattcacttttggtcgcatgtaaaaatgatttctgtagcagtggatggagtgattgatgagcaattaagacctccacaaatatgatttataactcagtaatagctgtgttttttaatatttgttgctgatactgtgtatctttacatttaataacgctcttcaataatcctcccttcgtgttaggttataagacgttttgactttggtcaaagtcaaactatttcaagtttgacaaatatggtaatatttataatactatgttagtttatcaactcaataattgaatatattttcataataaatttatcttgggttgaaaatgttattacttttttctataaatttagtcaaaattaaagcagtttaatttcgactaaagtcaaaacgtcttataacatgaacggataaagtataatatatattgattggtaaagtcgagtgatttttcccctctcgtgataataccctctgcctcgtgccttctgggcgaaggtatgccatgcaaatgtggacggctaaagagtcatcaaaattttagaacggcgttttttcagcacgggtggaacgggcttttcgcctgattctccagctcgcagtgctgagtgctgattggctctggttcctttcgattggggcaaccagaattcctctcccggtacaatgcacaaagtacaggtggctcgtgcactgcaccgatcttgtgtacgcagtgtgtacgtaactttgtggccgacaaggagtgccaagaagtcaagaatctgccgttcgttaactcgagagcggatatatataatccttatatcccaaaataaattaatcccatacagatatatcttatccacatacgagataaacttattctgaaacgaaaaaagtatataggaacaaaaaaataattttccatgtaaaaaaaagataagtattttactagcatactaaaaaaaggtaagggtaagggtatgtttggttcatccacatattgccaggtcgaaggttaaatatgttgcagtttattaagataggcatttagttgattattttatcatgtgataagccctactttactcatcactagtatatcccgattcgtactactactccctccatcccaaaatataacaacttcttcactaatattctctttcttaccaatcacaaccctctaccattcacttttcccatctatctccactactcatccaatcacaaccctccaccattcacttctacctatttttttaataaccgtgtccaagcctaaaattttttatattctcggacggagaaagtatattactatattttagaataaatagtgtatttaaatttgtaccacacttatgaccatactttatgggctttgttacatctataataggttgaattagataaagttaggcatcaaccaaaaaaatcaacctaaaaccaacctgtagccagcatgcagcagaagacgaacaacacaggtcgagaaaacatgaacagaagatcaggactagcttttaggatccgacacatcttctgttgcgcactatatatatgtatttttaccactactgctactttcactcaagacggtatattttccgaggacggctgtccgttgctcatgactactccctccgtccccagaaaaaagggtaaaccttgatttccgtgtccaactttgactgtccgtcttatatgaaatttttttataattcgtattttcattattgttagatgataaaatatgattaatattttatacgtgacttgtctttttaatttttttcataattttttcaaataaa

SEQ ID NO: 19688 - DNA, 4101 bp, Oryza sativa
agtgcacgcattacgacgttccccagtgcacacaagatggataaaatacgagtaatgcatggttgtaacacgtgacatttgcttctctcttttttttttttttgaaactctagtgggacaaagattgtgatctccaaactatagtactgcaatacgaggccaacatgcagcaccagaaaagcaaaactgtatagtattgtagaaacggcatgggcacatgacaagaaactgtggctagccttgttcacaccaggcatcgtgataagaaaggacaaaactttcgttgagaaaatttcacttcacttcgcttttggcagaaaccatcctccatccaggaaacaagttgcaaaaatcatatggcaatcgaaccggccgtgttgctccgggcgagactctggtggctgtaactatagggtcttttttcttcgcgaaaagaaaatttttaggtgtcatatcggatgtttaacaaatgtcggaaggggttttcggacacgaatgaaaaaaattaattttataacttgtctaaaaaccacgagacgaatctgttaagtttaattaatccgtcattagcacatgagggttactgtagcacttatagctaatcatggactaattaggcccaaaagattcgtctcgcgatttctcccctaactgtacaattagtttttttaatctatatttattgctctatacatgtgtccaaaaatttgatacgatgtttttggaaaaaatttttagggaactaaaccatgcctatcaaacaatcactacaactttcgctaggctatgcctcttacgataacgagcccgaggagatgacagttgctgaaatgctgatggacggcaaaccacaatcaaggccctgtttatagcccaccccaaaattttacatcctattacatcgaacgtttaaacacatgtataaagtaataaatatagcttaaaaaataactaattgcacagattacgactagtctgcgagacgaatcttttaagcctaatttctccataatttgataatatggtgctacagtaaatatttactaatgatagattaagtaggcttaataaattcgtctcgcggtttactaacagattctgtaattagttattttattagtgcccgaacactttatagccctagatctaaacacccccaaagctgtgcgatccaaactcccagacccctcaaatatggtactgcaagtctgcaactaaagacaggaaaaaaaaataactcgaacattggataataacgagtgccaagacaaaaggctcgtggcctttccatcacaggcgaatgttggaaaggggaagagcgaagcagaaaaaagagtactcaacagccccaccccacttagtagaagtaccccatgatagcaaagtattccctccatctacttttgatagtcatattttatcttgtcacacagactaaggataagtaattctaattatcatccatttaaacatgctactagtcattcctcgtaaacaagcgattcattaatatttatatttctcaatacccatgtagccaatcgtgtgtggaagaatggatagttatgcattaaatccgagaaagtcattaagatgatagtttattgtattgaaatatgcctatcaaaaatatttttttcagatttggaaatatgactatcaacaatagatggagggagtactacgatagattttctgttatctgtgtgggccctttccaaaaggttgctttccaaaacatggctggagactgccctagcaattcacttcaacgagatgatgttcaagttcaacaaaagctttgtatttctcgatcacataaatttggcaaatgggatgaggcaaacacgacgaaccaaaaaggcatttatctagtgatagacactaaaccacaatcaagctagtgatccaaactcccagagccttcaaatgtaatatacaaattagtcctttgatgaggtatctagcaaagaacaatggacaaaacgagtgccaaaagaaaaggctcgtggcctttctagtttccaactttccatcacaggcgaaggttcgaaagggaccggacagagcagaagcagacgaaactccgggttgagtacttcctccgtctcattaaaaaccaatcagtatcagacgtgacacattatagtactacgaatctgaacatacatatgtccagattcatcgtacatgtcactttcggttctagattcgttttttatgggacggagggagtaggcactagcagtagtagcgcaatgatagcgaagaaaggtttcctttacgaaacatgggtgcatgcagaattcacgaatggtactggtctactagtactagcagtaaggccatcacagtgagtcatcaagttttgatgttccacaagaccacatacaagtagcttgtagtgggtcccaccaatactactttcccctcccccctctctctcccccactcttcctttccccaccgcaggagtcgggcggagacagaggtcgcggaggtcgggcggtccggccgggcggcggatcgtgggatcaaccttggacggcagcggcatgcgcggcggcgggcggcggcgtcggtcagcaccctcctcccctggccagctcgccgacgagtcctaccgcgccatcatccccggtcgccaaggtggtcggactcgctgtcacggctgccgcgggagtcggcgcctccgctgccgccgttctcaagagccctgccacgggagtcggcgcctccggcgccgtccttccctccccggtcgacgccctcctcccccggccgacgccttcctcccctggccggcgcgccgaggacgctgcctgccatagtcgacaccaaggcggcgagctcgatgaggccggcgacgtcctcaacttcttcagtcccctcccctccccctcgcttccggcggctgtcgagctcgcggcggcggggatcgacgtcggtgggcggatcgagcttgccggctccggaggtgtcctcgccgctaatggcgacccgtcgagctcgggtggtggcctcgccggcgacgaccaccaccacctagcatgggatgtgggagcatggcaggggaaccgccgccacggccggtggtgaggtggagtgaggtgtagacgctgctatgcacgatgattgaggaatcactgacaactttgatggaatcgctgacaactttgacgaggaacgtggagctttctttggctccgcgttcttcagtttctagcgtgagaagtgcacgtggctgggaatctctgatgttaaagggggaagccgaatgccatgtcacgcactgtgaacgccctaatatattccatttcttgcccattccttcaacgagatgatatccagttcagcccactgaccgagacactactccaaagagagaagcaaacacgaacccaaagcacattgtgtacatacaccaccgcactaccgagtaccgagtacgttctcccagcgtaaaatgcaaaaggatgaaacgcacaccactttagtattacgccctcaagaaaacagaaaaaaacaagtagcactcgaccactcgtgtcgccagtgcaggactcggtcacggcgatcgggcgatgtgaatcttcagagtcaacaggcgcagccgaagacacgacgcggacatgcgtcgacgacgacgacgagcgggacggcgaggaagaaggcaaccgccaaggccgtaaccatgaccatcttgtgggagcgttccgtggccggcgtcgtggcagcgtccggcgtcgcggccgcatgtttcgccttgcggaagcggaggacgaggatcgtggtgccgaccacggtggcagcggcgacgccgacgacgggcacggtggcgagcggagcaaggaggcgctgcgatggcgcgtcgaggatgccgaccgcgaggcgccaaggggcaacgaggacgaggcagatggcggcgagggacaccgaaagggtcggcttgataccgcgctccgtggcggtcgcggcaggggtggcgccggcgccggctccaccgtgcgcattcggaagaagcacgccgcggacgcgcgaggcgcaggcgcccacgacgagggcgactccggcgaaggcgagcgggacgaggtgcccgga

SEQ ID NO: 19689 - DNA, 6325 bp, Oryza sativa
agggcgggcgcggtgaccgcggcgatgacgaagacggcgatgaggatgtcgacgagggggctcttcccggcgaaggcaagcaggagacgcagcgcgtctggtccgcccagagcgcccgcgcccatggccacgacgatgatgttccgaataactcgagacattggggctcaccgcctcagaactctgctcttccttgtgctcgttggcctctctctgttttttcttttttttttttggcaccgttggcttctgtttgattcacgattctcgcctacaaccgcaataatatatagtatgtggaagggtatctgcttgtgcgtttcttttttctttctttctttttttttttacatgtgtgcttttgcgtttctggacacactcaccacacatcatcgccgccggcagaggctgggcgggtcgttatcatgccagcgtggtccccttggagatccaaacgattcgaccaatttcatgtatggacacgttgatatacgggtagtacaaagacggtgaggaccggaagtgatcgcgattcgcgagtttcctttgaatcgatccgtaacgtactccacagggccgaaaatgatcgtgattcggaattcgcaacagctcgttgcggtgacaaaccggactacataactgagttgccattgattgcgtattttgcgtcgtagatctctgtttcctcgcaattcgcaagataggtactctactccttacatccaaaaacttcttcatttctcattatctttatcctaaaatagtttcatctttcaaaagtcattccattgttgtttgtaaaggtgaaggataaatataccgaggctagataaaattgcattgagatttcttactttgatgataaacaaaattattttggttttaaaaaaaaataaacaaagctattttgaaatggaggtagtagcattgttgatgataaagcggtgacacaataggcagtaatatgttgctcctccactgtttcccgcgagagtgtgccattgtgcaagttatttaattacggatgacattttggacacgccatttttcttcatttccccccttctccctactgcactttacctgttaattgtaatgataaggagaaaaaggaaaagaaatcacagttatataggctctgtttagttgatggtaaagtttagattttagttgaaattggagatgatgtgactaaaaagttgtatatatatgacatgttaatatgatggaaaaagactgaagtttgaattcaaactttggatctaaacacaggcatagtcgagaatttggggatggcgtgttcacacttcacacgcccaagtaatttattcggtcagtgagctggagaaggaagcaaattacgtttggccatcccatctttccaatttcgatgaccgagaatctgagatgcaatcctgctactttcactcaagacggtatgttttccgaggacggctgtacgttgctgatgactagtcttgttcatcctcagtcgccgtaaaggaaatttcacttcactttgcacgttgctttttgggttaaaatcaaaccatgagaatttgatgataagagcaaggctaatagtgaaaagtagtagtcggcggtagtacatgttcaggtcatttaaagttaatactgtatattgtttatataaaagattggctctagagtctagatgtgctttacggaagcaagaataggtttaaagtcaagtgctatggtagatgtgactatcacctctaaatttatctattttattcaatcatgaactaagaggcaacccatacaatgtatcacctctagtacacaaataccaatatatctaatactctcacatctttcttgaaatttgtgtggaggttacctcttgatttaggggtggctcatcatctctctcctcacttctctcctccacatcatcacttaatccaatgtggcattcttagggataatatatgggtcattatagtacttgccctaattgttacatgtacaggtgatcaaaactaaactccatctctgtagcccatcctgcttcagcatgaaactaaactagtacttaaaatcacacagtatgcatatgcacataagatcaagtaactgaactatagacccaccaagcgaataaaatatttcatcttgcctaatttaccgtgctatcgtccggcgcttgcagaagcgctcgtttcgctctctctcatgctttctccctccacgtatgataatactgatgtggtggttcctagcgccagctgagttcagtactattagagcaagttcaatagtatagccaactactagctccaattcatctataccaatctaatagctcattcatacaatagttacatactacactattaatacctggtcccacctgtcatacacacactatgtcttggagtccgtgctacagctggctacaaatatgtagcccgttgcccttctctctcctcatttatctccttaaaatatgtttgcagctggcttatagcctgctattgtacctgctcttagggtatttacaatgcaagctatgggacccatagccttagcctcaaaacttggtccaaggacacccttcccacagtgcaagcacccatagtcagggtaccaagcctacagccggtgggccccacgaaaaggaatcgtcacattgagtactactcgcgcggaccgattcgtcctcctttcccgaacagccctcgcgcgcctcctcgagtactactcacgctgcctcgcctcctcctccctctccgcgacgccgatgggaagcggtggcgagagtcgtccccggcggaggcggctggcgcggcggtggcgagaggtgtccccggcggcttgcgcggcgttggtgggaggcgtccccggcggagacgactggcgcggtggcggcgggaggcatccccggcggcagcggcttgcgcggcgtcggcaggaggcatccccgacgaaggcggctggctgacgagacgggtaggaggaaggaggcaatggacgccgttcttttttttttgttcgtttttgttctttagattcttgatttgtttgcaccaccttgatttctttgggttctttatttgtttccccaccttgatttcttccggttcttgattaacaggcgtggatttgattggggaaatcttgcgatatcggtggagcggatgaatcggtggtgaatcgggagaggatttttgagggcgaatcggggatttcgcgatgggattcggcgcgagggtacgacacctctgggtcacgtgctccacagcgcacggagcttgctacgcgtggactcgctgcgagaaagttcctcgcgtctttacttggggccaaggggctcaactagggcgcgcgaccttgctccacgcaagcacaaatcctcgttggcgtggtatagcaccggtctatgtcactacactgtgagaggccttatacctgctctaacagggaaagaaaaaacctctgcggcaatcatatgcctgttgcaatgctacccacggccaccccaccatagactgtttttcgttttaaggtccactgttactatttttttttttacccggtgatgattataccacaatcaagctgatggtccaaactgaaagaggccccaacgatagtggagtatctgtcaagaattaatataagacaaaactggcgccacaagaaaagataagagttctcgaaaaaaaaccaagaaaaggtacccgaaaaaaaaaagaaaatataagtctccaaagcttcggaatggaaataaaggtacacgtacacgaaagttggaccgagatgcaaagagcagaagaagaatgatgcgaagtgttccaaataaaatcgacctttgcacaaaaagttccaaccgagcacatcgtagagttgaatgatgtgtcaccgagaaaaaaatcgacttacagatagaagttgagcacaagcaaataaaaaaaattgtcaagttgcacgagggggcggtggacacggatgagactaaggcggaaatgctaacgcccgcgctggccccttccatgtactattgccttcctcttcttccccttcctcctcccctttcactacaggacaccacacaatttttttaaaaaaacaaaagttagaaaaaatttatgtatagaaatactatatacaaaaattttaaattcaaattcaaatttgaattggtatgtaaacttttgacttataaactttgggtctataaactttagatgtataaacttttagatgaatagaaatattatatatagaaaatatttgaattcaaatttgaatcgggtatgtaaatttttgacttataaactttgggtctataaactttaggtgtataaactttagatgtatagaaatactatatgtcagggttatgtacaccacatacctaatagtagttgactaaatctcggcaggacccaccatataccatgtcctatacggaaacaacctgcagatataggaggagttccggataaggaaagacaaccagagttctacatggaaacgacaagaactactcggattgtatccatattggtttccctagttctacttggacaaagggacacctatcggtataaatacaagcccccctaggagtacagggggacaaccatgatgagacgatcaacacgatcaacacccaccatgacgagacaatcaacacccaacacaatcaacatagaagccacaacatacaagccaacatactctaagacaagacgccggatatcgacttcagagataggcatggctattcccctacggtgtctccggataccatcaggagagacgaaaacgctatctctgatctcgccgggcacggattcgaggaggaaggctaccctgttgtcgactacgagtcagatcttcagaccaatatgtcgacaacagttagataggctaccccacatattgtactggtgtgattatggtgaataaaagcaactccggctccggccaacagtatgtagggttattacctgacagctcaagggcccgaacctgtataaaaatcctcgtctccatctcttttacctcagtctcgtgtatatcctagcaccaacgatccccatactgtccaaataccgtagttgagacatcaaacgtcgacagtggcgtgccaggtaaggggattttggtgctctaggatttcaacgagataggttcaaaagacgaattctccgacaacaagctactcgatgacttcgctgtggggagatctaacccgaccaaaatatgtctcccgatgagatcagaaccatcgtcgtcaacaactcgatctctcgagatcgaccaaacttcaagacatcgctgccgcggagaacagtgacttgatattatcaactaggaggtctccgatctccatctcttcggaagcgacatcatcaactgatttttggtaacctcggtaatgccgctgcctgctcagaacaccggccatcgaggaaccaaaatcaacatctcgatctattcactggattcttttgggactcggatcattctcacaccccgattaggatccaaattttggacccctgacgcatactgagaacatccatcccgacatcatgtgttccaaggatcattgatcacggatatctaccaaggtatcgagaaaacaacaagacaaagatccaactaatatgcttgctcctgacatgtacacatgcatatgtatggactcagtacgtgcttaggtatgcatgcattagttggccgacgtgtacatgcaaagaagaccaacatggctgtctaaattgcaatgtgttgattattcagataaatcaacggccgcccgtgatcaggtatttagtagattgattttttaaaaatggtctactattttcgtagatacatccggcatgtatctacaaaggtacgcaatattttatctgcaatttatcgtacctatttttccaatttatacagcattgtcagatcaacaatttattatgtttacctagagcatgcttcttatacaatatccgttgtgcgagtactttcgacgataggccaactatggtctaacgctaggggctcactccgttctctcctgtataaatcatgcttgtttacggtttacataatgcctgatatttaatctgcttgttgtatcctgataatactagaagatctatgcaattttttgagtacatactcgatattatctgctatatattttgcgttctagaaaatatttttcaggaacaattgagcactcgagtaggtaatggtcgagtaaactccattatcgagaacattctcgacaaatgcggagttatcgcacccaacctgccaacaaagaccgacgacctatctcata

SEQ ID NO: 19690 - DNA, 1258 bp, Oryza sativa
  unsure (1)..(1258): unsure at all n locations
tttccacttctagtggtcgagttacgactactgcctggtcctcgactagcggtgtagcgatttctcctactacttctacttcaacaaagttggaagcaggtacacaatatcgccaagtgttttacccagagatcccttaccacgatgacacctagcgttgaaacctatcctactgtccctttacgctggtctgacaaggcctccgaggaacctaagggatcttcggctggggacgcccagaaccgataaggccttgtcggatcctatagagacgaaagaccatgttaggcgttgttcggttaaaggtcttcccgtgggtaattaaccaaccggggtatcggaaaattacttttccaacttccgggctgggggttaggatcagtgcttattcaaccaagccaggtcaagggtccaagacccttatcttccaagaagaattctccgacgacaaggctgggggctagggagagtgtatgactctacaaactgactgatcaaagttggtngagagaaacgctcgtaaacaaaacattggttggtaaaaaaaaaaaaattnnntnttaaacaaacattggttggtaaatttaattcattttcaatttaccatacatattataacatgtcaccctttgagcattcgctcgggggctctttctatctaatattcttttctgagtattgatttcaggaaaattctattcgacattatcgaagactccatgtctctatggttctacaccaaagatcgactaaggcgagtacgacaaatgtcgacaaagctccgtcgcagactctacgccttctcgatcgctcgagaacggttgctggatctcgaaaaggaatacggaatgaagaaattgtgtacccgccgagataaaatttcttgacttcaatccaaattctcgattacagcaagacgggagacttagtcgtacgctctatactttctcggtcgacatcagagattgacttagacaaaccctttcggtgcccgcacgaggctgacaaaggaagtccaacgttctctctaaactcaccgagaacggtcacatgacctcgataatagttactccaatgtctgcgcgggtgagaatatgaattcgttcatttgcatcgaagtcgggggctactgtcagggttatgtatccacatacctaatagtagttgactaaatctcggcaagacccaccacataccatgtcctatacggaaacaatctgcggatataggaggagttccggataagaaagacaaccag

SEQ ID NO: 19691 - DNA, 14640 bp, Oryza sativa
ccaaatgaatagtaatgcccatggttaatttggtacaattctagaactttctttaccataatataaaatttggcttccaagtggtattaatccaaacacattacctagtattctaccctaccaaattattaatagtgccaaaacatacctaggttttggcactaccgatgttttggtatgaccctaaaccaaacaagccctgagattttttttacgcgaattcccacaaatcaatttctacactgtagcgattgatttgagattttgttcgctcgagtcaatcgaaataggtcttgtttggaagattagtcccgggctaattttaagagctaatatttagtcttgaattggtaggctaaacattagtctgggacaatatctttggatccatgagctagtttagggctaaaagatggagagagaggagagagaggggggaggaagataggactgttttttttatggtccccacagaaaattagtcccattagcactctttggagaggctaatgttttgaggggggctaattcacttaagccccaaattaacccacatgtttggatccttaggggctaattcagggctaaaaggtgggtggctaataattagcccatgaaactaaacagggccctaatcccaccaacactataggtgtcctaaagaatgccgtattcaatttcattagtagacgtagggtggtatttagattaggggtgttaagttttgatgtgtaacatcgggtattatatagtgtgttgtatgaggtgttcaggcactaataaaaacataattacagaatccgccagtaaacagcgagacggatttattaagcctagttaatccaccattagcaaatgtttactgtagcaccacattgtcaaatcatgaagcaattaagcttaaaagattagtctagcaaattagtcgcaatctatgtaattagtttttttagcttatatttaatatttcatacacgtgttcaaacgttcgttgtgacagggtataaaatttttgtgtgggaactaaacatggccgtactacctttgtctaaacaataaatctaatactagatatgatatattataggacaatgaatctgcataaagatatgtctagattcgtagtaataagatatatcacattcactattaggttggttttttatgggacgtgggagtactacagtctacacaatgacggcagatgtactccatctgttcatttatggtgtcgttttgaacctttccaaataaacatctacgtatattagcgttcatgtgtgatgtcctttcgcctgaaacgtttaccagaagtagtagatggcaatcgcagaaaaaaaatgtatattagaaaacctataggatgactcagattaccacaattggacattggactagaatagttttgcttccaagctcactattacacatttaaccttcaaattctggatcctaatatttacacagagaaatattggatgcgtaataataccactcggtaaccatgatatagcaaaaaataagtatactaaataaaaaagagtaccatttaagaatggacctgttccaacttcatatactttggtctttgtatttttttaataaaaaaaacagagtccatttgaagttccgttactccaagatagaacaggataatcttaggagatgacatgcggaagaagagggcgaaaaagctcataggagcagtacgtcttgaccccttttctccgtgaggaggattcgccgttgcgggttttagctttcggcagcgtttcgctatcatatggatgcggacagttggattggattggatagcgagtgtgggtgagtttttttttttttttttgagaaccagtgtgggatggtagatctgcttcgaggaagaacaacggatgctgctcgtggacaacaactgaggacatgatcacatgaattcctcacatgaatatacaagagccaagtcaaacagtttccctagaaggaaatgatgtcacacggtcattttctgttccctttctctccactgagtagcgcacacaactttgcgctatcaatcgactataatgtacttccacatgcagctaaatgaaccacatcactcgccaggggcgcttactctacaatttcgccacatttccgccacgttcaaactggaccagacggctataggcaattgcccataactttatttgcttgccacaacatccgtcggacacacttttttcatgtagagatcaggaggattattgccgtcttatggcagctagatactactctggtgtgaacggcggcaaggcacgagtattcaactgtttgaacggcatattttccgtatatgccacacgggttcctttcgctcgcgtggcctctgcccttcgaccttcggcctgttgggcttttcgccgtgcccggttgtgttgtgtatgccttgatggcgtgtgtgcaacagtgcaaggagaaaaaaaatccctttccgtgtgagacgtggcgctcaaatacgaaggagaaaatacgtttcccagtgcacacatgaaggagaaaatacgagtaatgcatggttgcagcgcgtcacaattggccggcgatccttctgatctcaaaaaaagaaactatagtgggacaaagactctgatctccaaactctagtacaatccgaggccaacataaagcaccaaaagaaactatggaaaatttaaaccatgccacacaaattttcaaaatttgtgatatgtcaccctaacccacatatcattgactcatgtgggtcctacatgtcattgagatacgggtggcatatctcaaattttgcaaaattaaggtggcatggttccaacaaacccaagaaactaactgcaggttcattatgtcactacatattctttttttttcttaaggccgtgtttagtttcaaagtttttcttcaaacttccaactttttcatcgcatcaaaactttcctacacacacaaacttttaatttttccgtcacatcgttacaatttcaaccaaactttcaattttaacatgaattaaacacaacctaagttaagtatagtattttagaaaggataattggcgttcagagaaaacggcatgggcacatgggctggctagccttgttcacaccaggcatcgtgataagaaaggacaaaactttcgttgagaaaatttcacttcacttcgcttttggcagaaaccatcctccatccaggaaacaagttgcaaaaatcatatggcaatcgaaccggccgtgttgctccgggcgagactctggtggctgccacttcctaacaatcaccacaactttcgctaggctgcgcctcgtacgataacgagcccgaggagatgacagttgctgaaatgctgatggacggcaaaccacaatcaaagctgtgcgatccacactcccagatccctcaaatgtggtaactcgtatttatatcaaagaacattggataataacgagtgccaagacaaaaggctcgtggcgtttccatcacaggcgaatgttggaaagggaaagagcaaagcagaaaaaagatgatagcaaagtactcccatggtcccaccccactagttgatgtacccgatgatagcaaagtactacgaaatattttccgttatctgtgcgggcctttctaaaacacggctggagactgcagtagcaattcactaaactagttctgttaatacttcacgtcgattactcacttcaacgagatgatgatattcaagttcaacccgaataaggcaacgaaaactcgtatttctaaatcacataaatatagcaaatgggacgaggcaaacacgaaccaaaaagacatttctcttcccgattacacgaaagataacatatagcatatgtacatacaccaccgtactcatacgagggattacgttttttttcaaccaccggtgcccagcacgctgcaccggcaccgcaccacctatgaacaaaggaagaagatgacgacgaagggcgtaaccatcaccaagatcatcttgtggttgtggaagagcgccatggccatcgccgttggggcggcggcggcggcggcatccgcatttttcgccttgcggaagaacaaggtgacaactgtggcgccgatgatggtggctgtggcgacgcagacggccacggtggcgggtgggttcttgaaggcgaaggcaaggaggcgctgcgcaggcgcgtcgaggatgccgaccgcgatgcaaaggacgaggagggagaagacggcggcgagggacaccatcagggtcgccttggcgaagcgctcggtggcgggggcgccgccgtgggcattcgcaagaagcacgccgcgcgcgcgcgcggcgcaggcgcccacgacgagcgcggctccggcgaaggcgagcgcgccgaggcccccggactggaacagcggcaggaggatcagggtggcggagacgaggacggccacggccagggacaccgccagcgtcatcttggcgaacgggtcatcgaccgccgcacccgttccgccggccccagcgcgcggcttgcggaagaaacgcgcgagaagaatggtgccgagggcgggcgcggtgaccgcggcgatgacgaagacgacgacgaggatgtcgacgagggggctccgcccggcgaacccgagcaagagcctcagcgcgtccggtccgcccagagccccggcgcccatggcgacaacgatggtattccgaagaattgcggccatgggggatggggctcaacagctgagaacactctcaccttccgtgcttactcaggctaagctgccgatcgatctccttcgcggctctgctcttctcgccgtggctgaacccctcgaccggcttaatttataggtgttgattaacggcatattcttggcagcagcaggggcccagggggcattgctgatttgccgagcggccgtgctgatgcatactagcacatcttttccaccctgtggtcccagtatagaagatgtgaagattcggtactggagctggagctacgcgattgcaagtaaaaaaaaatggattgcaagtatccacataatacgctagcctcgtaggtttgcaagtatatatttggcagacccctaccaaaagttgaagatgtagaaatggattgctgatttgggttctcgatgtacacagagtgagagagatacataaggctctgtttctcctggattcatgtagttcgataggttcgaaggatcaaccgaaataatcgcgtaactcgttgccgatcacggagcggatgacaacgaagtccaaggatggatggcacgaattgaagagcgattgattgtgctgcatgtttcagtccaagctaggcgccacagaacggacaaaagtaagaaaatcgctacgtacaactcacgtctgaccagcacttagctgctaattgccctagccacatggagagaagttggtctgcgtgaagcgtaacgattggcagataaagttggattggatgggaatcggacgagggagtcgaacgtatagcaacactccagaagtaaagcagtaaaccgaaaaagttttgctatcacttgtatgaccgtctccacaagtggcgactggcacgacatggccactcgacagaaccgcacaacaaatgctgatcctttgcccctattccatgcgaagttgcgacttgcgagtctttgggcagggcatgcactactgacaagatgaaagaagaaaatcaaccgtaattcgggcgtgcactgctgcagaatagtccttgtgatcatgtccatgtgaccatgttcgttacgttctgaggcgtcgatagcgagcgatgctggtaatcgtgaccaatctcgttcacgtccaccttgttgacgcgcacgtacgtcgctatatatgacaacgtcctgctacatatagccttgctcactttcggactttgacgtatgtgaagagagcacgactaggagccactaatcatatggtttggtacatgagaggatatgcatgtttcactttgcacccaacatgtactgtactcatctagtcatcctactagtattttccatcggtgtccctttctcctgtgatctctcgctttgcacacaaacctcgcaacaaaacggtctcgctgtcgcctttcagcgcttcggcaaaggattggtcggttcatgaggctcgcttgcccatctcctttgctcttcctgtcgcctctctagtctctaatgtgcgattctcgccgaaccagcgacacgttttataggtgtttactcgatcaaggtgatttttttttcacccgatgtaggggcagagtgtgagtgtggttcagtcagcatatctccttttccagcgctttccctgtatttatcaacccaaacaatcgaacaattttcatatgatcgtgtgtacaaagagagacttaaaactctgtttactactctacttgtacttggattcctgtagttcgacttagatctcgatcgaaatgattggctgatcgcttagctcggtgccatattgcagaacggaagacaaaagatggaggccaagaatggcactttggcacgggcaccagttgaactgcgttgcagatttcagatggattgcattgcatcagtcccagctaggcaccacaagactgacatgtaaagcgaaacacaacgacctacccgtacgcaacaggtggctttcagtggatccgagccaagttgagttcggtcgaggtaggatggtgacgtggtgtggatcgatccggcaggacgatcgacagcctctccttttcccgttgaaacttggcaaagctgcgcttggactacgggtactaccagagtactctactctccggcaaagctgaacttgcaggaagaatgtacttagcgccaggagtggtacgtttgtttgcacacacgaaatatgcaagtctgacggcattttcgaccgatcgagtattcgatatttcgagtggctcgctaaatggtgccgcccgttctggtggcgtgcgtcgactcgtctctgaaaatccgttccacccgacttcttccaactcataccgagaaacacatcggcagataaatccaactgaccggttttgtgattattattggtgcaccatctgcgttatattcttgcggcggaccaggtcaatagtcagggcggcgcggcgcggtccttttcgttcttcgctgcctattctttggtgggggtcgcgagcgtgaaagtccgattatctttatcttccgtcgggttgggtggaattttttaggatgggtccagactccagaccatgtgtgattgtgaactgagcgacgaccgctcggactaacttttaaagtttctatatacgcggacagttatgaggattgaggaggacatgattgtagatcaaagtggttaatcacgagaattaggaaaagaaataccgcacgatcgtttctgaaactaggaaaggtagcccgcgcattcgcgcgggcatgtgtattagttttttttaaacagatataacaaattgtgaaagtaagatatactattttttaattcattgtgcattatatcttttttttcttaagaaacttcaagaaatttatatcgccgatgaatgttttatttttaccatcaagtgcttaatttaattggttcacatgcacgcaatttgctatatgcttgcatatgaattaataaatttgttgtatgcatgtattgaagaaatatgcaaatagtggacatggtttttctgaaatatgtgggacccttatggtatttttttaaagaaaaatataggcaatatgagtcttaaaatataaatttaataggaagaaataacttttatcatgatatggaataccacatattttgagctgcttgtatatacaagatgtggagaaacccatgaagctaccacaaagacatgaatgaaatgactttatggatttgttattgaccttcgtctcttgatatgtatcaaaccaaaacataactttatactttacttgtatatataaagagaaacatagaaatgaaaaaaaaagagaaaaatataagtaggacttcaaaaaaaaaattttatagttaaactgattcaatattagcttgtggccggttaaaactctattaaatagatctctaggagcaaaaccattacaaaatctatttccataaagtggccaatgagggtgaggcaaccccgggttcattataaactatcttgttattatttttcatatatatatagatgttagcttaggggagagacggggtcagaggggtcactcctaatctcctgtttatgtacgagagaaaatacatatgtacaatttatccataaaaataaagatatacataagtatgataaaaaagataaatacaaaaaatttacatctgtatgaccgtatgattgaaagaaacaatcacagccaagattaattataaaacaaccagaccggccgaccagccaagattaattccaacgaccatgcaccatctgctcacggctcaagcacgtatatgcaccatggggagggagtttttctggtttttctttttttttttagctgagaagggggaggtagttggtacataagtgggtaccttttattttccttccgaatcgtatatacgttggaatatattggaaggagggcatggctacgtacatgatttgttttcttgagataagaactgatatttaaattaataatttaatggttaaaatattgtgtctacctatttcaatgaaaatagatggtccatttttttctcataatgccacgtggtggcctagtagcatttgtaaaacggaaatgctatataccggtatactgtcgggaagggtatcgacgggatacccttcgtccacctttcccatccaaataggaacgacgctgagcgcctaatctgtgaggaggaggtggccgtcggtgactccggcgcagggaagaagtcccgcttggggagagaaggacgcggccaccggagacgcggccgccggtgacgtggtcgccggatttgccgcctggtgctccatccgcgtggccggctggtgcgccctccgccagcgccccaactccgtcaccggtgacgtggctgtcgatgatgtggtcgccggattgccgccgagagctccagcaccgctgcctgccatccacggcgccgccgttaacgcccaccctcggctccatctgcgtggccggccggtgcgccctccaccggcgccccaactccgtcgcgggccctctccggtcggctccttcgtcgccggccgtcgatcccgctgcgagtccgggccttcatcctatccatctgctactttgggggagcaaagagacaagatggtgtgcaaagaacttgttaacttggtcatggctggctgtggagtgtggtagaatcatcttctacgtggtaagagtcgtatgatacatgataggtatcatattctacgtggtaagaatcgcatgatacctgataagtatcatcttctatgttgtaagaatcgcatgatacttgataggtattatctgattcctctcaagtatcacctgatatatagtagaatcacatgatacctggtaggtatcacctgataccggttagatatcaggacctgaaacatcacaagcatcacccaccacgtggtaagaatcgcatgatacctgataggtatcatttgatacctcgcaagtatcatctgatatgtggtagaaacgcaagtatcacacgatcctactaaagtatcatctttaaaacccataggatcttgttactagacatgatacctaagtagggtcatgtggtactgcataggtaccacacataatgatactttgatgagtatcatgtgatccttctaagatatcatttgtgaaacctgatgataccagacaagatacagataaggatcatgatacctctcaggtatcacatgatcctcccaaagtatcacctatgaaacctggtgaaactggacatgatactaaggaggatcatgctacctcccagatttatgatcctactcgagtatcacttgatacctcgcaactacgcaactatcatcttctatgtggtaagaatcgtatgataccttacaggtatcacctgataagtagctagtatcgggtgatacctatcaggtatcatgcgattctaccatgtatcaggtatcagacgattcctatcacgtatcaggtgatactcgtgaggtatcatgtgatacctatcaggtatcgtgcgatttctacgacgtatcggggtgatacttgtgaggtatcatattcatatgatacctactagataccaggagctaggcgtcgaggtgtcgaggcatcgtcgccggcggccgcgtcctcccccgtccacgctccacactgaacccgaacctcgtcgccggcagccgcatcctcccccgtccatggtccacatcggaactcatcgccgacgaccgcgtcctccgtcgggagctcgtcaccggcagtcacgtccgtcgtccacgcctcagctggcagctgcgtcctccacgctggagctcgtctccggcgccgccgccatcaccacgcaggatcctccgccgtccacgccccacgccggagctcgtcgccggcgtcgtctctgtcaccacgcagatcctccgccgtccatgcgaccatgccccacgccggagctcgccggcggccgcgtcctccatgccggagctcgtcgccggcggccgcgtcctccacgccggaggtcgtcggcgccggccgcggccgcgccaccggcgttagccgcatctgtgctgctcccacggtggcctacactctcgcgtctgagggaagtggacagggagcgatcccgttgggatactatcccaacgcgataccggtatataaagtgtcatgcatgtgtcgacttagaagtatttgtaggaagtttaatgggcttttactatataatagatttatttttaatttatcagatgtgccatgtggtaggttagtagcactgtagaggatgtttaatggagcttattatagattgatctacatgatgtttaatggatctttattacacaatgggtatttgtctatttgatcgattaaatctttagattttgaaacttcaccttaaatatgtagctttgtgaaatttactttttattgtgtatataatgatttgcttgctactcctacaaaatagcgaggagaaagtgagcaagcagagagataagagatcacatatatgttattatattttaataatatttaattgctcattatttgccatgtaaaagataggagtttttttttcaaattatatattcttatatatccaaacatgcccaatatagataaataaaatatattataaaaattacaatcattagttatctaacgtttgattttgtttacatattaaattttgttaggcagaaaattggaagatgaaaggaaggataggagagggagagaccgtatctacgtatatgaggggagaggaggtcacgtacgtacacataaggggacaacccaggaggtggtgggtatggtgggaggtgataattaatggattgggctttaggaattctttttaaatagatctaatggtgaaaaataatgggtccactatgttatgtgaaaattaacggtttggtgttttgtttttttctcagaatttcttggatttccctaatttattagaccgtcacatgtcggcttaggagcgtttataggaagtttaatagacttttagtatataatagatagatagtttggtttgttgcccagatatgctagtattaaaattttggtagcaccgacagtaccagccaaccatttgtgttgttgctgaagcactggagtggagtgcagccgttcgtacaatcggaggatgacatgaaggcggtgtgaaacgacggtcgaaacactgtccctttcagttaccacagttcgcgacgcacacgcgctgcaaatccgccacacgggcacgaccatcgtcgttgtgttcttcgtctgcgattagtcagtgctcgtccgacgtggtcacgtggctgacagagcgaggcgactagccgaatgttttcatcaccctatccctgtggcttgtcgacgatggcaaacattttttttgtttggattagtacaagctttcatttgcttattccagcgtttcaccgggcaacacactctatgtgcatatgtttcggagtgcagccgttcgtattggtaaataccattattatagagagttttgcccggtgatttgtttgcctggcgaaaaaaggtagtataatgttttatcttgagagaaaaagttgtactacatggtagtagtatatctctcggctgcagattgacacgaacattacaacattgagtgaaaaaaaaaacccaacatctacagctacttcctctgcatgaggtgcgtgtgcaaggagagcttgattaaccgctaaagttcaccacagggacatgttcaccagacaccaagttcaccactccacagggacatgttccgcaggacgaacagggtcgcgtggcgcgtcaggcagcgccggagccggggtcgcggctggcggagtgggcggaggaggggacgacgaggatgaggcaggcggcgacgacgagggcgacggcgagcgccaccgcaacagtcacccgcgcgaagggatccacggcgggagcatgaggcgcagccgccgcggcggcggcgcctcgaacgacgcggacgtagcgcgcgagaagcatgttcccgaggactggcgcggtgacggcgcccaagacgaagacgcaaatggcgacgtcgtcgacgaggctccggccggagaggccgagcaggacgcggagcacctcggggccgcccaccacggcgcagccgagggagagaacaatcgccatcgcaacatcagaagccatggcgatcaagaagagcacgcacggaaaagatcaaaacaaaaattcgcaagaataccaaaagagaaagcagagtcctctgaaaagcctctcctctctctctctctctgccttgctcaccctgttcactgttaccagtagatcaggcaagaagtagagaagaacagaggaggaagaggttgtgcactggtgtgtgttgctaggtgtagcatttgctccgggtaatataggcgattcggcacctggtttgggcatggttaggtggtgacgcctcgttccagccaagtcggcacggcgcgacgggtcatctcggcagcgaaagaaaaaggtggattggagtgtggaggccattaaggactaatccgatctttgactgatttgatgtgcctgtccgtgtcactgtgttagatctccctatccatgtggttttgccatcatcttggcttaatccctatgctttcgaatactttgttggcaaaattttggcatggagatatgttcagctataagataatggtgagagtaaagttgatcgtagcaacaagctgaatccgtcgtataatgcgtattctgtcgtttgttttcttactcctcccttactttggacgaaaggcattacgccaagcttttactaaaaagaatacgagttcattacagactaagaaacaaaaaaacgacagaaagtaaagaaaggtagcatgctggggaacaccagctaactcctcccctactttgtctcccctaataacaacaaccaaatcaatatgcccagtgccaagaggttaactacttgaggataagacacggagaaaaataacgacaaggttgtggcttctcagctgaaccccatcgatttgttgactaggctgtgagattttcagccgaattacgtgggccaggtaatagctgccaatatgttggtagaggctgatcctgtgacccccagtacgaacacacacacacacacaaaaagaaatacacgaggagggctacgaactaccaattcatagaagatcgtttaatcataacctgcccagcggtagaaatgcttccgctgaaaaatctgaaatcaaaaggacaagttcggtggataagccgaagcatagcgatggagcccgtagggaaaaggaagatcttccatgatcaggtgggaatctatatttttgaaggcagccaattgcttttggagccgtgagccgtcgactaggaaactgatgcctctgacctgcacatcccacatgtgcacgcgcacgatgggtgtggtgacgacgagcaaatgcgacgttcccctccaacctgataaaaccgggatctgatgggcaggcagaccctacatccggacaggagtaatagagtatccatgccggccattttgccagtttgcaggtatctgagcgcgagcaacaacggcaattgaacacaccacatctgcattttttgctgcaaattaacccagctcctgatcgtggtcctagcaggtggccgtcagggagtgcggttgtccattgacatggaaagccaccaagtcgaggagaccttgacgtgtaccgtcggcgatttctctcgacccgacttttgaaattcttctccgtaaattgtgtgatgtaagggatgacgctggggtagccttgtgcactctcggacagtacgtgagacttcctcgtgtacacacaaacatgtccgcgttgctggcttgctgcctcaactgtcacgattcacgaatgcatcaacttgtgctccccttttttttgcacacacaaacattgccattgcactctttttttgttcgatttcatgttagacgg

SEQ ID NO: 19692 - DNA, 14279 bp, Oryza sativa
caactgaaacttctcatggccaactgtttgttgctcgcccttgatgatctatccatagcaatctgccgttagtcctctgcaataaaacgttggtaaaattgtttgtgcctttgggacgtggcacaacccaacgtgtcgagacctcgcagtgcaaacgcctccatcgtgctcctggaacgggaaagagggggaagctctctaggctagaacctgtccaaaacatatgtgtctgtatatcatctcgcagaaagccagaaacacaggcgttagagcttttgcataagcgtgagaagacacgagacacagagatggcttgcccaacaactcttcttttttttgtttacatttgttcctctccctcgatcggcatggacgcacggtggttacctgttgatacgtcactatcaaagtatatccaaatgctgaagcgtacggaaccaaagagagatccaacagagataacattgaacaaaccaaacacgaatacggggcgccttttttcggattcgtcaagaaaaggaaatcatcctaggatgtactatggtgtatcacaagctctgttcgaattggttcgacacattcaaaattcagctctgatctcagaagatcaatcgctttcgccaattaacatcacatagctgcgagataaacagtagaaaaccacacaggtgatggagtaaaagctgtaaacttgtcgagagacgagagctgagcaatcacacacacactgacaaacacccacagggaagtgaagaacagcctcgtatcaagcgcgggcgaacgtggcggagggaacggtggggacggcgaggaggcaggcagcgacgaggagcgcgacggcgacggccaccgtcagagtcacccgcgcgaagcgctccgtggttgggtcaggggcattgcccgcgacgcggatgaagcggaccaggagcatagccccgagcacggtggcggccgtgacggcgcagatgacgccgacgatgacgacgacgccggcgatggggctgctctgcccggcgaggtccagcaagaggcggagcgcctccggggcgcccaccatggcgcagcccagggagagaacagtggccatcgcaagatcacctgccatggcgatcaacaagaacaaatctctcaagaacaccaaaaagacgagctctcgctggcagcaagaacaagaaatccctttcttctcccggtgctctctctctagctcgccttctctcctcttcgctatgtgtagaacagaggggaaggaagtggatggtcatataagcagcggattggatcgatcactgataggggaaattcggacaagaaatattgggacggggacagatgctagtttggtcagaacctgcggcgtccgaggcgctgtgacgctgtctgctgacgtcatcgtggacgaggacggaaagttcgccatttcctaatggaatggaacgtggagggtcaaatgccaatcgaaaagatccgcagagcacttcggttggttagttcgttactgtagtaacgtcgacggtagtgcacagcaaatcagcaatgttcagaacagtagaaaggtaagtccatacagacactggtcactgctctggtactacactgttcatggtgatgacagactaacgttacacggcgagatgggacgacgcgtcgtacatgtttcgttgccgcttgccgcttgccacactgagagcgacgcccgcgtacacggcgtaccacctgcaactgaacagccgaatcaaacgacgtgctattccttagcattatttcccacatagcttcagttcgcgtcgtgatgagtcgtatactcgtatggtcgctatcaccgtgcttccatcagagccgagaagatcgctctcgaataagatcgttgaaaaggtcaggctctcagggcctatccctgtgttatgttatccgatcttattattcagagttctaacttaagggatgtggaagcttttcttcaacatctcctcttttttatttctctttatgcccttgcccacaatgccacttgagctgagtgcgaggcgagtacgaatcatcatcgtagttccgtttctttccctttgtcatatttgtgtcaaaccaaagaaagtgtccctcggtgtggtggaactgcatgtgatagatactccagtcactaatagtagatgtacatgtacccaatgatagtaaagtacgaagatttccattcatctgtgctgccctttccaaaaggttcctttccctaaaaaaaaatggttcccttccaaaacgtggctggagaatgcacaagcaattcacgagtggtagtgtatttccctccgttattgaggccctgtttagatcctgtcaaaaattttataccatgtcacatcaaaaatttaaatatctgcatgaagtattatatatagacaaaaaaataactaattgtacagattgcgactaatttgcaagacgaatcttttaaacctaattgctccatgatttgacaatgtgatactacagtaaacatttgctaataacggattaattaggcttaataaatttatctcatagtttactgacggattctgtaattagtttttttattagtgcccaaacaccctatacaacaccctatataatatccaatgtgacacgccaaaactttacacccctggatctaaacacctccccccccccaatacgaaacgaacacgaaccaaaaaagcaccactcttcctgattacaccaaagatacctatgtacaagtgccaccgtaggaataagttcactagagatccctcagtttaatagcgaggtttttttaggacccttaaccataaaatcagaaaatgtgtacccctaaactcactcaaaggagctcccatgacagtattgacttaatttttacccggttttgctgatgtggcatcctagtcagcaaaaaataaaaataataaatgtgggacccacatgtaagtgaggaaaaatatggggttaacaatcctagtcaacagtttcctctttttctttttctcttctactctttcggttttatctttgctgcagatggggtggcagcggtgcgcggccggaggcaggcggagcggccgcatcggcgggcgagcgaggctgcggagtgtcggcagcggcaagcggcgggcgagcgcgacggcagcgggcgagtggcgcctctgggtcgggaggtgcagaggggcttgggacatggggtcatggggggggcgagcagcggctccgggatcgggaggagcatcagctgcggcaggcggcggctccgggcgcgggaggagtatgtgaaaatggaatattcagattcattgatctaagttatgtcccatacctatgttttttagacgaagagagtactcactcggttaaaaaataataattttaatttattcttagaattggatttgttttactaaaaaaagtactccattctatgagggaccgaggtgatccactaacttgacgtcgctgctgacatgctgtacaactaggtcccgccgccggcgatatcttgcgtgaaaccgaccctttggaattccgaatttctgatcaatcatccaaaatttcacgtatccaaatgttgtgcgctttcggactttgatgtaccaccagttcccgtacgcgaagagagcaccgctatataagccactaatcacagggtttggtacagcatgtttcactttgaaacggaagcaatataatgtttcactttacacacaacatggtcatgctattctccatcggtatccccttcgccaattcgattgcgatctcgctttgcacacaacttgcaacaaagcaagcagtgatcgacaagggttggtcggtgcacgtccgacgtgggcacattgctgatgcctgacggggcaaagtgaacaagtgggacgtttccggtccatgaggttacgtgcgggcatggtcaatttgggaacccggtccaatagcaaatatatatgtggtcattcgccgtgcttactgttactgaggtttgcctgttcaatctccttcgctcttcctgttgcctcttgtctaatctataaacacagtgacagagctagaaattttctaagcctaaaactcgagtagagctcaactaataagatattagttttctaaagaaaaatatatggtgatttaaaaggattgaggcatatttatggaggcatgtctagggctcaagtccaagctaccctaggtttgtctccgcccctgtataaacgtgtagggtagtgtggttcactcaacacctttctctttccagcatttcccctgtttttagagatcacaaccaatttttatgtgattatgtacaaagagaaacttaaaagtatgtttactacttcaattggattcctgtagctggacttggaacgatcgaaatgattggctgatcgcatagctcggtgccatattgcagaacggaagacagagatggagggcaagaatggcactttggcacacggcacgtgttgaagcgagataggttgcgttgcagatttcagatggattgccattgcatcagtcccaggtccccagccaggcgccacaagactgacatgtaaagcgaagacgcactaacgccacttgtatatacgatcgtctccacgcgcgacctaaacgcaacgactcttcggcacgatcgatcgcgccctgccctggactttctcgcgagctgctgcaaaccgtccttttgtgatggatgtcccgcactctttgaattccctggttggctggtcgtgccagtgggtgatcgtatcctgccgtttgggcgtcgcgagccgcggatcgtcagtaccccgcaccgaagctggctttcagtcggtccgagcaaagttgagttcagtcgaggtaggacgatggtgacattggtgtcatggtgtggatcgatcgatcgacagcctctcctttttcccgttgaaacttggtaggagcacgtcggaaaatacagaacttggttggactagtcgttatttccgtcaaatttgggcttggactacggtagtagtacgtacagtcccagagtaaatctacgtacgttgtcgatctctcagcttgcaggaagaatgtacttagcgccaggtgtagtacttttgcttgcacgcacgaactacgcacttttcacagcatttttcgacccatcgagtatttggtatttcgagtggctcgcgaatggtgtcgcccgttctggtggcgtgaatcgactcgtacgtctctgacaatccgttcacccgacttctcccaactggaatcgagaaactcatcgggagataaatccaactggccagttttcaggcgattactggtgcatctgcattagtatattcttgatgatcaggtcaaggtcaataggcagggcggcgcccgtggggtgggccagggcggcgcggtcccttttgttcttcggtggggatcgcggccacgaaattttaggtcgggttgggtggaattttggaggatgcgtccagcacgtgtgattgtgaactgatcgacgaccggtcggtcaggatggcaatggtaaagttggtaccatatacgcggagaattatgaggattgaggagggttcgttcatcactggaattataggaaaagaaatgccgaacaatcagtttttggtagcaccgatagtaacaggatgaacaatcagtttcagggtttctcaaatagtttggtttattacccagatatgctagtgctactaaatttttggtagcaccgatagtacatgcaggcatccatttgtattgttgctgagtgcagccgttggtatagtcggaggatgccatgatcacaagtatatactcctagaacatacattttttttaaaaaaaaagaatgtctttacgaacaaatgaagtttatccgtttattctccaacgttataactaactcccacgattctaaggggaaaaaagtatgtcaaattgttgagagagcataagtaaactccggtgtgaaatgacggtcgaagcactgtctctttccgctatcacagttcacagatcatcgcacgtcgcacgcgcagcatatccaccacacgggcacgaccatcgtcgttgtgttcttcgtctgcgattagtcagtgctcgtccgacgtggtcacgtggctgacagagcgaggcgactagccgaatgttttcatcaccctatccctaaggattgtgaggattcggatcaggtgcagtcactactgcaactttagcagtatccatcatccaaccatccagcacataagggatggtctagattcgttgcttaatttcccccagcttttcacctactctctgactcgagcaaatgtgttttggagggaaaagtctgagagggaagtaagaattggcgccaattttaccatgggaagcatactttacctcctaccgctgcacatcacacgcaattaatttggatattatctttttttccctagggttctattaatgttgaagatgtcatcttatcttaaaatttcatttgaagaggtcaatagaacttagaaggcatcgtgctgattttggaagcagatgatgatctacttttggatcatgaaaacttttgtaactgggttaatctagcagtagcatagctagttgattttgaaagcttttgtgtcagtggatgcatgacacctaattttagcgaaaatagttagggtatgtttagttcacgaaaagaaaatttttgagtgtcatatcggacgtttgaccagatgtcggaagggttttcggacacgaatgaaaaaactaatttcataactcacctggaaaccgcgagacggatttattaagcctaattaatccgtgattagcatatatgggttactgtagcacttatagctatcatgtactccatccggttccatattatttgacgttttagataaggttgaggccaaacttttataaatttgaccatcaataattttaaaaatatttagtttaaaggacaacatatatagatttgtctttcaaagcaccataataaaagtaaatatatatttatttattttatatattataatagaaaaataaggtcaaaagatatatttttgtataccgtgtcattaaaatgaaaccggagggagtactaattaggctcaaaagattcgtctcgcaatttctatgcaaattgtgcaactactttttttatttatctatatttaatgcgtcatatatgtttccaaagattcgatgtgacatttttggaaaaaatattttgggaactaaacaagggcttaaactcagctcattttgtcaattatgcgtgcaagatattatgaagttcaatataatgaaatgaagtatgtgtctacttttctttaacaatatttgggttttcttaaagttcaagaaaatctattatattattaagacagcttgaaaagaaggcaccacgttcgctgtggaggctagaaattcccacattaatcggagaaaaagaaaaaaaagagtccaagtagaaatacaatctgaaaaataactgaaattcggaattaaaaataaacaatattgaaagaggagaccatataagaacccaatacgtgattaattaaaattcagaataataaataaataaattgctgaaattagaaaaaaagaaaaaaaaagagttcgagtaggaatacaaatttgaaattactaaaagaataatggtctagatttaccgtataaaatataatcatatcaatctaattatagatcatacaatccgcactaggagtccttgtccgtttagaaaaatcaattgcagaactgtatagtatagagttatgattctaaaccaacatacattgccgcacatatatagggtggagataccagtccagcacgcttaggctgcagcaacagaaaaataatatagtgccctcatttcatacaagtccatatattagaacccaatacgagattaattaaaattcaaaataaaaagtaaaataaaatccgaaattagaaataagaaaataaaagaagagttcaacttggaatgcaatttaaaaataacttaaattcgtaataaaaaataaagactatttaaagaatacaccatctggaacccataacgagattaattaaaattccaaataagtaataaaataaattctgaaaatagaataaaacaactaggaatatagtttataaataaaatctatcggaatgaaaaatatgaaaatttcaaaaaaaaatcatctagaacacaacgatgataaatgacaataaatatcgaagaagtaacggggctgtaaaggagtagggtggtgacagccagggtttaccaaaccgccggggccggggttaccgcgccccggcggtaagcacggttaccgcgcggtaactgcggtaaccgtgaaaaccgtacaaaaccatgcaaaattcatcaaaaattcaaattattttttaaatttatttgagtttaaggaggttactgcggtatttatattatcgtacccccgcggtaagcccggtaaccgcgcggttaccggcggtatggtgaaccctggtgacagttgatggaacatctaaaaactattaacaaaaccccaaatagaatcccaatgacaattaaaaggagtgacgacggacatgccgttaagcagcacggtcacgacggttggcgggatttctaaaaaagtaaaaaataaacctcaatgataatcacattcgattttaaaatctcaaatataataaagagtgggaagaagcggggcgagccgtagaggagttcagacggtttggtgggactctataaagtaaaaattgaactcaaatgataattatgttcaatttttaaaatcccaatgacaataaagagaggaagcagcggatgggccgtagagaagtatattgacagcttttaatgggacttctaaaaataaaaaaataaaacccaatgagacaataaactcaaaaaaaactataagatccaatttttaaaggttaaaaggagaattaatataagccatggtagatcgagaaagcaaataaagaaaagggtgacaaaaaaaagcaaggggtagcaactgatgtgatttttataaaagttacaaaattagaaatatggggatgatatggtttggtctttcaaagtcttaaaacaatgaaatatctattgaataaattataaataaaatcatattaaaaatatataattttgtatcggtgctagccgcgcaattgcgcgggccacccagctagttcagatcaaaaggagagaaattgcaggcaaaatctgaactgaagctgttctatgcttgttcaaatagctaaaatgatgcatgacacggttaaatctgggccatccctcgtgtgctggatggctggatgattgggtactgccaaagttatagtcacagtcgtgactgcacctgatccgaatccggattgtggacgatggcaaactatcttattttgtttggattagtacaggctttcatttgcttaaccctgcgtttcaccgggcaacactctggatttgtacatatttcggactgcaccgttcgtattggtaaggaccgttattatcatccggtagtacaagagcaccacgaaacatttacagagttttgcccggtgatctgtttgcctggtgaaaaggtagtcttttatctcgagagaaaaaaaaatacattcatagtatttctctcggctgcagattgacacgaacactacaagtctacaacctatcgacgaatggtaagattgtataggtggaatgacaaaataaaaaaccagcagctgcttcctctgcatgagctgcgtacaaggagagcttgattaaccgctaaaaagaccgcgcaatccagacaccacaaaggcacaaacataacatgtgacctacaccgcgtacgaacgggatagaagccgcggtacgcgcaccggcactacccaccaccgcaccacgtgtcgtcgtgtccacgtcgacggcgcgcggcgcggcgcgtcaggcagcgcagccggggtcgcggccggcggaggggacgacgaggaggcaggcggcgacgatgaagacgacggcgagcgccaccgcgacagtcacccgcgcgaagggatccacggcgggcgcgggggcgcctccaacgccgtccgctttgcccgcggcgcggaagtagcgcgcgagaagcacggtgccgaggactggcgcggtggcggcgcagatgaggaagacgcaaatggcgatgtcggcgacgggactccggccggagaggccgagcagtatgcggagcgcctcggggccgcccgccacggcgcagccaagagagagaacaattgccatcacaagatcagaagccatgggaatcaaaaacggcacgcacggaagggatcaagggaacgggttgagccaaaacaaaaaaaaaatcgcaagaaataccaaagagaaaacagagaaaattctctcctctctctgcctcgctcaccctgttcactgtctagtagaaaaggtagaagtagaagaacagaggaggaggaggaagaaccgaagaacgtttgctccgggtaatatagccgatagatgcgcatttggagctcaggtttcggcacccggtttgggcatggctagttggccgtgcaggacacctcgttccacgtcggcacggtgcgtcggtcatctgggcagcgaaagcgaaaggcgggttggcattcatatttcatttcgtgggtgtggaagcaattacggactacttcgatcttgacggctgattttctctacctgtatgtgttggatctccgtatcggcgtatccatatcccataatattaggccgagtttagttccaaaatttttcttcgaacttctaacttttctatcacatcgaaactttcctacacacataaactttcaacttttccgtcacttcgtttcaattttaaccaaactttcaattttggcgtgaactaaatacacctattagtttactgtatgtttagtttggagaaaagatgaaatgggttagactcatctttattttttatggaattgccccattatctgtttggtcttgctcttttatgatggaggggttgtggcccgcatgtcagtgatagagaggaagtgtgttggattgattcaacagcgactcgtcttggtgttctaggctaagaggggtgacgatcagcagaggctctggggtttagtaggggtgacaattcccctacaggatcgaaagcaggtcgagatttcaacccatataagtgctacagtaacccacatatgctaatgacggattaattaggctcaaaagattcgtcctgcgatttcccggcgagttatgaaattagttttttcattcgtgtccgaaaagcctttccaacatccggtcaaacatccgatgtgatccctaaaaattttcttttcgcgatctaaacaggccgtccatttgtgaagatatcctctgcctttagcttgaaggcagcaggcagcaacatgatgtgaatgcgctgttcaagtctcaacgggggcataaacgctcgtggcatatgccgaaacggcacagcgacacgagctcctttcaatggttacacgagtgatgaatcgcctcgtcacgcctcgccgccgatctgaccgtcctgggacgactaattgtccctttttaaagtagactgatgtgctgattggctagaccagctgcttctcctgttgggtacaagcagaactgccgtcttggtacaatgtacagataccgacgtggcgtgtcttaaattcccctactgtatggcgtggcaataatccacctctggagataaatcacgacgggaaaattatgcggcaaaatgttcagtccaggagagaacaatacttccttcatccttcaaaaaaacaacttagtactataaatttaagcatatctatttccaaattcattgcaatagaatgtattacatctaattccagttagttttaccaaactccgcttttggtgtcccttttttctttgaaggaaggcccttttatttatgcaaacatgcacatggcgacctgaaactattgaaaatgcattttcagttcgcttttactatgagcgagatagcgaccgtctgtccaattgtttctctgggcgtaccgcgtacgccccccactaccaccgttctctgacgcagttggtgagatggatggacccatgctaccagtggtagccgtcctcctctgcaacatggaacaaatcgttgctgaaatcgtgcctttgagacgtgccagtgccaagcttatcgacacctcgctgctcaaacacttccatcctgatctcatctgcacaatcagccaccgcaacgagagagtcagagatcgaggccgagaagctcactaggctagaaccggatactgacctgtccagaacgtacgtgtcggggtacaaaatttttagagtaccatacgatcgatataagtgtttgacggcacgtgcatgagacggtttgtccaacaacccttttgttctagtataacctttgttcctctgatcctctccctcaagctggttaactggtgatacgtcacaatcaaatcggcataactaaatgcgcgaaacatatggaccaaaaagagagaatccgaaactccaaacccaacagagatagtaacataaagatatgtgcatatggcattagggaaagaactaaaacagacgcatcaggagatgaaatcatccagggacattccgtgatgaatatgaatatctccagtttcactgtctccgatatgttcacccaagtccccaaatcggaccggcaagaaagatcacaaaatcctataactctgttccaattgattgagcttattcaagaatcatatcaagtgatctcagaatatcactcacattcgcaaattaacatcacaagactaccacagaaaaacagcaaaaaaaaaaacacacacacacacagatgatggagccgtagtaaaacgtcgagtagtaccactgtaccaggctaccagcaccggggctcgccgcgcacggcgcaccacaggtcggcggcgcgggcagcttctcgacttctcgtagttgcagccgcgcccgaatccgccgggcggccgagcgcgcgccccccgcgcgtcaggcggagctggcgaacttgtcggcggcgggggcggcgaggaggcagccggcgacgaggaagatggcagcgaaggccaccgtcagggtcacccgcgcgaagcgctccgtggcccggtcaggagcgtcgcccgcgacgcggatgaagcgcaccaggagcatggcgccgagcacggcggaggtgacggcgcagatggcgccgacgatgatggcgacgtcggcggcggggttcttcccggcgacgtcctgcaacaggcggagcgcctccgggccgcccagcaccgcggcggccagcgcgaaaacaatggccgtcacaatatcacctgccatgacggggatcaagaaatggcgcggaagagaagaggaatcgcacgtaggtaaggaaggaagaagatgagctctcgctgaagccccccctttcttccccttttcggctttgttttttcgtcgcccacttgccgctttgcacaagattttaaaagcgatggccgtgtaccgcgtactccgcgtaccgctggcacgatcccatgtaggagtagctcctgttgtttttctcccatgtgtgctcctgttcggggtcgtgatgcttcaggttcgctgtgcccgtttttttcatcagaaactgaaaaggtcgtcaggctcttaggggcctaccgaaagttcaaggtgttatgtgggggtagctttcagagtttttattaagggatgtggacgtttagatgaacatgtccaaaacttttatgttttgttatttatctttatttattatgcccttgccacataagctaatcgcgagacgggtatgtataatcatcagtgtttcaccccggccttcaccagccaccgcgtcacaaacacagtcacacgctcgagggaggcgcacaggaccatattgggcttaattgggtcctatcttgcctgttttgggccacactgggttgtgctgggtcgaatagttaattttagggtgaccctcaaatgtgatcgaaatctaaaccatgaccctaaactacaaaaccggatatctcgacccccaaactcccaaaaacggtgcaatttgactccctgggcggttttgggaggcggttttgctgacgtggcgccacgtggcgtctacgtggcaatattgaccgagtctttgctacatgtggcgttgacgtggcacctacgtggcagtagaaataaaaaaatatgcgtgggacccgtttgtcattcacacataaaaaaattgtggggcccactgacatgt

SEQ ID NO: 19693 - DNA, 9528 bp, Oryza sativa
catgtcagtgggccccacattttttatgtgtgtgaatgacaaacgggtcccacgcatattttttatttctaccgccacgtaggtgccacgtcaacgccacgtgtaacaacaactcggtcaatattgccacgtaggcgccacgtcagcaaaaccgcctcccaaaaccgtccagggagtcaaattgcaccggttttaggagtttgggggtcgagatatccggttttgtagtttagggtcatggtttagatttcgatcacttttgagggtcatgaagtgaacttattcctttcagggtaacaccgagctacggcccattagttgttcatgagctgaattagcctgaacgtatatatccatacacgtcaacggtttttgagaaagattaaggacgttctaaccgggcaaacacttcgtgcactggaaaaccgtagacgtctttgcactggaaacacttcgtgcacttattacgtggtggttcatcatcaacaatcttcgtgatcccataacaaaaagggtcacacggagtggaattcacttagtttgcgcattttggctgtccgtctgcaacataatattgccatcacaacttttcttttgtttggattgacgcatttcacgatttcccaaatcatggaatttgactcagcttgacaatcaaagtggctgtttttgtggtttcgtgctgcaatcactctacaacaatcgcattgtaccaactagcaacaactctcacaatatatgacacccgacggaacaagattctctaacataccttaccctgattttgtgtcactgacatgtgggcctatagtgagatagacccacatgtaagtgacacaaagtcacctgacgttatgtcagaggatccacatccccccccacccccaaggccgccatgacacgctcaatattttacaactgccagtctgttactgggagtacttaacaaaaccggtcggtgctctgctcccaaatccccaaaagtccacatggagaacatacaaaatacaggtatatgcctatctagcaaaagaaacaggagaactagtgaacacaagaaagaactcgtgcattttcatactataaatactaaacaagatgttcaggtagggaataacgcacgaacaactgtcgtaatgtcgaccacttggaagacagaggaaagaaaaaaatgtgagccaagcggatgaaataaaaaaaaggtgagtatgagtttctgaaacttcactgttaattatctcacctgaatacagaacgaatcaacaattaaaacatcacaatagctcacgcagtcacgttccccatctgcacgagctgagcatgagtattagcattacaggactacactctgcactgcacgactgcgatgacagtacggtgattccagactccaggtagtacacggtggccgcgtcgcgggctcgcggcgcgggaaccttcacgtgcagccgccgccgggattggcaccgtccgagataatcttggcggcgcgctccgtggccggtagtggggcagcggccgcggccgcggccgccgcattttgcgccttgcggaagaagagggcgagaagcgtggtgccgacgacggcggcggtggcgacgccggtgggcgcgtggatgattgggttcttcaaggcgaaggaggtgaagaggtggtgcgcgcggaggccgccgaccgcgacgcaagagccgaggaggatgcatacggcggcgagggacaccgtcagggtcgtcacggcggcgcgccccgcgtccgtcaccgcgccggaggcattgcgcgccctgcggagatgcgcgaccccgcggacgcgcgcggcgctggcgcctacgacgaaggcgggaacggcgagcgcgaaaagaccgacgacgacgttcccggactggaacagcggcaggacgagcagggacgcggagacgaggagcgctaccgccatggacaccgccagcgtcatcttggctaagaggtcagcggccgccgccgccgcacctcttgcgccgcgcggcgtgcggtagaagcacgcaagaagcatggtgccgagcgccggcgcggcgagcgcggcgatgacgaagacgacgatgccgatgtcgacgagggggctccggccggcgaaggtgagcaagaggcggagcgcctcgggcccgcccagcgcgccgccgcccatcgccagaacgatgatcatcggaacaacaccggccatcgcggctgcggaattcgatatcaagcacacttgtgtgttccttcccacctccctctgtattactctgtggcgcaaaggatcggcgtggcggcaattcgtaggcgggacacggacaggcgcagccgtctcggaggggtcgggccgtcgcgtgcggaggtggaaccatgtgatcggtgatgttgccggatccgataatcgatagattccaaaccagattgggcccaggagaggactggataaagcgggctacaccggccggtggtagctatgacggagacgtgcggtgggttctctcttgctaagagcaagtataacagtgagctataagtctactataaacttatgtgaagagagataacaaaatatcaaggatgttggctctcatgcaagaactagcttaacacaaacttatatgtaaatacattaaatgcacaggtgagagatagagagaggagaagaaaattgtagccaaccttatagctaatctattatatatgttggctttaagatgggctaatagtaggaagtgagctctactattatccttgctctaatacggagtaacatttaaggtttgacgcgttcaaggtatatattgacatgcaaggtttcgcgcgttgaaggaaaaaaaaatgtctaggtcaaatattatgatagaaaatttatcttctattgaaggctagtattaagaggttcccttgactttgtgcatgagcaaccctgcatatacaggtcagtgcggccggtggcggaggtatgttgatggcagtggcacttattaatctatattttacatgtaaattcattttacatgtaaatccattgaattttataaaaatgatctcactaaaatataaaccaatgctattcgatcccacagggtaaaatttatagctccgccactgcctgaggccttgcttggaactcacggaggaagaacgagtcgcgcagcaaaggcgtcggaaagcgcaaatgtgccaaatctgctctccacttttttccttctggaagccgaccattctgtttctgtggcatgcatgcttatcacttccgaaggggtagttctccgcactcgtagaatagtcgcatccacgtcacggtcatatttgccataatggacgagtaggttatttgtttatatctttaaggtggaattagtcgattaaaaaaaaactctctttagtaaaaaaaaaaactctcaatgtccacacaaggagcctgactgaactaatagagtagtacgtacgttccactacaagtagtagtgctagaaaattagagcatccgccagtacagagttcttaaattttaatcagtatatttgacgagaaaggaaagagataacagccagcgcgcagaaaaaagatcgacctcagctaacatcagatcctagggaataatggaaatgtggaatactcatatcacccatcagctacaggattaaatcttttggtttggacatttctatcggagggtatcgatagacgaaattttcaaaatttaaaaatttcagtgaataataatatatggggaggggggagggttccgatatgaccgaaatttcgtactgaaattttgaacctgatcagatatcagtgtaccatatgtcattctcacacacacagcacacatggctcgtgagtcgtgacacggtgctgctgttccaatctgactcccgctatggcctctacggatgcagaagcagtcaagcaggcagcagccgccagtcactacgccgactaggccacgacaacagcgactggggcttgaaatacgggcagatagattgactgcgacgtcgcccatcggcccatgcacgtacagaggcgtcaccgccgtcacttttgggccctacgtgcggccgcgctgtcggcccgtgaggccgtgatagcaggctatcctcggccggcgacgtttaacgcacaaatcgtaaggtcattttgtggtggaataagtccatttttcctccctcaactcatggccgtgtatgaatagcatccctcaaccgcaaaaccgggtataacccatcccccaactccgaaaaccgttacaaatcaactccccggacggttttggaggtggttttatcctacatggcaattgacttgcttacgtggcagttgacttgctgagtcatcaaatgggacctacatgtcagcagtctccacctcatctcatcttctccctcatctgttcccctttctctttcatatcttcctcctctcaccttctgaccttctatcagcagggcggcgacgacggcgcacgggggacgagctcgtcggctggccgcgccgcgcgcgggggagcggctcggctcgagcacgcagaggaggcgggagggcgccggggcatcatctgagaggaggtcgtgaggacgaggcagcccctccaagtcgccggccgtccgcgcgtgtggaggatctcgccggcagtcctcgcgcgggaaggagctcgccggccgtccgcgcgcggggaggatctcgccggccgtcctcgcgcgaggaggatctcgtcggccggccgcgcacggggcaggagctcgccggccgtccaagaaggaagccactggggatgtcgccgagcgtcgggttgtactgcagcatgaggacggagaggctccggcacggggacgacggcggcattgcccgcagctgtgcatggcggacacccgctccgcgtcgcgcgcacgttagaagaactccgctagcttgtttgctgtttgctcgtgttcttcgacgatttcgtggtctctgatttgttctgttcgttcccctttcttgtttcacgtgattgccggcgtcttctctgaattcggcaaccaccatgtgctacttgtcttgccgttgatcttgctgctcgattatatcgcctcgcctccgcttcttgatttttttcctttcccgtttcttgaagggaatcatggtgagggagaagagatgagttgaagactgctgacgtgtgggtcctgcttgatgactcagcaagtcaactgccacgtaagcaagtcaattgccatgtaggacaaaaccgcctccaaaactgcttggggagttgatttgcaacggttttcagagttgggggataggttatatccggttttgtggttgagggatactattcatacacggccatgagttgagggaggtaaactggacttattccttttgtggtgctagaaggcccaagtttgggtttgatcgggaccgtgttggtttggcttgggtcgacgaattaagggcggtgtttggatctggggtatataggttgtcgtatgggatattcgggtactaataaaaaaactaattacagaatctgtcagtaaaccgtgagatgaatttattaagtctaattaatccattattaacaaatgtttactgtagcaccacactgtcaaatcatggagcaattagactcaaaagattcgtctcacaaattaatcgcaatttgtgtaattagttatttttagtatatatttaatactttatacagatgttaaaacgttcgatgtgacggggtgtaaatttttttctgtgggatctgaacaaggcctaacaacgccaaagtcctttagaaaggacatgagttttggttaggcacggtcgccgaagctcactaggccggtgggctgtggcgatctgcccccataaatccattgcatatcggtccagtatactgtatacagaggtttttaggagctgtttcgattgatgatattttcaaccataacattatttagtaaaattaataattacgtggttatatttagttactaaatattataaatgtgtatggaattttggctatattattaagccaatcttactaaaattttgacaatattattaatttgccaaaattttgctattgttaaattttgataaggtttactttagcaacaatctgaatgaacccttaaaatgtaaatacgtcaccatcaaacgtactctctccgtccaaaaaacaacctataaaggaatatgatctctcctaatataggctgtatttagtttcttccaaagttggaagtttgggttgaaattgatatgatgtgactgaaaagttgtgtgtgtacgacaggttgatgtgatggaaaaagttagaagtttggatctaaacacagccatagtaatctggacaaactataaagggtcacatctttttttttctttttttttacggagaagtaagcaacgatttcttgccgccggccgacaccaacacctcccatgggaatcagctggacagaaatttcccctggcgaagcttttgcgaaaatcaacagagctaatttcgcaaagaattacgggagatttttttctctcgagcaagctacaacgaaacttcccggaagatgcatcaaggtacgctttgcttgcatgtcccgcattttgtgttgcttcgcggaaattctgcttgttgaattatttgtcgatcggttggcacattccattttggcttttgcctgtatcttgccgccgtgaccgatcgcggaaagtcaagatgaaaaaacggcgttcgcatgaacgtgtgctaccttgtttcctataaaatggtttgcacaccatatagacgtctatatcagtgtatgcacaacctttgagcaccgggtcttctgtagaatttctacacacaaacacctgggcaaactcttgagagagagagagagagagcgtgtgttcatgcaatggcaccggtgatcaagctgcaggcgtatggaaagagaggaaatgagcaagcgtttatggactctggagctcaggatgcagtgctacaggaaagctaggagaaatcggagatatatatggcagttgctggagtgggagatcgacgcactggaaaggttacagagaggcttacagtttgctcggcaaaccggaggtgatcgctgttagtcggagtggccatggtcggagtactcctagtcctagaggtagcaggttgatcgagttccagcttcagcgaagcgtatgcagtgcaaaaacagatcagcggactgcttcacagcaaggaaatagagaaggagtggatcagcagtgacgaatgggtggcactgaattgagggattccatggaagatggagcagtctccagcaatgaaattccctttcatctttacagatgaaagtaacagagcattggttggacagagagcctctctcaactggtcatggagactctcgtatggaggtaatggactaatggccaggacgcctgattctgtctacttccaatcttccaggaaggattctgtctatttttccggggcagttcaagcaggaagagaaacgggctaaattcaagaggaacttacaaaaactagcaggtaagcgttaatatgttactttagtccccgtttcttttttttttcattttccagctatttttattgttcgggacctgtttttacctagcttaccttagccttactctcccttctcctcgtgtaaaaccctccctcgtgaccacttcggaatatcgccgttgtacaatattttctctcttgctaatatattgacatgcaagttttcgcgcgttcagggaaaaaaatgtctaggacaaacatatatagcacacccttaccgtaccgaagtagtaagtattacatgcgggcggccttaggctaaaacatgtcattccaaatattatgttagaaaatttatcttttattgaaagctagtactaagaggttcagaactaagttgaacttgaggttagtttgtggatacgggaccatagaagaatgttggatttgagaaaacatctatctaaacctatgctaattggacccgaaagctcccacatttttttaaaaaaaattctagttaatggtataagtttatgggaaatctaaatcgaaaacgctctcagttttgtattatcgcgcgactcgtccgacaaccatccatccgtgtcttggtgctatcggagcgacatgcttgcttccactgcaatggcatcaaagcgagaaatctatgcaccaccatccatcaaaactaaagattggttacactagccaattctttttttaacaaaacctttgatggcttatgcattttaaaccacattatttttcactttcgtttgaaccatcatcctctactcaaaatagatgataaaatgagtccaatactaaatatattcaaacatttaaagtaatttacttaaatcgtagaagtaacttagcttcgcaatagaagtaactacctataaagcattgaaagtagttatcttgaccaattcgttgatgatggctgagatacgaacacatggatattgtcctgaccaagatagagaaacgagaccactaaccagaaaaataggaccagatgatctgctagttgtcatatcaatttacgtacatgctacagaggctaacaacactagtatattttcttaccatagaatctttgattacctatatttctatgacggtatattatttttaacatacgtttgaaccattatgctctacttaaaaaatgtggcaaaatgagtctaatattgaatatattcaaattatttttatttcgtagctactctagaagtgtagttagtgtgtagttacttctaacgccatgaaaagttaattttctcaagctgtgtacttacttctaatactttgaagttatttctattttatttttctatagttactttcctctaggagtgtatttacttctaatattatgaagagttacttctatttctttaaaatttacttctctccagtagtgtaattacttttaatatcgtgaagagttactttcatatatgacgcaagattttatttttagaaaaataaaatagagattagtttagataaagaatatatgtatttacttgaaaatcttctctaactttgtttgtggatttactccacatagtttcttatttcaactcactcacactcacagtgtaattacttctagtgctataaagagttacttctattgcatagttaagttacttttgcaatttaaataaattactttagaatatattcaacattgaacttgttttgtcatatattttgagcagagtacaacagtgaaaaagatcttaaaaataatatatggtttgaaagatataagacatcaaaagaggtttcaaagaaagatacactaattaatgaccgatcgatataagtgtttattgctatttctatatggtaaaggaggatttatatgtcacgtgggatgaagtagtcgctcgtgcactgtgcagtgtaatcgtgtcccaagtttaacgttgtgggccacatttaaaactcacgtaatccgtgtcatgtttatcacaacatagtgggccatttttaaagcccatctaaga

SEQ ID NO: 19694 - DNA, 4419 bp, Oryza sativa
  unsure (1)..(4419): unsure at all n locations
cgagtaaagggggataatataggctaagcactattaaaccgcggcaaatgacggcatcgaggtttaatcggtcacatgacagtcagtacgtttactagctagccgttcgcggtaaacagtaccattccgttttgatttctaatcttttcgcccatcaaaagatgagatagtgttgctacacgaacaatttttcttcagactcacaagtcaatggtgtggagggtttctgggcaagatgaaagaaacttcgcggctacatgcacgcattttgttttctgaatatgtaaaatgtcattaactcaacatcagctagtaccgtagtttgtaaaattgtttggcaagaatgtaccaggtattttctctctttacagtgggtgcaaattttaaactctcgatgggatactcactcgttgtttgtatattatcgaaatagttatgattttttttaaaaaaaaatagaagatagattaatatgcgatatatcacttcacaaatatgcaaattaaaattcaccatgtacaagttgcaaaaaaacaaattaaagtattgctagttcacgtatatttatagtcaaacatttttcgttgcaacatgtaaggccccctttgattcaaatgaaatttataggaattttagaggattttatttctattagaatttttcatatatagccctttgaatcaaaggaatggatcttatggaatcctatgaaattcctatgaattacctaatgccatgcaagttttggaggaattctaacatgagataaaatctcttgaaaactttcttttgagtctttatctttcatctaattcctgtgtttttcctgtgatccaatcaaacgaccattcctatgttttacagtcctctgttttacagttacattcctatcaaaatcttgcgtttttcctattcctatgttttcttattcatgcgattcaaaggggtcctaaaagtttaatttgatcttctatgtttatggagtaatatattacatattaatctatatagttaaaatttttcataaacatttgaatattatggatatccctttagcaaagatcattaatttcttcaaacgagtcgacccacataatcctattgaaattttatcagcgttgttttaattacgacgattgtatgtacaagctgaattaaccagtttgtgcgcctcaagacactccaaactctacaggccgcgcattagtacgaagaaatttccgtagcgttcggctaattcgatcgggcctccgcgttgtgaggtctttaacgcgttgtggcacatccacaccgtgccgcgcgtacgtacgtcggaacgtgaataaggccatgtttacttcgtgaaaagaaaatttcatgtgtcacattggacgttggacgtttggtcggatgtcggaaagagtttgtgacacgaatgaaaaaactactccctccgtctcaatatataacaccctacaataggatgaggcccatcctagaacaacaaatctggatagtccagattcgttgtctcatgtgacagtccagattcgttgtctcatgttgctatatattgagacgaatggagtaattttataactcatctggaaaccgtgagacgaatcttttaagcctaattaatgtgccattaatacgtatgggttactgtagcacttatgactaatcatggactaattaaattcaaaagatttgtatcgtgatttttttttctaactgtgcaattagttcttatttttatctatatttaatgctctatgcatgtgtttaaatatttgatgtgacttttttagaaaataaaaattgaaaactaaaccgggcctaagtgatccaccgatcgagctgccggctgcgtgtgcgcgacgcgagcagcggccagcagtgaacagaatacgctgaatacgctgaataatcgtactgtcgctagagccgatcgatggactgccggtgcgtgcgcgctagataaaacgtgccgtgcgagtgttgcgggcgcgagcgccgtagattcctgtggcttggctggctggctgtctgcgccgaacgtgaaaattaaaggctttcacttaatagctcgttactacggtatgtttacttcacatcaaacttcttcccaactcctaactttccatcacatcacatcacatctaaaactttcctacacacataaactcctaacttttttttccaaactatcaattttttccaaacttctccccaatatcaggaactaaacacaccctgcatactctctctagctagttcacgacactattacattctctcagacagcacagctagctagccaggtagtaatggagaaattaatggcttcatcttttcgcttatgtttatactaattagccaaaatttacattttcaacattaaatttgaagctaattttggggtttttttatcgaaatttatttttcagtttttgcttttaggttgctaagaacacgtatataaaagttttattaacaccttacttctcatatgtaaatatgccgtttggtttattccaggaatcagcttcaattttcgctgcgtctctactttgagtaatctgtctgcagcttcggaaacttcaaacgcgatttgtaccaaccaaccacgctcaccccagcccagctcgcttgaccgctaacgccgaggaatttggcatacagcgccatcaacgagtggctcggtgcggaggcgtgcggcgtcatggtcgcccggtcgtcgtcacgcagcagcacatccacttcgtgtctccgaggctcggacaggtcggtactgggcggtaggtccaatgtgcccaacttttcaactgcttttctaccagcccactccaatcagaccacacttgttcaggtcaatcaatgccccatgcaaagactgccctgagaaatgagactttttaagggggtgtttgcgagctctcaaaaacataagttcttagggtaaggacacttttatgagagggactaaagtttagtctctagttgctaaactttagcccctctcttaaaaacataagtccttagggtagtgacttattcttttgtgagagggactaaagtttagttcaattgttcaatgcttccatccattgttaccttcgcaacaaaatctaagatcctcctgcgatgctatcttaatttggaagtagtggtggaatcattgccgcatatgtacagtaacgattatttttaagatttataatcttaaaataagtctcatcccatcctaaattataatattttaggatggagggagtaattcatagcacagttccacagtaaaaaaaaattgtgtacctgaccctcgtaatactggctggctagtaaaagttttttgtgtgctatggttatataaaataagttaacgttggaaagtccaatttgttctcgcactatctactggaaagtccaattctcttcaactaacttgactggacttgatcggtagtccctccatcccataatataagtattttgatattttacttgcatcattcgtcttattaaaaaaattagaattattatttattttatttgtgatttactttattattcacagtacttttagcacaacttttattttttatatttgcataaattttttaaataagacgagtggtcaaacgttagaagaaaaagtaaaaatctacagtatctataacagattttgtgttggagctgctgccgtaccgatcaggcccactatataggccacacatgcgcccaccacataaaatcgccgcaaggttgaaaagtgtgggctaaaaatatttgtactccctccgtttcgaaatgtctgacgccgttgactttttatcacatgtttgaccgttcgtcttattcaaaaaatttaagtaattattaattctttttcgatcatttgattcattgttaaaaatatttttatgtaggcatataattttacatatctcataaaagttttttgaataagangaacggtcaaacatatgctaaaaagtcaacggtgtcaaacattttgaaacggagggagtagtatggattattgtagtactccacgaaagaagtaggagtacgagtttatagcttttaaaaacaaaaaggggaaagtgacaagaaaaatctacttccatgtgtattggtagctctattccagatgctggcggaacccgacaaggacataaagaaacaaaatctaactttttcaaacaataaagaaagggactagctaaaaaactgtccaatgtttgaggagaaaactttcaaatctaactatagtatataatttcactagatctatactatactaataataacttatatatatgtattaaaataatatatgcaactttatatgtaatttatatagagataacaatatagttatagtgtagttacactataattacattgtaactatagttatatattattgcatgt

SEQ ID NO: 19695 - DNA, 7068 bp, Oryza sativa
cataaacatgcaatgatgggactagcttgtgaaaagagggtttagatctaatagcaaaatatctcagtacaaatcttaaagcagaatcgacggctaaaaaatttgacagttttcactcaaaaaaaactgtcgacagtcctctagcaattccgataaagaaaacaaagttttcacaaaagatccagaaaaagcaataattttccgtgaacagaaaaataacaagctccatcatatcgtctcggatttgatactgcaggtctgcagcttattgccgattgaaaccgggaagaaaaggaaatgaaattaagatgcatgtaacagtggccgtatataataatcgagtagaattgctagtatttccaatttccatcaaaatccaatagctttatagacctgcacaaacgaaagatacaagcacgcccaactgcctcgatcaacgcctgacggcgacgaccggaggaggagcgatcagatagatctcacttccccctcacctactcgattccgcctgcgcgagcggaaaagaaaggaaggatggctcggcgaggagagctgtcacggcggcggcggcgagcgttgcggtggcgacggcgaagaagccaccgtgccccgctccaccagcggcgccgagcttgccgacatatgcgaacagaaggagacaagtgagctcgacagagatcagaatggtaaagaagagagcacctgcggcgagttgggcgccacgatccagcgacggcgaggtcgcgctcgacgcggcgaggaaggattcgagcgactggagggccccaagcaagatcgagaaggccgagatgacgatcggtggcacgcgcgaagccatgatagagctgtgactggtgaagcgaacggaaaacgagagatttgggcggagatgtgtcagctttcgtgcattttatagaaaaaaaataatgatatgattcattcgtcccagaatataatgagttttaaagttagacacggttattaaagaaagaggtaaaaaaaatttagataataaagaaaatatgtagaattaaatggtgtaagattgtgattagttgagaagtaaaggtagatataaaaattgaatggtgaaggatcataattattttaaaaagaaatattggtgaagaagttattgatatattttggaaccgaaggattataggagaatcttattcgatgatgagcatgatgacgcgattagaaaactggaaagagcacgaacagcggaatatttaattgatttcctagtacttgtactaaaaacacagatgcagctttgtactattgttctttctacttttgatgcagatattacttgtgattccgacctcgtgatagacttttccaccaaccgcaacttgagcctttttcgagttttttttttacgaccagaaaaagatattcaagagaaagtcttttggctttctcaacgcgaggggcaaatccagcggttgcatagaagatgctaattaattcgtcagattcaccttcacagtgttaaacctgttcttccttcttttattttcctatctaacctgttacctgtcgacctgtacgtgcaaattcaaggtctgaacttcacaatggattaatggaatttctcgacgcgagatcacagcgaaataaagaaggaaacctttcatgcatccatccgaccatccccttggatcatacctccactctctcacttttgcaaggcatccacaaccgaacgaattcatcgactttttgcacacagtaaagtcattcgtatcgaccttttgccgattattataaatgttcaaaccgggcttaggttcactcattaaaacgaacgaacagtaaaggtgtggacatgcataattaaaatccagtatacaattcggcctaaagatgatcatgctttgccacaaaaatgaaaaggagtaaacgcacttccgttacaacaacaagaccatacaactccttgtaacgagaaatcaccatgtatgatatgtttgaagtttgctataggtcacaggcactcaggcagagctccgatttcctagttatcgctcctcacgtccagttcgttcccctcctccctgaacttcgtttgtgtcgtcgccggccagcctccacagaaaattccaccaccaccagagctttccgcgaaacttcgccagtgcaggtgtcggcgtccaattttcaacgaaggcagcttcgacgaaacttcgggcgtcgattcttaagccattaaatttgtatttggtgcttatttttcaacgatttctccgtagatgtcaccatgccatgccatttttcccttgtaaaaaatgaatcgtcttgccgttcacacagatatataaatcgtgcaatcacttttgatcatgcatatatatgttgttccgtcgattcatatgcattcttggtctgatgcatttgcattctttgcaacgcagtgccttcgccgagatagcttgccattgtagaagatagccctggtgcgttgtagttttggatggccgcggtgatggaggcagaggcggtgatggatgccactgatcgaattgagcgaataaattttgatctttcactagttgagacctaatttctcggcattggttttctcggttcggtcttattctgcccacccctacctctctcaccttctgttcgtcgccgccagatctggtgggtcacgcctcctacccctccctaccttgccaccaactccgcccctccgctccactgactccgccccaacgcgttgttgagtccatcgcctccagcctctcctcaccgcgccgccgagagtgaaagggaaaaataccctgcgggagccgggaccacaagaaggaggcgtggccacggcatcgctcaacacggagccatgggttgtggatcggggaggagtcgaggagcgcagggagacacgtcttctctgctcacagatacgccgtgtctctctgcttattgaaaagtgacagcaaccgaacgacgtcgctagggctacgagccgaagacatgcgttgtacatggccttagggcatcagcaatcaaagacactctatgggtgccctcactaaccgaagccactccatagggcacccatcttgcaatggaggatacttgtagctaggttcttcacaatcttaggcaacaggataagactacttcagcccacaacgggttgcttcaccccatatagccacaggtattatttccctccctacccctagcctcttctctctctcatttactcagcccacccatcaccactagccattccctatttccccatttctccccagtccccatcctcctctgcgtgttcgtcttctccgcccgcgcgttcatcctctgccgtggccgccccaccgccgtcgtcgccaaccttcccgcagcgagcagcgcacggggggcggtggacaggtctggtcgggggcgccgtcggcgcccgtcgcgccgtcgccagcgccgcccatcacatcgtcgcgaaccttcccgccgccgccgtcgccaaccttcccgcagcgagcggcgcacggggagcggtggccagatctggtcgggggcgccgtcgccgccgtcgcagggtcatcgccgtcgtctccatcgcgaggtcgtcgccgggtcatggctgtcgtctccgtcgcggggtttacgccgccgccatgccccacctctccagctctgcccgccgccgcgtgtcgctcgaggtggcttccccaccggagcttctagaagcttctctaggcgaagcctcgatgtccatgggagggagcggaagtggaaggggaaatatgggagaggggtgtccaggcgctgcggcgaggggtggaaggggaaatttgggggagggagcagtgtccacgggacacacgcctagccaacacgcgccctcgtgccgtgtctcagcgaaaagtgagcgaggggcacgtccctctgcgagcaaacgcgcacccacgctgggagacggctcagaaacgggacgccgacgccgtgagcagggatacgggtctgagataccattgctgatgctcctcacggtcacagtgctaaacctttttttcgtccttttcttttcctaatcggtccaccaggcaccagtacgtgctccagctgagtactgactgcacactgtgtgacattgaaatcttgatttaggccttatttagtttttttttttcaaaaacatcacatcaaatttttagatacatacatagaagcattaaatatagataaaaaataattacacaatttgcatgaaaatcgtgagacgaatcttttgagcctaattagtctatgattagtaataagtgctacattaactcacatatgtaaactgtttacagacctaattaataaattcatctcacggtttatagacgagttatgaaattagtttttttattcatgtccgaaaacctctttccaacatccggtcaaactaccgatttaccactcaatttttttttttcgcgacctaaacacacccttacatagaattcaaaattgtctcaactttccaatggaatttttcgctgacacatgatcacccacctgcgtgtcaagatgccagtgcccactgcccagtgggtgtccaccatccaacatccatgcatccatatccttctcgtatctttatttgctgtgtcacggttgctagggtttcataggcgatccaattcatcgaactagttagcatcttggcggcctcgtttagttctaaactttttcttcgaacttttaactttttcatcacatcaaaatttttctacacacatagacttcccaacacttttccatcacatcattccaattccaattttaacgtgaactaaacacaccccttgtgtgatttacatcgaataattgctgattcctgtgttcagacatgacttacatttatatataaaaaaacctcttcaaaatgaacagtaaagatatggttatgattaattagatatataccgaattcggcctaaacatacataagagcatcctcaatatgtaaaaaagataaccttaaacaatagatgcaacactttaaatattgagtattaatatacttaatactcatactcatactaatactcaatatgcgaaagagcctgtaattggttataagagcttcagtagcacctgaggtcctgggttcgactttccatgggagcgctgtgtaatttgaaaaaaatatctatctttatatactaaaagtccattaaatttcctataaacgctctcatgccaccacgtgggattcctacaaacgctcctagattgtcatgtgacattttaataaattagaaaaaatactaaaaattataagaagaagaaaaataaatctaaccttcgattgtcatttaaattggtggacccattatttttaatgataagatgttatctctaacacataaaaacaaactccgatcccttccatcttactatgggcacggccaccctccatcctctcctcttttttctccgctgtcggtaaaatcgaaatcatcgtataatgatgtggcaccagttgaccggcatggtgctcccatctgtacaagagatgtatcagctactactcacgttaattcagtgatggcaccacagcttctccaagtttccaaacaatctgcaggtccatggcagcaaaattgcagtcctcgagatgaacatacgtatatagttcacgattaactgggttttatcatttctcaagcatcacagctgtccactttactttttgtcgatcatccgagaaatcagaactgaacaatatctttctactcctaaccttctgttatgttcgattagtgtatttgtgttcgctccctttcaaaaggaacaagcgtcctatagaatgcaatttggccatgttccaatgctaataaaaatatattctaacacgaaaaaaaaaaccttttgctactgattcctaaaagtttatgaaagacacttcgcaaaatcaaaacagttcatatttatgcgaagtacttttttccgatcaaaatccattttttagggattataaaaaaataaagtattctgctataccataaatatttatggaatatcttctactgtttataattaattacattcttccgataaaaccattaatatgtagggttcagtctactatacccccaaatattagtgccatgtatatatccatatgtatccagcaactgagtcacgactgcccattagattctaatagttttggatccatgatttttttaaactggatatccgtagctccacaaatctatccatctaattttttttcaatggatttgtttatatacctaaaacccattgaattttttaaaaaaaaattgaggtaaaaatatgaaaaacgttggaattttgataaaggaaaaaaataccctcccttaatttcatctttaatttagtgatcactatgtcatgtacctaactagctgggtggcccgcgcaattgcgcggctagcacccaaacaaaatcatatactttttactataactttacttaaaatttattaaatagctatctcgttgtcttaagattttaaaagaccaaaccttatcatcctcgtgtttctaattatatagattttaaaagtcacaccagttgcttccccttacttctgtcatctccttctttatttgcttgctcgatctatcactatttctattcattctccttggatcctttaaaaattgaatcttatagtttctagagtttattgtcatgttgggtttctttttataatttctagaagtcccgtcaaacgttaccattatacgcctctacggcccgtccaattttttttattgtcattgggattttaaaaatcaaacataattatcgttcgagttcattttttactttctagaagtcccaccaaaccgttagtggctctgccattgtacttatctatggctcgcccgctgcctcccttctttattatcattgagatttaaaaatcgaacatgattatcattggtttttttttacttttcagaagttccaaacctttaaaaattgggccttgttgtttttagagtttattgtcttgttgggttttattttttataatttttagaagtctcgtcaaacga

SEQ ID NO: 19696 - DNA, 1327 bp, Oryza sativa
ttcataaaataataataataaattgcccacgcatctgcgcgggcttccttcctagttatttaatagggtaatcatccgatcttcaatttatccttaatttgcatgtccaatttttaaaataatttgcaataacattcaaaaggatggtcatcaaagtacgcggccaactccctagaattttgagaaaatctactcaaagtccattaaacacactctaatccctcctaagacatctagaacttctcttggtatttcaacaaaattagaaatcctataaattcgaagtaagagtagaaaaacagttggctttctttttttttcccataaatcgggatagaacaattattatacatggttatatatctaatgccttttaaaaaaacttaattaagttctctcttttgctataactgtttctttttttcccataaatcgggatagaacaattattatacatggttatatatctaatgccttttaaaaaaacttaattaagttctctcttttgctatgaaattacacatgatcagtgaactttaatattgagatgccctatgcaccaattgctggtgccattatttttagggacctgactgcgttccctcatccatccttaaattcactgtagtctttagtcaaataacggataaagggtagatgatccgagcatcatatcgtgtcgtacaaagcatgtctagcctttggtatcatagaaatagcttatgcgtaacaccttagccccatttgcagcatagtatggcacattgtttaagaacacttttgttcagcaactcgggtgagattttccacggcacaaaaactacaaaagtcattaggaagtgattacgtaactattaaccattgcatatttgttttattttttaaaagaaacttctatacacaaatatttttacacgaaatgcattgtttaatagtttaggaagtggagcaatggagaatgagggacttgctcacccaaatgtcctagaagtggttgtggtaatggtggtaagatatgtgctatacgtacccataagttcacaacatgtaaaatagtggtaaagatttcacagtttcatagtaattttagtttacaatctatgtgttcctacggtaattgcaatgaaatcataaccaatgttgaaagcaatctcaaataattttttgagagatctctgaagtttaaaatagaataaaaaatattatctcaactataacccattcaaaattgaatattaactttactctcatatctttttacaaaacattaaaataggatgcctgccataaaaaaataaaatatactttttttattgattcattgtca

SEQ ID NO: 19697 - DNA, 2184 bp, Oryza sativa
cttgtcaccaacttcgtccccgtcgccggccggccagcctccacagaaattccaccaccagggctttccgcgaaacttcgccagtggagtcggcgtccaattttcaacgaacgcaacttccacgaaacttgtatttagtgcttataatcctttttaaacttgtatttagtgcttatctttcaacgatttcggcgtagatgtcgccattgccgcgccatgtttttccttaccgaaaaggaatcgctggctttccgttcacacgcatatataaatcgtgcgatcatatgtatgctgctccatcgattaatatgtgttgctggcctgatgctggtgcttactgctttgcaaacttgtgccttcgctgagatagcttgcccactgtagaagatagctcctgcgcttcgccgttttcgatggccgcggcttttcatttgctccctttaagatcaaagttaggcctactttggaacggaggaattttataggatttttgcgggaattttaacagattcctgtaaaattcattcgttccaatgtagccctattagctttggcaagcaagccagttgagttacatgtgctctagctagactacaagaaggaaatcaggttcaagatgggagctgtgtatcttcatcaatgggtggccgggttttcagtggcagccgttggacagaactacgacatggaaggagcaaggctcaacagaagagagctttgagtcagagattagatgtccaagtgcaaatgaatgacatgcagagaggagttttgtgatcatgctggcatggagattgggcaccagactactggaatagcgcgcatcggcgcatggttacaattctttcaggaagacctaccagaaatatcacagggtaaagcagttaagattcttacaggatacataccgggaatattacatgattcataccaagttttttttttttcattttgagaactattcatactaagttaatgccaagaaacatacagtaaacttgtcatttgtcaagaaacatacatacagggccggaagaatgggtccaagctgatgtggatgcggttttgaaaagtccatggtttgttgtcgaacatatcatttgttcagttcccacttgtgggaaaagtcatcagtaaggttccttctgtacttgcaaaggtcaagattatttactacttaacttggaagaaagaggagaaaaacagtgttaattttatcttcttttctatctctttatcaattcactcatcttctgcaactgagcacataactgctttgtagcacgacttgaaaaggcacaactgattgaaaacaaatgtataccttgcaggactgaaatttgcgagaaaagaaaaccaatcactcagctgattgtaaattgctgtacatgataaatttacagaaaactctatggtgcatgattcttcttctccttcaggcccatcaagcacactggaggtcgctggttgatttcaatgcaaggaccggaatgttccatgtcaccatgtgccaccttatgcctcgccggagcatactggttgcccaagattcctagtcactggcagagcatatcagcatactgtcatggacggaccagcttggtagtgataggtacaacagattctttcctggatcatgctgacgacttgatgaaatatacaaagttcgagatctgccgtgatggagcactctcttgtgaatccaagaaaggacatcctgaaaggtcaaatcttttattcagccgtgctctaatttctttcttggcttttccctctgatgaattgccccgtatgaattcggatagtgccacaggggattaagatttaagacccaaatccttctcaaacctgaacagaaatctcaaagaatccccaaataacgaggctatgacaattgagagacacaagcagaagcaaggccgagctcacgatcaccggcgactcagagagccactcggcggtagacaaggattatgccggtgaaataggcggcggggagggcgaggcggaggaggtcgccggcggcggcgtcaacggcacggttgcccgtgaaggagccgctctcgagggcctcgataatcggtcccaggaagccggcgcagccgaccgcgaggcagagaagaagaagcgcggccgcgtcgaggtgggacgccatttgtgttaggtatgggcacaatctggaga

SEQ ID NO: 19698 - DNA, 9302 bp, Oryza sativa
  unsure (1)..(9302): unsure at all n locations
aagcaaagtttttttttttttaatcctcctcctcgtccccctcctccgccagccgccgccgccgtcttcttctcctccgccgacgacgtagccgccgacttctcctccacctcctccgactccgccgacgcagccttctaatcctcttccggcgccgccttcttcttctcctcctccgacaacgccgccgccgccttctactccacctcctcctccgccgacgtcgccttctactcctcgtccgaccgccgccttcttcttctcctccgccgacgacgccgccgacttctaatcctcctcctccgccgacgccgccttcttcttcttctcctccgacgatgccgccgccttctactcctcctccgccgacgccgccgccgccgcctcctcctcctccggctgccttcttctcctcctcttccgcggacgcctcctgctcctcctccggccgccttcttctcctcttcctcctcctcctctcctccgctccctcctctccggccgccttcgatttctctcctgcttctccttctggaatgaggtagaacctcgagtcatccggagggcttatttacaggggaaaggtatttgttttactatggcactgtttggaagattagcccacggttaattttaagagctaatatttagctaaattggtaggctaaacattagcctagggtggtatgtttggatctatagcctaattcaaggctaaaaagtggagagagagtagaaagagaagagagagagctgcttttttttttgtccctacacaaaattagccccattagcaccccttggaggggctaatattttgaggggggctaattcacattagctcaaaattagcccacatatttggatccttgagggctaatttgaggctaaaagatgagggctaaacattagcccatggaaccaaacaggacctagataggcccttagaaatatcatttatttctcttcatcagcattaacaaatactctctccattccaaattgatatacatatttcgtaggtacatcaagaaaaaaactaataactctctcatactatatttactctagcaacaaactcaatgcatacaccatcccaaatatttcttagccaatagcaaataaagatattgcatgtgttatataaatactggtgtgtatggatgcatgcatcaatgtccatttactctaatgcataaataatgaatagacctaataaataaatataaatacgtagaccatttaggaataaactaatagattaaattgtaagggagggagtactactagcaagagagtagagtacggtcctttgaattttttgctagtagctccgtgttgacctcgcacgtaaatcatctcagaatggagacactatggtaacattttcaatcgaggaaaatacgagatagacatggggttgtaaattttaaaaaaaagagcgtatcaagttatcaacactcttttaagagagagagtatcatcaaacacataattaaaaaatttagagataagtgaaaggtgcacggtgcaccattggatgcttagatggcttgagagtaggaatgcaagcataacagtcaagcgggattattctgcccgtttatctcactttgagtttttcttatttttaattttatattaacatgtgagaaattaattagcaagcgaatttttatactgacagaggaattacccacttaaatttctacttgagaggacttgggttgtcacccagattgaactctccctgttgaaagtttttgaagcgtctctccccaaaaatcttacttttgacagctaatcccctgtagaaacttaagctgcttgctaatactaccaatgaacttaatatgctgatagcttacggcgtggtcaggggctgccggaccaaatggtgagcgctttcctagcaagttgcgtcgtagacgaccacgcaacgcgcaaatacacaaccatgtgcgcgtttacaagttacaaccatccgagaccaatctgcttcagttcagagcatcactgaacacctgtctcccccacattggcagggaaaagtattgcttctacacacttgcatttttttccagagagaatttgtaagtacttccttttgttggtaatagtatctgctagggaggagcatcatttggtggtagtacctgcgagggagaatatccatgcctattacattcatatttacttctcgcttttcctacggatttttttactccttgaaacaatctctaaacgagaacggtacttgcaatccattattcagctggcaggcagcgtaggttttttttaaccattttcttctctattaaataatggatgttagtttgtccttagcactcccaacacattttccattcaaaaaaagatctctaaacattcacgccactgtccgttccatcttccaacagtgcatttctcagacctttgagcatcggtctcccaaagaagatggcttgggtatccaatttattctccagaacgaattgccagtacgtgcttcaactgaatgcaaatgaaaccatccaatccaacgtacaacacgatgtggagtgacaataactaactttcagaaaggagaaatttcacattgcatatccatggaacttttgtccaatacattattgactaatcatactcatcagggtggtgtcttttcgcccccaaggccaagcaggaaaatgcctcgttaggaaactaggggatagcatagctatagcagccactgtccatggctgcacgcatggtccccttaaatctactccctccgaaccataatataagggattttgagtttttgtttgtagtgtttgaccacttgtcttatttaaaaaaaaatttgaaattattatttattttatttgtgacttactttattatctatcgtactttaagcacaactttttgttttttatatttgcaaaaaaaaagttgaataagacgaatggtcaaacgttacaagcaaaaaaaaaaactcaaaatcccttatactgtgggacggagggagtagattgtagagtgcttcaattgtaaatccatggcgttacatgctactccaattcgttgtatctgatactatcactttattgtactgaactatctgtagtagtagtaaatatttttccccaccacttgtatgtttggatttggggatttagctgggatttagttcaggctcaaccaaaatcctcagcaaatattacctcgctcactgtcactagaggccaccgccggcgacgacgacgacgacggaggcaatggctggcctggcgaagaccagcgtgaatgcggtgacaatggacagcttcacggcagccgcgaccgccgatggggtagtgacggagaggtagacgaggaagacgcagacgaggtaggcgaagacgagggcgaggagggcggcgacgatggccgcgtcggcggcggcgctgctggggctcatcccgttcgccaggaagtcgaggataggcttcagcagcctcgcgcagccctcggcggcgcagagggccacaatcgccacctccgggagtgaagccatcgccgccgccgccgccgccgccttgaggtgactatgtgagagtgagactagccgagcacaaagtagcagctggtgggaggacagacgagaagaatgtcagcaggaagggtgacaacgaacaagctagcggccacagccagagaaaaactagaagcactgctacttggagaactagtactacaagcaaatgaggatgtcattttgatgtttctaataaggtttttaattgacgattgaaatagctcgtataagaagtgcaacagataagttgtattgaaaacagaacagtgtagatatgtgtttacttattttatctcttatacttttatgaattcctaatcatatgataaaaagtattgacatgtcgtcaccctatttaataaaaatgaactttttgtaacgtacccggaattctttgaagtcagaaaaaaaggaaaataaagaaaaacttagcaaaattttgattttgattttgattttttttctttgtcttttgaacttatttttggcgttcttggatttttcatgcatcttataatgtatttgcaagcaatagatataaacaaaaaaatgttgaagtattaaatcaaaaagggataaaaagaattgaaataagtggtacacacttgaaataaccttccttaagtctcacaagtttttcatctcaatcaaaaagacgaaaacatccaaaatttgattcaaattgaaataaaaacagtgaacttgtatgaattttcaaaacaatataaactacacatgagaaaaatcccagaaattcaccaaatgaagttcatgactacactaacttccagtaattttggcacaagcttttgagctctgtaacaatcctgaaaaaaaaaattcccagactctcagttttccctctcctcttcacctctcccccttgaggtcatttcgtcgaacatttggagtgccaacccgaagtcagcgcctccaagacgaccaagccaccctctgtccgcgattcccgctgtgccaaggctgcacaaagccgacgccgcccctgccgcgcccaggcgccttgcaccgcagccgccgtggccaatccaatgccgccgccctctgccctacctctgcccgatgccgaccaagccaatctccgctctgccgcggccaatcgacgccgccctctctgcccaaggcgacgacgcgacacgacgaccccgaccgccgctgccatccctctgcaaaaagcctctgggaaggctgcgtccccagccttccgccgcgattcccgccgaggccgcccacgccatgtctcccgtcggcctcgcccgtgcgcaccaacggcgagacaaccgcgcgcgcctgcttctcgctcctccctcgcctataaatcgagacctcgcgcggctgactccccacaccacactcgttctccaacatccctagacgaagccctaacctctctgtttcgacgggaacggccgcgccatcaccgcacccccgagccggccgaacagagccaccgccatcacctacaccatcgagccgtcgcgtcggtgagcccccttccttttccttgcgccagcatgaccccgggagccccttgaacccatttcatcaactaattttagaccccccccctcgccggagcgccgccgccgccattgccgccgtccgccgcctcgtgaacccgtcgccgcgccgtcacgcaccacctccgccccgaatcaagcaaggagtaagcctcctcgtagtccctaggccctcccctatccattaatcgagccactgttcgccgtagcacactgcccgccgccgtcccgaaccgcctgcactgccggccatggcgctcgccgcctccagccacccccggctgcgccaccgcctctaggatgtgcgcaaggacctcctatagcttccacggccttcggccgagccatccccgcggccgctcgtcgccggcgagcccttcccgagtcgccgcgcctctctgcccatcgagctgcctgtaggttgaaggaggaaaagatagggggctgttcagattttgttattttaaataaaccttactaaattttattattttaaaattttgataagatgataatattgttaaaattttagcagaatttcttatgtatttatcaaacttaacaacaaactaaatatatatattttttaataactttaaaaaaaatgatatggttgaaaatgatgtaaagtgaagaggcccagtgtctttttaagaaatgcaagacactgataggtaggcataggatctatatgtaatttctggaaactttaatgattggccgaatgattagaggagtgcctttcactgacatgtggacccactgttttaaatcgatgcacacaattagaaaacgttttccctgtaggaaaacgtactctatatagtgcgctttagtttcttttgtaaacaaattattaaatctgagaaaaggtttctgttaattatttttgtactgagaaattctgaaacttttgaaaaaaattatataaaaaacattttaactccgattgaggttaaccaaattttgttagattataataattttctctttggtattgtacactcaaacttagcaccaccatactgtaaaatttcattaatttaaatttgaatagcaaccttagtatttactgtaatttaaatcttagaaacgcgataaattgcacatacatcagatttaggcaattatttctcctaaatttatattaaatcaccctatatacgctgaatatgttcatgcaccatgcatcatattttatattagagttttactggatgttcatttgaatgtacgtttaaatttaaaatagaggacaaatcgattgtcgctgttgacgagagtgtgcaagaccgagaaatattcgagtaactcctgaacaagccaagccctattcaattcttccttcgaatatgttgaatcctatccccaacaccgtaactcctaagcaaggcaagccctattcaattcttccttcaaacatgttgaatcctatccccaacaccatctcaaagcaattgccagcctccttcctttccccatgtattcaccttttgccgcttctccttttccactatggacgagagctcgagccaacaccatctcaaagcaatagcctagtgcttttcctttcccatggacaaggccacgaggcagtttacaagaactacgctttcactaaggtgaaaataatcatcaatgggaaaaactgttttgacactgtcaactgttaggactcaggagaaccgaaacattagtaagtcgtaccgtatgtggcctgtggccagtattttgagacaaacatatgaaagcaaaacatggagagggtggtacactgatacatccccaaaaaaagggatacagatcaacgtcatagtagtatctacaactctggctatctcctaatctcttatggactccgggccaatgcaacttcaatatattacactgctcgtgttcaaggcaatcaacaaaggaccgcaggggaactattccacatgctaacaaatggttaatgctaaacatctggctctacagtaatgtcatacaccctttctggattgaagaacccacaagatatgaacaaacttagtgtgctagaaaaattcctatgtgttactcgcatcgacaataagagaagtaagttcattttcttgctgacttttaaatcgtgtcagagtagggaggctccttttaaatctctcaggtagatacctggacaattcaggaaacaaaatgttatatagtgcataaaccaatatagtaaatgataaacggaaatgaggtgatacaggaggaacagatgattgtaaagtctagaaaataactcacatgtcaagtctttcagcaatcgctctgcgcactgacgagttgagccataagcgatggaattaaaaagcccctaaagataccatgaagcattagaatccatggaaaatgtgttcacagatgatgtaacgccagagaagttttgtgagataagctcaagctgaggtaagcctcacaaggaaacaaaacaacaatacacttctacaaacagaacttcaagaggactccacgagaccatgactcatctatgcattatatagagccaattctttggatactgaaggctaagtatgaaatacaaccaatttcataggcctgtttcaagaaagagtagggttgaactccagcgctcccatttataaaaaattatcaacaggactgacaacaagataccgggagtcctctaagcttctttctctagccctaaacttaaaaagttggttcaacccacattatcaaagtagtttcaatatgttatgaagactcttcagaactgggtaactagcatctaggatgaaaatactcaccataagtccggcaaacccaacatcaagaatagagagccanaatatcttgtggcctggattagcanagtcatgcacacgattgattgttgcgaaagcccatgaacctattagaatgagagggtaataaccccaccgattaaacgcctgcaaaagaaaacaagtcaataagctgtatctgctcaaataaacattcctatctgctaccagacagtagacagtggtgcgaggctgatccagacatccaggtaacatgataatataagtactcctagaatttacacatcatttttgctccaaacatgataacataaggtattatactccagttcatctcaagactggaggtataaaaaaaataataggatcaaatgagttactctctgaattcatgatagtaggaagaatacagtagcacattaggggaaaatatttcagtacacataatgagaagagatgtgtaggaaatttataccttcttgtctgccctcacgtcagattgaattgatcgatcacttatgccaacagccatctacaaattcatccattatcttatgaaaatcagaacatataagcaaaaagagcagaatttacaaggattcaatacaagccttatttatcatcaatataaaatagaaaactgtatgcatacccttgtcgcgttgtttatcatgcgattaacctgaaagtatgtatacccattgtagagaatggcaccccacaatggaagataaaaggttaccaagtgcaagacctgcatataaaagacatataatgaacaattgctaaaattctgacaaagtgacaatatttttattttgaatgagtggtctagctaggatcaagatggcaaattaacagaagacatagattgcagtaaagatatggaaaagaaagaagccaatgcacaaaaagtcaaacatacaaactaagagaaagcatgcgtatactctcagagactcactaaactttatgataccatctgtcttgtgcaaggtacgtaagcaattccaaataaataaatgttactacctccatcccacaaagacttcatttctgactatgaatatagacaatacttgcctaggttcatagctagaaatgaagtctttttgagacaaaggtagtacttattctgttgagtggagtttgttttggatcatttgataacagctcaaatactaaatgaaagcaaaaacatataggaacgtcattagcaccaatttgggccactctgactaccatggataaggttcaaatgtaagctgtaaataggtgttaccagtgttagaaccaagttaactgattcatgacaaaccacaaaaggtcacatgcctttcccatgcttccttgttggatccaacaccagagtgcctggccttccataatcacttccaattgaccgta

SEQ ID NO: 19699 - DNA, 7111 bp, Oryza sativa
ccgatcagatagcaaacatcttacaaaaaaaaaattgtcgagaactgcttcagctcgcacgcataagcagcaaaaacagagcatccgttggttaaactgacggcgtgaacccccaatatttctcaatcggaggcgaaatgaacaccgcactgccctcagatccccactttgcgctccccaattccaaatcgcaacccaacgcagttacgcagatcacgaggctagcctcccgaacccagaaccccccaaaaccaagtagttccagatctgagccgctcaccgagaccgcgaggaagtagacgagcttgaaggagaacttgcggagctcgcggaagaggaggtagcagagcacgatgaaggaagagcccgcgagcgaaagcgcggcggcggaggtgccgacggcgtcgaggacgtcgcggtccctcagcgcctggctcaccgccgccgcagccgccgccgatgccgccatcgccgtcgccggcgagcgagcgatctccgcgtcgacgaggaggtggggggaaggaaggaatggcgcagtggaacggccggtcggtggtttggtcgttgggttgggtttgggttttggaccggatttgcctgccttcgtagcgaaggctgtggtttacttggtctgtctggtggttagtctaatgggccgagccagcgtacagacgtattgctttttgggccttctgtgtgtatgggcccatccatggatgaactcggtataagtctgcctttggtagctccagttgagaacttttccttaacaccaaaatggagtgactcattagcacataactaattaagtattagataaaataaatttaaaatttacatttatatgaatttttaaacaactttgatatagaattttttttaagaaaaacacaccatacatgtgtgcgagaaacgagatagtataaattagaaaaggggagaaaagaatgcaacctaagattactgatttggaaaaggtttttttcttaatgaatttttattactgacactgatgggtcatgcttagatcgtatctagattttatttaaccaaaaggttgggatcatttttgtaagattttttagaacgtgtatgctctatcgatttccttttttataggatgtatgtatattagtttgtgcttctaaaactataaataaagtatatactcccctccgtaaatagtatatgatgcttctctataaagtgggttagtttcaaaatagagtgaattgtatattgggctagttattatgactaaagtttcactttggactatggcacatccaacatttttagtttatacaagagtcttttaccttgggttgcacattagaccactctatccattttcacattccatgtttccactcagccactgcttgcttctacatcaagctgctgactgttgccaatcgtctctaactttggcactgacattgggtcaagctagcagaggagcacaacaccactagcctaaggtattgagagccgcggggaatggcgttgaagagaggagctctgtctacgttgcccctgagcttgagctcaagctccatctgtggccacctttgctagctgcgtgcttgagcttaacctccgccttccatgccccatgctcgagctccacttgcaccgtcgtggcgcctcaacagccctgctccgtagctactcttttttcttccatgtattgtgctcattgctcttgcaacagtagaggcagcatgatctgatctagtgcttgatctagtcataagctcctaatctagatgctcaagctcaagggaaacaacagatggacagctagactgctataggcaaactggaaagagaagtggagggagcgatagtggggatagggatggactggtcttgaggaggaagagagaaggggaagagggagagacacacatggtctggctgacatgtgggcctcttgtccaaattgcatgctcaagtaactatagttggttgaaagtgaaaatgtttgataacacctagttcattgtgaaacatgggtaagaaaacatagttcaagatgcaattcactctttaaaatatcatgattttgttttcttgaacatggtcaaagtcgcgatttcctttactacaccgctcgttctcgatggcaaaatactacattttttaggtttgatccaaggactaaaatactactagtgctgtatacataaggattaaggggtgaatatgcaacgactgtgactgtgaggcgtgtacttcaacagacagatttcacacaattttgtacagatacagtgtccaaatttatatgcacccatgtgagccataaccttatggcctagttaatttaattaacttgtgggctaccagtacagcagtaatatttttcttagctcggatgcattatcgagtttaatgcatccaaaaaataataattccattagtcaaacggcccttcgatcgcaccttatgctacattccttgatcgaattaatcataacctcccttgctgattatatacgctttgctttaatttgttttggaagatactatttgtttcttcacagagatcaattatatagagtatgtactctctacgtactaaaatataacaacttttaacactttgaatttttctcaaaatataataatgttttcatcaatatttccttatcaatcaatcacaacatctttctatttagtttatctaatttttgtataatattatccaattgtaaaacttttttatattctaaaacggagaaagcggtaactaaccaatacgtcacatttaatttttgatcgagatctaaccgctcgtcgttgaggtcaacgtagcacaccggctaacttttccggcctccataagacaacacatcagcatgtaccagtacccctccagaaaaagaaaagaccattctcgagatgacctgatacttaactgctactacatcatcgtcaccgatcagtcgtttggacttattgaagaatagttaagttaattcatctagtgattaaattagcttgacacccagaaaaggtcacagaaaaggagtataattagaacactctgcaagcaagctagctaagctggcttagcttagcttcttctcttggtaagaagaaaagcgagagagattagagatcaagctgagctagctagtgaggtatataggagaaagccaagaaatggtggacgacgtggtccaggtcgccaggcgagccattctgttccggatgccgaggaggagggcggcttcggcgtcggcgtcggcgtcggcgtcggcgtcgacggcgacggcgacggcgacggcgacggctgggcggatgaggaggaagaaggtggcggtggtgaggctcggcggcggcggaggaggaggaggagggacgaataggaggctgtttggggcgctgcggcggctgcgggtgcggtggctggcggcgatgtaccggcgcgcgctgcggcggctgcgggtgtgctacgccaacgccgtccgcgacctcatcgacggcgccgcgctcgccggcgccctgcgcgcgcccgtcggcatcgagtactcccacgccgccgcgttcggccccgccgccaccgtcgggttctgagaccgagacgtacggacggcgcgcggacatccgtccgccggtgaccgccgccgcacaccgtggccgtgtcggtgcgagcataggagctcagtgagcctctgtgccctgtgtttgtgtgcgtgcatagcatgtttaacccacatggaaatcatggcgtcttttttatgtgaattctgtctttgtttgaatcgtattttgtacagactttcctcgttttggacgtagtaataagtagtaaatcttgtcacaaattagctgttgatggtttgatcgttgcaaattgcaattatgcaggatgattttatctttagttttttttaggctcttgtttgcaataagaacaggagattctttttttttagagatgaagaacaagacatatttaagtctgaatcattatctaaagaaatgttttaagtgtggatactgaacaaaactgtgtttatgctatgcaaaatacatttatgcattagaccacattacaaaatcaaacttgtttaaaaacaagtttgatttttgtaatatgggcctaatatatgagcctctaactctgcgattttttttagtttttaattttatttattaaaatatttaaaaaataattttcgttttgaaaatattgcaaaactagtcgcccatcgcttaaaggcgactagttttgtaaatttttcaaatagaaaactatttttttaaatattttaataaaaaattaaaaattaaaaaaattcctaagtctgcaacctcacagcccaatacattactgggcccaaggcccaaatcttctagtaaccaaagtccaaaggctattctgaaccgaagtcctcccacaccaaaacttcgaggcccccgtcgcggcaccctcctccgccgccggatctccaccggagtacggcgccggccaccccctcctcccccggatcttcaccgccggtgagtcccccgctccttcccataatctctcggtgagtctccgcctcttcccgtcctcctccttgctcccccgcgccccgcctcctcaagcgcacggccggcgaacacccagaggcgctgtgtgcggccggcctcctatcgttgtcccacccccaacgtagccttctcttctccccactgccggatcctcgcttgcgcggccggggagcagcgttggagccaggggtgcgaccttcctccatcttggttcgaatggtagcgtttgtttcctagaggaattggggggctcagctgagaaccatggccggcgttagtttctggccatcttagcacaatgacactacggagtattaatttgtactaggtgaggttatttccacctccaatctgagtttagttttagttagaccgctacatcaatccaagcttgcaaggtaggaacagaaactagtgaccagtttgctaatgtatttatcatgatgcaattacctttgtttttgaactaatctttagcttagatatggaatccgtgaatgaaatggcatttcccctttctgtttcactttcatttcattccagaaattcattgtgaatagagttttcgtatagcagcataaagatcttctgaattcatgtaattctaatgtagtggagcggtacaggtgaagtactgaggtgatgactacatcagagtcagtacaagaaaccttgggattggatttccctcatcctagcaaacctcgggtcctccttgctgcctctggaagcgtcgctgctataaaatttgagagcctttgccgtagcttctcggaatgggcagaagtcagagccgtcgccaccaaggcttcattacattttattgatagaacgtctctgcctagcaatattattctttacactgatgatgatgaatggtctacctggaagaagataggggatgaagttttgcacattgaactgcgaaaatgggcagatatcatggtgattgcgccattatcagctaataccctagctaaggtatgtgattttcttttctttttctggtgtgaaccatatattttttatgttgaatcctggatttgtttgacaatgtcaacttgttttcgctgcctacaaaaaagtgacactggattagttttgttcagattgctggtggtttatgtgacaacctcttgacatgcatagtgagagcatgggactacagcaaaccactctttgttgccccagctatgaacaccttcatgtggaacaacccgttcaccagtcgtcatcttgagacaatcaacctgctaggtatatctttggtccctcccattaccaaaaggctggcctgtggtgattatggtaatggtgcaatggctgagccttctgtgatcgattccaccgtcaggcttgcttgcaagagacagccacttaatacaaatagttcacctgtggttcctgccggcagaaacctcccatctagctgatgcggcaactattctgttcaagattaaactctggacctagttttctatggtaaagagtacttcgtgtcacaaaatgaaatgttaagtgatgtctatgtcggccaacatagcacctttattggccagttgttgtactactattagtgatatggtaggacgtggagattggagaaaggctattgtcccagcactttaatgttgcttttccaaatttcttgtgacataatgctaaggtgctgatgaatatgttcatgttgtagcactatttttttctgcaaatgtttgcaaagactcgtgatggaatcaaaatgtagcaggttgttctttcatccttttctttttgtgcagcatgcgtatattggaaggtgaacttgtctggtgtgcaaatgctgcactttcctgcttggatacgcagccgctaaagcttggacatgacggcttacctgaatcctttgtttcgatctacgcttccctctcgttgatgactggtgatttgtcgcatggatcacttgaagctggtgcaggaacaaactgagaatgacatgtggcaggcaagccctgtgaatgcaaaaaagaaaatggtgactaagcaagaagataatgccaagttcagataagcatttggtaggggattgcaacaagctgggtgaaggtggcgtttcaagtttagtcatcatctgcaccccacaaggaaatggtgaggaatggtttaccgatcaattggaaagattatgcccgttcaccatcgactcttttgaataattctgcctatatggtaggcatgataaagctcaactagaggagtaacccaaaaaatgccatgcatatatttatcaatcagcatgattgaacttgaagttgaactgcatatggttggccatggtgtatgttgaaatagtaacacagtggtgttgaagttgaactgcatggtacatcttgatcagttgattctgaactggtctacgttctttccagcctaaaaaaattgaaagtataacaagaaaaaccataaaattcccctacgcttgtcatctttaagatcgtgaaagcgcactgcgttggcgctttatggcctcaaactaataaacatggccggtcacaacttttctgagattatgttgggattg

SEQ ID NO: 19700 - DNA, 20350 bp, Oryza sativa
ttcttttatatgacgttggttcatttacaattaaataaacatagggagtaatctgaattcagagtcgttaacacaattgaatgtagtaagaatatttatagataaagaaagaagggaaatcgtctgtcataatataatttgtgcaattgtacaagctttgtcaatagtatggattagaatcttgaagataaaataaatttgtttccacatttgcctaaaagattttcttctaatcttgtgactattcgcttgattatcttcatctcaaaagttctgatatgctaacctactaaatgaaactctaatgaacataatatgtcattctccatatatttgttcctaacacaatatatacaattgttatacttagagactaaataaatttagaagcaatcatgtgtaagcaaacacaatgtgctaaggagtaagggctttaaattgaaaatcaatttattccatacattagcccaaacatctagtttcaaaacacctattccactagcaacacttcatctaacaaatctaacattcaaaaacatatggctccaccatttgagatctatgtatttgcaagcatttcataacatttgccataagaaagaattgcacaagaaagaatagacaagaatatttgaataaaagaccataaattctgcaatccacatggttggaaagatatttatattagcattagagtatgaacaaacttccatatattttatgatgaatataaccatagattgaacaccttatgatatgttgaaatagtccttgtagacaccaagaagtttatggtcataacaaccaaaacaaaatccatgaattaaaattagatcccattagatgcaccaagatactcaaacaagaatatttgttcaccctaggtacttgcaggagcaaagtccacaaaaaatagaaagatcagaaagaaatagaaacctatgagaggaatggatatccccttgttcttcttgaaatccttctgtcggtccgcctccttcgttgtctcctatggctgcaagatcatcatcttcttatagataaagccaggtgtgtgtggtattggttcatgcaatgtttatgacacaaaatgacaaaagaggttagcaacagatagatcatcccacatcagtttccttgagtcatctgggttgtaaaatcgtgtcttgggttgcatcattagctgccctttttttggttttagtgaaggacttcaaatacaaccctaacataattgttatttatatagtcattttaatacaccctccgtactcgtaaaggaagtcgtttaggacaatgtttaagtcaaaccatgggaatataaatcatgaataactctcaagttgttgagtttgaaaatgtaaaaattatatgaatagatttgtcttgaaaaatactttcataaaagtatacatatatcactttttaataaatatttttatagaaataagaagtcaaagttgtgttttggagaccgtgtcgctgtcctaaacgacttcctttacgagtacggagggagtatgacactatgtattacagtttttgcttcaggctttgggaatgggaatcattattgacatatgtgttttcttagaatggagtatgttattgtgttcagtgcattattaacaatggagtgccgtatgtgctcttttacaatgaacgagtacgtgtattattttttacaaggatgcacaatgattaaacaaagcctactatggctaaagatgctacaagaacttgagatcagtgatgatgtgtctatagtcaacttgtacattattgcatccgaacacttcccaatgttagtttaaatcagtgaaaatagagcaaaattgtgtatcccatgagttaacataaatagcgaagtgtcctaaccattgtgttgtgtggtgtgcatcttttccttcttgtgttgagcatattataattcatttttccctacgttcatgtctacaatgtttgaacatcgaaacattgagatttgtgctaacatgactctaaaaaataattggatgatctaataattatataagaaatgttcagtgtccttttcctaaagagaaaaggttgcagtagcaaccagcacatagagaaaaatccaaattcaaaacatgcaacagacatctacatttgtctagttgttcttattggaacgctccagctaatcggtcgagtggacatgcaacgtgtaaagttagtgtgtgaatcattttatttatttccttcttggttgtactaccttttctaccacacattgtaggggacgattgcacaagtcacgaatactcacattatagcttaggggacaactgcacaagtcacgaatgctcgtgcgagttagaaatatttcgttgatgcaagtgcctatccgaaaagtagatttcaagagataaaacaccatatctttaaaagcaagaatgacttcgtgatccaattaaagcagcatgttccatttgaccagatcaatagacgatgaacaactaacgaaatatattttttttgtttcatttggtcaatcacaaaaaaaaaatagtgatcatacttcaaaatattttattcaaatgttgttaataaactagtagaggttcatggagtgacgtcgcaaaataatttcattctacgcctaattgacatccatttcaaaaatatatggacaaatgtgccataggatttaatttcatctgtaactagcaatctgtaatatttttcatattgagccgatagaactttatgtaatgatatgacttgacagatcggactcgtaccagtggaacattgtgttgaaattataagcacgtaataatttaatatattcatgaacagatcaaatatacgcaacatgtcgaacatgtatcgaggttgcggaaagaccagttgctcagcaggaattactcgcggttgcaggcgtcgatgaaggcgcgcatcacgcaagcggagaggaagacgagccatcatggacgaacaaggagcagtcgcgcaaagcgcttcccaaaaaccttattgccgccttctcccagtgcaggacgtcgaaggtagaggttccggagacctactctcccgatcgccggtgcacgccggcgagcgggatggagtagtctacgaggtacggcgcagcatagagtaggaggcaaatgattgatttcgcgtgtgttgcgtgaaggcggcggctcggtttatgtagagataggtcgcttgatcagggcgtccgcacgatctccactccacgtaaccaaaccggataagtcgcgcataatttatccggacttcacgccattttcacgcaccggatttttcggaatgtttccaaaacgaaacaaaaccgaatttcccgcagcaaaacaaaactgcgaggcgagcacatgcatgtgttccccccacttctctccaccacacatgcttcaagtggctaggagggcatcctcccttttaaggaggtccccctctcctagaataagtaaggtggtactaaaatctccaagcatgccatctcatgaagtgggcttttgtgattttccaaataattaatcttcaaatgaggtaaggcccatctattaattccaacacattgttatattacaccaagcatagttgcattatcatctcaaaactccagctgttacaatcccatagttcgaaagttacaactaaaactttttaagaccatcatcagtacaaactttacaattctttagtaagatgagggatcgctttatctccaaagctcaataagtctaggaattttccggtatcattaatagaaaaatgatttttcacaacacctaggattgacttattttttcaagcggactataaaattcacgcttaaaaaacaactagaggcaccatagttctagccccgccagtggaaaaagaattttacaggcgacatcctatatgtaccgcttgtggtaacagcggaccaacgtgacacagttgataaccataaaatattctaaacccgatacgagccatccccctatcactcattcaattttatcctccccctttccctctcctcgccctatcggtggcgcggaagtaggactgtcaacgagccgagctcgaacgagctcgtctgcttaaagctcgagctcgagccaagcctataaaatattcgagctaagtaaaacaatatatatttcaaatataatctttaaaaaacaattaatttctagttcatcatattaatataagagaaaaaaagaataaaataaatatatgatgttaatataaggcatacaaataatatattttatcttctaatttattaaataacaacaaaaatcatatattactagactcgttggaagctcgagctcggctcgacaaagctcgcgagcttagggagaggctcgggctcggctcgtctagagctcgagacgagctcgaatcgagcctaggacgagccgagctcgagcagctcgcaagcctcgagcttttttgacagccctgcgcggaagcctatattggtgatgggggaggggcagtgatggctcggcgaaagagcgacggcaggcttgatggtgaccgtggcgagggcaggagctcgggaaggcaacagcaagggcgactgctcaggggctgcagatcggtggcacggccccagatccgcgggtggaccccgttgatttttatttttatccttgtcattgacatgtgggtcccacaagctgactcagttagttaacagggtcaaagatgccacgtgggacaatctgcctccaaaaccgctcggggagtcaatttgtaacagttttgggagttggagggtggttttacccggttttgcagttgggggatgcgattcagccagggtcaagagttgagggataacaaataaacttattccatccaaacagctaccgtgatcagattacgttggcccagtattaaaatttatatgggcttttcggggctgtaaatgaattaggcccaaaattagaattgacacaaaccggataagactcccatctcagcgtccgtgagctaagctacctactaatgccacgtggcggccgtcaagcgggcacctaatcctcatctcgtataaataaattcatttacccccctcgggatccgagaaatttccctcctctttccacttgtcaccgccgttcgccttcccaaccacgagacgaccctgccctcgccggagatgctgccgtcggcgaccggggacatcgccggcgacgtccactcggcgcgagagatgctccatcccatcctcctttgacttcttgccgccgcgggagcttgactggatctgagctagctggattggtgggtgggcgcgtcaagaaggggatgagctttggcgccgttgacgtcgacgatggcggcgccgcggcgacggcggcggcgagtgggggtgaggaggtgagagctatgccggccgaggtgagctgggagatgcttgacaagtcgcggttctttctgctcggcgccgcgctcttctccggcgtctcggcggcgctgtacccggcggtggtcctcaagacgcacctccaggtctcgccgccgcctgcggcggcggcgtctaccacggcggcggcgatcctccgccgtcacggtcctcggggattctaccgcggcttcggcgcgtccctcgccgggacggtgcccgcgcgcgccgtctacatggccgcgctcgaggccaccaagagcgccgtgggctccgccgcgtccgcctcggcgtcgcggagccggccgcgtccgccgcggcctcggccgcgggcggcgtgtccgccgccgtcgcggcgcaggtcgtgtggacccccgtcgacgtcgtcagccagcgcctgatggtccagaccgccgccgccggccccccgtaccgcggcggcgccgacgcgctccgcaggatcctccgcgccgacggcgtgcgcggcctgtaccgcggcttcggcgtctccgtcctcacctacgcgccctccagcgccgcgtggtgggcgtcctacgccacggcgcagcgcctcatctggcgcgccctcggccccgcccaccacgacagccgcgcgtccgtggtcgccgtgcagggcgccagcgccgcggcggcgggcggcgccgccgcgctggtgaccatgccgctcgacaccgtcaagacgcggctccaggtcatggacggcggcggcgcgtcgctggcgtccgaggcgcgcgcgctggtgcgggagggcgggtggggcgcctgctaccgcggcctggggccgaggtgggcgtccatgtcgctctccgcggccaccatggtcaccgcctacgagttcttgaagcggctctcgaccaaggacacctcactctgatagaggcatcgtagctgtaaccagagcaaaccagcttgtgatttgtaaactgatagtaaatcgtatgcacatgtacatatctaaagcatctgcgtttcacattgatctcctctacgacattaggatgcaaaggctagattttgttggatttttgaagctctctttgtaagttgtgacgatgatgatgaaaaagtttggtgaaacgaagaacatgtatatttgcatttgatcaaaatgttatttggtggtttatgtgattcaactggatgattgttgcatgaccaaatgctgctgtgtccatcactgttggggattgcaatgttacagttaggcgtcactactgggacagctgattgttgcaccttgagattttattttatttttttacgatgaaaaatttgatgaaacgaagaacatacatatttgcatctgataaaaaatgttgttggtggtttatgtgatacaactggaagattgtttgcatgatcaaatgctgctgtgtccatcactaattcactgttaggtcattcacaatgctcctatgtggcgttcggcctggacaaagaaaaccgaatattcggtggcacatcctcaaccagcggtgcaaagccaagaacgtgtagccaaactttgccaccctttctgtttttgggaccacactagtactccgtgccgccaagaaagagaaagggagagagatgtgtcgtcgtcgtcgtggtgctccacaccgccgagctcgtcacccaaggaaggaggacgatcgggcgccgtcctcgtcggagaagcttgtcggctcgatggggaaagcgacagagaaggagaggccacggccgaggtcgatcagtgaaaggggacggccgcggtggaggtcgatatggcccccggagctcgatccgccgctcgacccggctccacgaggaagtcgaggtccgcatcgaccgccgccgaggagctcaacgtgacggcagcccctcactctgttcttgtccgccgacaatgcccgacgccagatccggtgaggtcaaggtcgaggctgcgctcttggtcgatccgcggcaccggaggaggaggaggaggaggagtggtgtgctggcgagcgccaggccccaccgccgttgccgctccgcccgctcggctcgacgccgtctctagccggctctctgtggtggggattggggaaaactgggaaaggaagaggggagagagagagagggggaaggggaaaagtgaaaagtaaagtagtactggtgggacctactatgagtggtttgcgccgtggaactcacatgttcttagtctaagtggcatacgaggtacaccaaaactttgtaattgcaatgttacagttagacgtcactactggaaatttgggaactgaaagtgcattgtgtgtgccaaatttgtcacggtgttgcttgtaggagcaagacactgacgaaacagttgatatgtccgaaattctgggagtagaatcgttgctgccctgctggaaaggcagcttgagatattttccacatgatgaccgtaattttcgttgaaaccgaacacttctactactcctgaagtcctgatgtcttactaagtccgagtttagttccaaaatttttctttaaacttttaacttttccatcacatcaaaatttttctacacacacaaacttccaattttttcgtcacatcgttccaatttcaaccaaactttcaattttagcgtgaactaaacacaccctaaagacagcaattttttttttacactaggtaggcagagagaagaagatttgatcaggtatatatgactctgcaacttgactcaaaacagtattgtgataagataagccagctagctaccggttgaaattctaataactgagttaatcaaaccactaaacacagtatcgtcatcagaagataaggcgagaaagtaaaccctatcgctttcctgccgtgtgggcccataccgatgtgcagtctgaggcgtcgtccgagtcatcaattcatcgtatcccttccgggtttaggctggtggttggacgcatctcatcatctacttcgccgacctcgacctctcaacaatggcgatccgggaccggggagacagttggtgaacaccaacccctgccgttaccaaggcaacaaacttcgcattcctccattaatctcttcatcgatctagttcgttttgctttgtttgcggattcaaagaaaccggtcttattgctacgagtctacgactagttgaactagtgtgcataagttttttgacaatgaacaaatttgatgtttgctcgtagttggggagtaaggataagcttagctccctagataacttatttcaaattaattacagggcaaacttttgaaaaattggaaggtaaagattaaattatgtgatttaagtttcagaagcatcaatgttctttatcaaattattggaaactacagatttacaattttgtatataaaattgtagatttttcgcttaagtagccgcaaaactatgggttttttaatctccaccgtagccttaaacactatttgacaagtaggtcccacctgtaattctttaaaaaaaatgtaggattttattgcagtacatgtttttgcatgtgggatccattagtcaagtaaatctgcatgcgaaaatggagcctaaagtttgtagttttcaataacgtaagcgtataatttgtaattctcaatacaaactttaaattcgtagtatcaccatgatttatgtgaagtatatgtagctttccaaaaaaaaaaaaaaagcgccagccccgttctaggctttcccattcgtaatgttcattgcctgaaagattggtcttaggaggggacggtttgagcaaaaacaatttcttctttttttcagaagtaaaaagatatcggaacaaccaatttggagcgattcatctgggactttatccatcaaaacatacatatcatcatctactagtaggactcaaataaattgttaatcatatcaagaaaatgatgacacatttggcctgagatcccaatgcttcgtgcagctactatgcaggggtgccgtcgttggttccaatgcgctgccggctatgaacacagccggcaaaacagtttcacctcatccttctgggttttggcacacacgaaatgcaaagcttgtaaggtgagcgtaactcaattggttactccgtttatttatattcaagttttagatgtgatatggatatatccgtattgtattaactttttattagtggtagacaacttacctgtcggtaccgatgtgcctcaatcgtacttacagagatagtgggatagggtgctggttcatttaggtgagtgcttgagtgcttcgtctttgctgtctttcaaaaaaaagattatatatagattttttttcttattgaactcttactaacaacatttagattttttttataccttctgttaatttaaatcaaacggttgagctcattagtaagaaaatattagtacgtgatgaagtagtgccctttgaaaaataatgcaaagctctgtcatctaaaaacaaatgcaatgcgttgatctgcaggcaggaacggcccatcagaacaagcacttgggctacgggcttatggcccactttgcgatgaacctgttggcctgtaagctgggcccactcgtccacagataagcgcagcagcaaagccacccggacaggttggcgacgcgacggcgacggcggcggcggccatcgctggcgctggccgccgatccgatgcgatccggcacggaactcggcgagcacccgctgcttttggttggatcgatggatggatggatcggcgacgaggaaaggcgagcgcccaccccgcgcgcgggagttcccaaatattccccctcctcctcctttcttcttttgatccgccgtgatcggctatctcgggatcgccgccggcgctgccgccgtcgcgcttttccttccccccaatcgatcgatcgatcgatcaggcgtgtggattctccaagaaagagagagagagggagggagcgaaagaaaggcgaaaacgcgaggccgagtctttgttggctttcgtcttttgtcacattctcccctaacctttcgctttccggtctttcgagatgaaaacaaatttgaaattactacatccgtcccaaaataagtaacgtccgtcttattaaaaaattttatgaaaaattttaaaaaaagttagtcacacataaagtattattcatattttatcatctaatatcaataaaaatagtaatcataaaaaaaatttaaataaaataaatggttaaatgttgaacatgaatagtgtaaaactgcacttatattgggacgaagggagtactacgcaacggatgcagcccggccaggcagccagccatcgacctgtccattcgcagtcgcaggctcgcagcttaccattgcagtcactaaattcagtgttactactaccaactaattacctcctcttgtactaatccgctcttcgagttgacatgttttttttcataatgaaattcattctcacctttactaaaccaactacaatcaattattatagatttatagggtttgctccctcaaaaaaaatattataaaattaaaaactactcaaaatatcatttcggagacaaagatggataatttccaccaatagttggcgtcttggtgagacgtaaccattatttctttttagggcctattcggtttgaagaaatttcatggaatgtttgaacaaattaaactatatccttgtaaaaattatgtgaaattcctacatttcgacattttgaagaagcccttaatggcttacatgtagagcatccccaggagttacaccatctagtactccatctgaaatatggcgcatgtgagcaaaaaagggcctccaacagatatgtcatcgagccatccataaatagcgcatgccaaaatgaagatagaaatgccacatatagagcatctctctcatcgtatcatatcacaacagccacagatcccgccaccttctgaagttccgcgacctcccccccctccccctcatcggcggtcggaaggagagggaggaaaggggaggcaccgccacaccggtcaccgccaccgtctccgtctcctcctccgcgcctgccgcccgtcgcccctgcaaagaaaataatagagaatagtctgggtggaatagagaagagcctagaaaagctatagttgttcaacacatcaaattgataaaaatggttcactcatttcaaatatagcaattaaaaaatttcctattacaaatatacccatttcaaaagattatcacaataaataacaccgttaattttagtcgtcgaaaatatagcccgtaaaaaatataaatgtatgattatttggaagatattactaaaatatagaagtgtgtgacataaagaatgtatggatgaaccgttgaggtggaaagggatatgaaggagaaatcttttttggatggttattcatatggtaatgggtatatgaaggatcgaatttggatgagctgttggggatagtcttatatatagtttttgtctttatcaagcaggagcataatcttcgaattaaatccatagccgatcattataccgatcgaatttcacatatatcatcagccacaactgacgacgaacaaataggtagataatggcagagagtaactaggatgaaactggtacggatatttttttccattcagacattttttgggatcggataggtttggttggatattttcggatttgtcggagatacagacccggggtatgcgaagtgagaggaatttaccttcccatcctgccgcgtgaccctacagtctggccctacccccgcaccccgcagatcgcaggagcggctggggggcctcggggtgccacgtcatacccctcgggctctcgcaccgctttgccccgaggccctcgcccagccgccatctggcgggggagcaagcggggaggggggccaggctgaaccacctttaatgcgcgcagtgccccaactgccccctgccgcattcaacgcagtaggggcagacgtgcggcgtgctcgactggcacgcgacggtcaggaatgaccgatctgtgaccagcctgtcgccggtcacatctgactggatggacggtcgtgcccccacatcgtatctgcctccggcggagtggaggtaggtgtgacccgtcccatcggaggggtcattcgaagttctccccacgagagggcggccaccacaagtcttcacccattaattggggaatgacagggttgtcccccttgtcaggcgagggacggtgctgggccccactcaaggacaaactgtggcttagcttccaggcgaaggcacgggtcgagacccggtcaaggtagggtgggcccccatccgagagaagagtaggtagaggcggtacatgtggtattcccttgaggtataaaatgaggaccttgcccactaagaaaggggacgactctcataaaacctgagctctaggagaaaggaagcaagagcgctctccggatcttagggacctttgtaactctcagcctaaatcccatacacaggagtagggtattatgctttatagtggcccgaacctttataattttgttgtgtacacactagctagtagccttgggggcggatacgtgattttcagaggcgggccttttcccccggccaaactcacgaaagggggatcccacgatctcctgctagagaggatcactcctcgacaggattcgaaaacgaattcagatatttttttctcgaaaatagaaaccagtacagtataagggcactatccattagaatcggagaacggtcggaaactatctgggatttttttatgatttccgcaaacaatgattaatttttttaaaaaaaacacgtatttatacataaatttttcatacggagtcaaatgaaatttaactttatatcaaaattatagagctcgatgagatctataactgtgttgctaataattttattatttgagatcatttaaggctctaaatattcattataaaatatcatatatgtttttacaaaatttcatatctacaattcaagcaacatccgacggagatgcgtgctctatatcaaaattgtagaactcaatgggatctaccactatgtagtttatgacatttgtgtttgaaaatattaaaagtataaaacaaattttacaaaaattgaagatgtgaaataaaataaatagcatcttcaatctatacaacaagaacataatattccatccgtcctaaaatataagaacctaggaccggatgggacatttcctattactacgaatctgaacaggcagcctatccagattcatagtactaggaaatgtcccatcctatctaagcttcttatattttgggacggatggagtaagtgatatgttaagtaagctacctccgtcacatattacttgtcgctttgactttttgtttgcaacatttgactattcgttttatttaaaaaattagtgtaaatataaaaaatgataagttatacttaaagtacttttgataataaaacaagtcacaaacaaaataaatagtaattcatattttttctgaataagacgaatgatcaaacattacaaataaaaactcaaagcgacaaataatatgggacggatgtagtatacatgaagtaggcgatcttgggactagaaagtggataatcatatttacatacggatctcttagaaaacggccatgaaaattgatttttcacatacggttatgggatcgcctacaaaattgacaatataaattttagagatattgacctaaaataacaagcgatatctcttgcttgattaacgaagctcaatttgagaggcttttatatcccggcaaatatacgttactgtattcattctgtttcatattccctctgtatctatattcgttaatattcgattctattttcgtatccaagttttcgattttgaaaaaaaaaagaatacgatagaacagtttccgtccattttgtatctgttttcatccacaggagtaactcggcttcaaatagttacccgtccaaatcctgccactagctccaaaggcaacatcggaaacgcaaaggcaaccatatgtttcagatgttcttgtttttttttccttttctttttcccctcattcttaataaagagaaagaagagatcaaaagagccatgattcgcaggcaggcaacggcggcatcatttcgcttcgttcccaagctgtcagctgccacggcgcgtagcatggacatgccatgattcgtcgattccttcttcgccctgatgatgatgatgatttctcgtgcggaagcaccagcaagccaagcaagcaagcaagaagacagagcgtgtgcatcgcctgtcaaatctctccctctcaacccctccatcgcttttggctttccttcctttttagggaaagaaacgctaatggttttctccctgtggtgtctgctgataatcctgctaggcgatgcgtcagcttttcgctttgtggtacggttgcttgccaatgtggttgagtttttgtgttaaaatttcatattactatctctatcccaaaatatattccatccgttctaaaatatagcatatattcgagatttatttttaaaatataataaatctcaaccaacaatctcttcccaatatcttcacttctaaatcaattacaaccttctcctatttaattctacatactttcttaatactatgcacgaccctagaaatgcttatagtctaggataagtagtaaggataagtagtaagaatttctagagtcagtcacagttattaagaaagtatgcataatttaacgggcaaaggttgtgattgcctgaaaagtaaaggtcggtgaggaaattgaatggtggagaattgtgattggttaggtagataatgttggtggaaaagttgttatttttaaggcaaattctgaacctaaaagttgttatatttaagaacgtagggagtaccagatacaacaatgttgaagtttgaagatcggtgtagttttatgagaaagaaacttacattagtcgtaagtttttttccccttatggtcttgattgctccaagattcatacatcttcggatagcatcatctcaagttctcaacaacaaggcctcctttgaaatggaaaattttcataaaaagattgagaaaaaaagttaatcaattcctatgaaaatttagaaaaactaaatgtttcgaaggattcctgagatgggaaactccttcctttatcgaatagatgtattgtgtgactaaaaacaaccaacacattactaaagaaatctatacaaaagaatgacccacaattattttacaaatggatttagtgagatcatgcaggtggactttgaaaagaaatttagtgagattagtgatatgtccactgattttcttctcttagagtgtggtgttttatgtgtagtgtgtgcacgcaaatgtgtatatgtcgtgtaaacgttaaaagaaatgcattggcatgcttataaaaagacctacaaattgattgtgttaacacagagtacaaagtaccaattatatagctacaattacatgtacacacctcctcaaaaccttggaaaagggaatgaaaaggaacaccatagtactattactatcggactatttttacagtgagccccctcagcttctaccaaattactagacagccctactccagctccgacaaggagcatggccgtacggacggcggcggccaatgtcgcggcggatcccaactccggtggtcccgtacaccggcagctcgtccccgtaggagccgtcgcgaccacccgccggagcaatggccgcgaggctgtcgagctcgaacaggtccgagctcgcgtcgctgctctcctcacctccgtcgtcggtgtcggcctccacctccatgaccggaattcggcggcagccggcgacggccgcggccaccgcgaccttgccgtcgatgtccaggaaccggacggtcctgctccggctcggccgcgccctcgccgtggtggtggtggtggggggggtgcgcggcgtcttggcgtggcaggggcggcgcgcgtacgacgacgacgacgacggtggcgccgtcgagcacgcgggctccgggtagtccggcgaacacgccgggcgctgcgcggatggacgcttgccggagaagatggagttgagcaagctggcgagccgcgcgccgggcgacgccggcctgcggcacgcgcgggccgaggcggagcccggcttcgtcttcgccgtcttctccacatccggctgctcatgccgctgcttccgcgcgaccgccgcgccgtctcccgcgccaccggcggcggaggtgcggatggggcggagccggcgaagcgagtactccacctcggacgacgagaagtagcccctcccggggcaatccgccgtggaacccagcgccggcgccgccctgtagctggcggccagcgacggcttgtagcagtagtagtagtggtagctgttcgccgcctcctgcctcttcttggccgccgcactcgccgcgtttcttgtccggccgtcctcgccgccctcgtccatggagtcgcagatggcgtcgagcagcgtcgacgagaacgacggctggtcaggcgcccgccgcctcgccctccccctccccctcgccgccggcgccggcgccgcccacctcatctccatgtcgcgcatggcgcagaaacagagcagaacgcaatggcgatggcgatggcaatggcaatggcgcgcgtgattcgattcgatggtggagtggagtggagtggagagtggagtggcgggcgggcgtgcgggggtgggaggggggatcttgttgccggggggcggggggcggggcccgcgccatctcggtgtcgcgcgcgcgatcgctgtctgtccgttcttccgttccacgcctcgtgctccttccatctctccacctcgccgtctcactctcactcactcggcggccgctttatttgttagctttttgctttgtcggcgccggcacgaggatggccgtacctgtgtcccctgccgctctcacgtctcactgttgctgcttacttgcctcgccgtttttagtttttaccgccatgggcgccggcgggatgatcatgggctgctgcctaacgggttgggctgtttcggacgtgggtgatgttgggttggggctttgttctttgtgtttaggaaaaagtacaccgaagttccctcaacttgtcaccgagataaaaaaacgtcctcgaactgcaaaaccagatatcgagggtcccttaacttactaaaaccggtcgcaagtggtcccaaggcagtatttcacatggttttatcctacgtggcgctggttttgtccaccgtggcgctttgaccttggtcttcgttgctgagtcaccagcgccacgcgaagctggtgggacggagtggggcagcgatgagcggacgcgtgggcagagtggcggcacccgaagccggcggggcggtgaaaccaagcggaggacgccagcctcatcgtcgtcatctttcggcttagggaggaggcgcgggagctggagcctgaggaggggctccgctagaagccgctgctgtagaaccgggagcgcatcatctcgagctccagctccgacgccgcctcggccgcgtcagtttcgccgcgcccccactccgccgccgacgccaccttgtcgtccatcatatcgaacgttgacgcggccgcgatcatcgccttggcgctccccgacagcgactcgtctggggcggccctcctgcagccccaccgccccctgcggcggcctcggctcttgcgccgccgcttcatgacccgccgcatgacaccagcggggagcctgacgatgacgagcagcaggatcgccgctcccttcctcctcctcctcctcctcttctctctctctcttgtctgggcagggcggccagcagcggtccacttcgtcctcgacctcgccggcggcggtgagctgttctccttgccagcggtggcaggggcaggagcgagagatgacgagctcgaggaggatggagaaggcagtggagcggcaccgcccgggccgctgcttcccccgccgccggcgcccgcccgcgcgccgctcctccccccgccgcttgcacccgccgaccgtcccccgtgcagctgcttcccccgcttgcgcacgccagcaaccacctccgcctccggcactgaagccgccattgtcgtcgtctacttgtcttcatccacccccaaaccgtcgtcgcgcctagacgtgcgccgccgtgtagccacccctttcccctcgggcgctgatcgccgcgccgcgccgatgcgcccgaccatcgcccaagcggagccgacgccgccgcttgcgccccctccaattggccccctgaccttctccttccggcaccactcccttccctccctccctcctctgcccggcgccgccctgattcctcccctctgcgccgcctcccggtcgccctaccaagacgccgcgccgcgcaacctttctcctcctgcgcgcggctcctgcacgcaaccgcgccgccaccaggctctctctccctgccgccaagctctcccccttccgccggccccctcttccccaccgccgccggccatcacctgcgtcgtcggcgcccatcctttgctgcgcgcgcgtgacggcgtgcgtgaggagggaaaaaaggcagagagagaaagagaacggcgaagagaagaaaccgtgagaaagagacaaaattaaaagagaaagaaaagaaaaaggaagtgggaccccctgactcctcctccccgtgaagccataaagggagagagatgtgacgtggcaacctgacacgtggggcccacgctaactcagctgcgacgtagcataaaaccgggctcaaaaccaccgaatgacctattgtgaccggttttggtaagttaagggaccctcgatatctggttttgcggttcgaggacgtttttttatctcggtgacaagttgagggaccttctgtgtactttttccttgtgtttatttgtgggtcataatggctcagtaatgtccaatacgagttgtttgcaaatggaataagtttgatttaggtccatgatattgacgtcgggtttgaattacatccttcaacaaaaataccagatataacgtggctctcaacttgtaaaaccggtgtacctcgaggtcccaaagtagtatagtgcccggttttaactgacgtggcaagttgactccaatcaaacctggttgagttggcatggcccccacatgtcaccaagcctcctctattcctcctctctccccctctcccccactctcctctcttcccccatctctctaccagctaggaggcctacagtgggtgccgcccaactagaagaggagcaacggccatggcggagcttgtcaacgagacgcaacatctccatctccttattgaactcctcctacacaatatcggtcttccgccacccttctactccgttgcggccgctatccctctcctcgtcgggttggatgtactccaaacttgccgaactacaggaaccattcagagacttcctcatgtgtacacgggtgagcatgtccgggtaggaatacaacgcagacataggccaacaaagggaggatatggacatgtcctgtgtcacgaagaggaatcccccaagctcctcatcttcggtgtgcgctttgctcgcccgcgtgcactcgtcgagcatgcacactagcatgtttggtggtgagcgacggctcaccctccctcgggaccctcgctgaggccgccgatgccgaagcagacaacaacacccctcacgtgcctctgtcaccgacatcttcatcgccacctcgctgctaagcacatctgcctctaatgattgcatcgtttcgctggtgccgcttccctagctcccgccatagggctggattcggtgctccgaggaagctcgacttgcaccttggaggctaattagccatcgctaccaccacctagtggtcggcgggcatggaggtgcccctgtacacctttgcatccacactcacca

SEQ ID NO: 19701 - DNA, 5622 bp, Oryza sativa
gggactaaagatcgatctttagtcccgggtatttgaaccgggactaaagataacgatctttagtcccggattggtagtcccggtttaaaaaccgggactacaggggggttacgaaccgggactaaaaagcacttctccaccagtgtccgcatcatgatgtcctcctcctcgctcaccaccaaactcgatggcactgtctctaccctttcccctctggtcgttgcctgtctcccagcttggaaagagatggggaagtgaggggagagggaagaatagaggaacatgggttggtttgtgacatgtgggcgcatacgagtcccatgctgactcgtcgtgttgactagagttaaatcgctacgtcaatcaaaaccaggcactatactgctatggaatcttaggtacaccggtttttcaggttaagaaaaatgttgtatctggtgttgcgattttttaggatataattcaaacttgacgtcaagatgagggatctacaaggaaattattcctttgcaaatagcaatctccttggggcaagggatgcataggatatccaagcaagagtagtataactgggcttggtttatgtagaatgactggtgcagtgacgctgaacaaatggtcctgatttattttttactgtcagttacctatatttatgcaagatatgtacataaggtgtataagcataaacttacatgatatggaaatacaatactaaatgtacaacgaatttaaatgcattgtattggaatcggtctagattgataaaataattgataagtaaaaaagaacaactgacaaatacataaccatgtaaaaaagtagtaggacgatccagttgcgtaactacatctactattaatttggtcatggacaatcaaagtacgccaattaatagtcggcaatagtcctgaacaatcgaagtacatcaattaatagtcgacaaattagattcactgtacctatgatattcccttcaagcttttttttaataggaaaaagaaacgctgaaaacaatacgtgttgttctatcagaagaaatgtgatggcgacctgaggccactgctaaggggaaacaaactccaaaaacataaactgatataaacactaccagtagtaacagatatttagatttgtagccccaaaatatatcactaggggtgtgtttaattttcacaaaattagaagtttgatttaaattggaacgatgcgatggaaaagttggaagtttatatgtgtagaaaagttttgatcagggccggccctggccctatgcagccgaggcgaccgtcgggggcccatgatggtggggggcccatgatagtggggggaccaatacctaatactagtagtctagtatctgtctatggcctatctggaagcagaaacgccgaaacgagaggagttggagtgttgtcgccttatcgcccaatctgagacactattgatcttaataccgttattgatggttttgcatcaagaaatgcccgaagaagtatcttttcatgagaagcaatggatatgatggggttcttttcttcattaaggtgatgattagttccaaggtataaatatattgttgttttggttgactttatttctcgataattaccagacatattaaatttaatatatgaaagtatttattttcgttttgcaaataaaattagcgtctatatatatcataaaattttatatatatagcttatagggcccatcgcgataagttcgcctagggccctcaaaatcataggaccggctctgttttgatgtgatggaaaagttgaaagtttgaagaaaaacatttagatatgctcttgtctatatttattgtatcaggaaacgtcacaactttttatgggcggaggggtagctagctaaccgatagtgtttttattttaattgtcatataattggttgatatcaataaaactattcctacattagtatatttgtatattgtaattgtaagtttgtaaccggacagagcatctgaccgaaggcatcgatccgggcaccccacactggctgtggcagcctaacaattggtggagaatttgtgtctgaaattacgatcatgtccctgcgtgatgagacgacgatgcaaagcagcaaaggtgcaggccgccgaggaggcgacaaagcacgcaggcacgtggaccaccgcacactggagaatcagcggctgcacgatctgaatctgagatccagccaaactgtcagtctccatctcaaatctcatctcgtgatccatcgtgcgatcataattaagtacgttaatctaatctatcaatacattactccattatacatatgctcccagctggcctagctcttggccttttttatacaagtcaggtgcaaagcgcgcgctcactcagcacatatcattcatgggtagagtagtagtcaatgtctacacgtctacactgatgaacacatgacaaagtttggttttgctctaaaacacttaaaatattttgtttttctttgttgatggacacttataacataagaacaatgtttttgaactcacaaggagaaatgaaaaatagccattgctgagggagctagttcacggtcgcggcgcagtagactcgcatgagaccggtagagcggtctcggagtaggcatgctctaggtgacgaagcaagtgtgagaaacaacaagatggataaccccttagcatgtgttttgttcaagagtttggatagatcgggttagctaggttaaatccatttatcagaatgttaggtttggggatatgcaagataagcgttggaggattaccctttatcgggtgctgaagatgatgttgctggggttactcagaactgcacgatacagctctgtgttcatgaaaagaaaaggatagcatcaatatattctgcagtgctacatacaatccatctccttcttatatatactactgatcctcatattttatcccaagaaatatatacaaaatccggatgaacagggttctaagaaaaaactctgccaacttagcttgggtcttgttttgatcgcctgacacccatggatttgtttaccccattttcgacactgtgcagatcagatcccaacaaatgcatgccattcaggagtacgatctctacttaaacaaaaggaaaaaatcaggatcggagctgtattgctgtccgggtttgtctgtttctctgatgctgcgttcgatcggctcgcgtggatagaaattttcagcccattcaaaacgagagtactcactagcgcataattaattaaatattaataattataaaactgaaaaacgatctatttaaattttttaaacaacttgtacataattttttttaaaaaaatatatcatttaacaatttaaaaagcgtaatggaaaatgagaaatttgaattttggatttggagtaaagaactgggcctagtataattcgtttatagctctatgagttcaggtcagctattgggttaccgttcattcaaacctggaagacattttgatctcttcaggaaatttataatcttcctatctaatctgaattagcatcacactcaacttggttgcatttgatgcggtctttgccttctgaacagggtacacggtaagcactaggctttggctttggatggtgcccacctggcccagcccacttgtaccaccggatctaaatccaacggaccagattggattggattggattggaccagtagggtacagtacttaactgaaatgtgggggtgaaagtggttaagacagatcaccagatcctccggtccatgctggtggggcctaggaagcaggcgtgtgtatcgagctgactgagctgtgggccccatggcttagatgctattgctgcaaggtgataaacccataagcacagtcaacttcgcttaagttaagggaggctaaagcaacaagagatacgctaactcggcattttctgatgaaacccaaatatctatggcagtgtttggcaaatagaaaagggaaataatttttcatccatctttaaattctaagcatcaattattccattttcatttaatcctaaccttttattcatttcctaatcccaattccgccccccatttcccattatccaaacacacctcatataatcaaaagaaaaaaaaacatattgcctactccatctcaatttgaagctgcctactccatcttaatttggagctatgttaaaaaaaagagagatagatttgtagggagaattatccctccaaacattttttaagaagaaattatgagcatgttgagaattgaacacatgacgttagaattaaaaccacataccccttaccaccgcactatcaaatgcatctatagaaacattccatgtccatatatatccacaaaatctacgaacaaattggtaaggtctactcatagaacatttcacatttacaactttagtcattgattgttgcagtcaacatcctgccatacgggcagtgacttgaggcagggtagagatagggcttgcgcaccaacaaacctcaacactatatttgccactgcatgctcttcagttatgactggtagttcgttttggttaggatcaaaacttgtcatgaccaggaaactagggaggatatatcgtagcaggattgtgttcctatatatataagacccgtccgatctcgttaaatcatatgaaactcttacataggatcgggatattaccgaaattaaaataaatactaggatcaatatcgttccttgtttgctacgaaaatactacgatacatatcatacatatcaaagatactgacaaccttaagattgaggacagagctcttgcaacgccccctactcgtgcaatctacatcccttctggtagaggcggagccagctctcggacaagtcaggtagtcgcccaggcttgtccgcttgtgtctttactacagataaccatcaatgtctgagagaattggttgatcgtcaaaaaacggtacccccctcgttcgaaaatataagcatttttagcatagtgcaaagtcaatttttttaactttaactgttaataacaaaaaaacaaacaagatcaataatgtaaaatcgatgttactagatttatcgttaaacaagctatcataatatgcaacattttttatttaaaatattttatttttatagatatgttggtcaaataagcatctcgaagactgtgttgaattctttaaaaaatggttatattttagaacggatggagtattatggcttgtttggatcctccgagctattaaatagccctctggatccaaacaggcctatatagcgcatctgtgcttcgggatcctgctggctcatccactgccttccggcgaacttcggcaggcgacggagctacggagtagctagctagcagctgccgctctccggccggccgggcggcgacagaacacgcatgcacgtggaactataaataaagccggcgacgatctgaatctgagatccagacaaatggatgaacaggcatcacctcgtctcacgtctcgtgcagatccgtcgctgagatcaatatacgttgcctagctagtggctaatatttaatttaatctagtgtctaatactccctccgtttcaaattgtttgacgccgttgactttt

SEQ ID NO: 19702 - DNA, 13126 bp, Oryza sativa
tgattcattgttaaatatatttttatgtaggtatataattgtacatattttataaaagtttttgaataagacgaacggtcaaacatgtactaaaaagtcaacggtgtcaaacatttcgaaacggagggagtatttaatttaatcagtgattgtaatttagtcagtatgatcgatcaggcatgttatcttatctgtccggactttgtcaggtattattttggtttcctaataaaataaatgtattattggttcaggtaattcgatgatctcatcccctccgtccaggcaggagatgattatacacgcgtgcatgtctagaatatctcgccattttattatatatatttctcatccgcacgtaaaatgggcaaaatgttttttttgtgcatgtgtgatgtgaaatatgtagttgttggacatcattattgttaattaaaacgatcaaaacataaagcagaaacattttagtagttgagatgagatatttggagtcatcaaaaagagaaaaaaaaacgtgatgcatgtattggttcgataatttaactattttgattctcttatttataatcgtcgtttagcaatttgttctataatcctattattgttatcagtcttgttaatgtgatcattaaaaaaatttctaatcctctctttcatctccagttctccactggagcaaagcatataaataatatcccctgatcgggccactgtcttctgtctcaccatccgcccttcatatggtaggtagttgatcatgcatggggtaaggtgagttgaccacattcaccattagagcaagtttaatagtatagtcaactataagttccaaatcccatctatagtcaattcatatagtagttatctataaatatatactacactattaatacatggtcccacatatcatacatacatggtgtctgagagtctatgctgtagctggctgtaaatctgtagccctctcatcttctctctcctcttttatattttcgatatgagtttatagctgacttatagtagggtcatcaccacatgataatatttttcatcttgtcagtaaaaaaactaaatttgccgcgaaaccatgcattagcaatgaccttgcacttaggcttgcgatctccgaagccacccattgtgcttcttatatggcttaacttctttcttgaattttgttcggttaatcccgccctcaaagggattgagggcttatttcgcggtagtctttctccaattagacttcccaaataaaactctccaaacacccatatagctagctctataattggtttcgcaagccaaacttgttgctcactccaacaaactgttcctctactttctctactctgaatttatgacactaaggccttgttcgatcttccattttagagatagattgttgatacacgcaaaacgagaaacctcattagcatatgattaattaagtattaactattataaattaaaaaaaatagatttatttttttagcaacttttttaaaaaacacaccatttaactagttgaaagaaaaacgacgaaattgtagtttggagttgaagaatagaacagggcctaagacccatatgttagcctctaccctctcccccctctttctcctctttctccctctctccctcttctctcactggggccatcccagagctcctcccggcccactccctctccgcagcgatgatgtccgtgcgaaggtggatggtggtggaggatccttgagtgcgaggtaggggtggctgacgccgaagaaagggaggtcgtcgcccgtgctatggcagcatcattggggcgacaatgagcgggaggccacggcggtgaggaggcacgtggaggctgtggctacggagtcaagggagaggccactgtgacagagtcgagagagaggcgctctcgacggtgccggttccgccgctcaccttcccgagttgcaacctttaacattgctctcgaatggaggaagaaagtgaatatgaggtagtgggacccacagaaggtgtgtggattgtaagtggagtaagttggccaagtttgacgagttaaggagtttggccggccgaatagtttggagagtgtgatggagagactatatgaatgcgattttttttatccacaagtgctaatttttgtcttttaaagtgggatgaagatgctctaacttaaaaatacatttttgcgagacaaatcgataaagctttttttaaaaaaattttgacgaagggagtatattacttatggcacatttcaaatttaacgaaaatggagaacaaacttccgctgcgcacaaaatgtgcttctcttagttcatgaccaacaatatccctaaatgaaacccaattctaaaattgaggtttattttgtgaaaagcttactcaacaactcccctagagatgtatcaaaaaattagaatcctcttctcctcctttctcgctctccacaagtcgagagatactctcgctccaaatttccgcatggcgaaaggagtgggtgacaagtggagagatcgtgtgcgtgggaggcgatgggcagagcaattttttttcgtatctgttggtagttagggggtggttccattttttattattagaagttagtttacaccttaaaatcaaactagaaattcaaaaacataattttagagataaatttttaggtatatcttgggcatattaaatatttaggtatatcttgggcatattctttggtactccctctgtcatattttaagtgcagccatgattttccgtgcacaactttaactgtccgtcttatttatttttttaaaaaaaattaaaatcataagtgacgtaaaagtactattcatatttgggtgaatagctaattaagtccctcaagtttcaccgaaggctcaatttggtccttcacgtttcattttatccacatagctcctctaaatatttgttttggcttgacatcatacttgggcccacttaatatgccatatggctatttttaagtcaatatttctattagaaaatatcccttttgcccttaatttatatacaactatatactaaaagggagaaaaccaagatgaataaacaacattgcatatatacttcccattatttcaatatgtgcacatgaaacttaagcaattactatcgtatacacttgctagtacataatttattttcgttttacataatttactaaacattatcttaaaaaaataaagcatacaaattttctcttatatatgtgaatgatgggggtataagtgtcatttatcaagagagttgttggtttaaggataagtttgaactaaaataaaaacttgaatgagtaatatggatagactgaaacattaagaactaaactgagctttggatgaaacttggaggaccactttagctattcacccttcatattttatcatcttataataataaaaatactaattataaaaaaatttaaataaaacggacgataaaaattagacgcaaaaacttataactgcacttgaagacaggggagtaccggagtgccatttaaaattgggaaaacggaaaagtgaaatattgagctgaatttccgggcgctggggagtaggggggtcaaaagagtcatttccgcgtatttctcgcccgttcgccatctcttgtcgtgtagtaccgccgaaaaggaatttccctttccgcccctgcgctgtgcgctccactccactacttgagtcccccatccccagactccgccaccaccacctccggctccccaccccgaccagcggcgccagagcagaggcagtgaggccgagctcctcgcctcgcctcgccgtctccgcccgcgcggcgctgccgccgagccgccgccggcctcctcctcctcctccttcccggttcggatcgggcccaaggtatatgccactcgtcttctctccctcctccccgccgcttcatgagccaccggagattgccttgaggggatttcttcccgctcggatcgacggatccagtcccgtttcttccgggttcttgcggtgtagagtcgtagtcgtagtggtagtgttggtagcggcttgtttttcgagggagggatttgggggggtttggttggttcgggttcttggggagggtttagctgaacccgtgaggtttctgaggtccccgcctgaacagatctgtggtgtctccgtgtgggagcatgttttgctgcgtgcgtgcgtgcgtgcatgctagccatggattggtgctcacgccgcatgcgtgagctttggggggggggggggggttcagttgttgttggattatgtgagcgagaacgcatgatacgatgcaatgccgcggtcctttttgttgtgatgggcagcctcacagcatgcgtgctgcggcattcacatggacgtcgacaccgtgtcgattctttttgtgtctcttgttgtgttgtgaaatttttcatgaatggtgcaaggtggcggttggtcttggatgtggatgttgagctgggaggatcagttatcctacaaattgcatcttagtagtacatatgttgacatggcattactgattcaccctcctttttttgcttctgcatgtcattgccctgttaccccttaaaataggttctattatggtatacctatccagtgtgcaagaatgatatgcctttgacattgttgcgtcatctttacttggtactttagatggtaaaatggaagtgtgatggatgtaactgtgtcaatacagcggagaagatattaatcaataatcatgtacatttgttgtttttggcatcttctcatgtaaaatcttttgggtctgttcttgttatgtgcttcactttcacttttactgttttttttttaattttcaagaaacatacagcttcagtgtggtgattgataaaaatcattactctaactaattctgttttctcctcgaactgttctgttcctagagccggactgcagccatggcagatctgcaggagcccctcgttcgtccgaagaggaagaaggttttggtggactacttggtaaagttccgatggattctggtgatctttgtggtgctccccatttccgctctgatctacttcaatatctatttgggcgatgtctggtctgccatgaaatctgagaaacgtcgccagaaggaacatgatgacaatgtgcaaaaagttgtgaagcggctcaagcagaggaacccaaagaaggatggccttgtttgcacagctaggaagccctggattgctgttggcatgcgcaatgtagactacaagcgtgctaggcattttgaggttgacctttccgccttcaggaacattcttgagattgacagagagagaatggttgccaaggttgagcctcttgtcaacatgggccagataaccagagctacatgcccaatgaaccttgcccttgcagttgttgctgagcttgatgaccttactgttgggggactgatcaatgggtatggtattgaagggagctctcacctctatggtcttttctctgacactgttgtcgccgtggaagttgttcttgcagacggtcgagttgttagagccactaaggataatgagtactctgaccttttctatggcattccctggtcccagggaacacttgggtttcttgtttccgctgagatcaaactcattcccatcaaggaatacatgaggctcacatatactccagttaaagggtcactgaaggagatagcacaaggttattgtgattcgtttgcaccacgagatggtgatcctgcaaaggtcccagacttcgttgagggaatggtgtacacagaaaatgagggtgtcatgatgactggtgtttatgcttccaaagaagaggcaaagaagaagggcaataagatcaactgtgtcgggtggtggttcaagccttggttttaccaacatgctcagacagcactcaagaagggtgagtttgtggagtacattccaacaagagagtactaccaccgtcacacccggtgtctgtactgggaggggaagctgatcttgccattcggcgaccaattctggttcaggttcctcttgggctggctgatgccaccaaaggtgtctctgctcaaggccacacagggtgaatctatcaggaattactaccatgacaaccatgtgattcaagacatgctggttcccttgtacaaagttggagatgctcttgagtttgttcacaaggaaatggaggtgtgtttcacttcggatcgaatatttgatgtttaagtatcaaatatgcatttaaaacgaggcttttcaattatataactacttctagaaatgaatattccatgccataaattgttatgcttgcacatgcattctattacttatatctttgggcttgatgtaagttcacctaactattcttgtgcctgtaccaactattttagtgtactgcaatctactgctgcttacagttcactaataatttctgttattaggtttatccactgtggctgtgcccgcaccggctctacaagctccctgtgaaaaccatggtgtacccagagcctggctttgagcaccaccacaggcaaggtgacactagctatgcccagatgttcaccgatgttggtgtgtactatgctcctggtgctgtcctgaggggcgaggagttcaatggcgctctagctgtccacaggctggagcagtggctgattgagaaccacagctaccagccacagtacgctgtatctgagctcaacgagaaggacttctggaggatgtttgatgcttctcactacgagcattgccgccaaaagtatggtgccgtcggtacctttatgagcgtctactacaagtccaagaagggaaggaagactgagaaggaggtgcaggaagccgaggccgccatcctcgagccagcctacgctgatgaggcgtaatttcgttgagacctttgatggtttagtcgtccgggttttctccccattccaaatgggatttttcatctgaactatccttttgcttagaacttgatgtgcagtgtttgtagcactttgtaatcctgtcatcgtcgtccgtctgctcttggtacttctttcacccttgatcaagttgctgaacttagtcaggacttaagtggtatttaacccaagatctgaataattttgtggctactggactagttaatttcctcagctattaatttgagctgtagcatcagatgaggtgaactttagcaattgagctgctgtttctggtgtgtcattattcgtcaagaaccttttctgttcattttaatatacttgaactgatcaccagtcactatcgcactatcgatattgatcatgaaaagcaagatcttgaggaaaattgagtgatggggttggggccaaaattgtgggtcgttgcaaaggagtactgtttgatccacaagaggataagagatgatttgagggaaacaggagaacagtgttgcagacgtgaatgggatgcatgtgctaccggttatgttctgttacatagaagatggtacatgtaccaccgctttgaggctcttttcttccccttgtaattcgtggtggggttgaattgattcctgtagaaaataaacgctgctcaccctttcgtttaattctcccaccaagtggattgaacgggatttgaagagaaataataacacacatcttcctcaattctctccaatctctttcttacgacaatgccttatgagatacaatggcgttctcttttgaaacaaggggatttctgattcatgtgacgaggtctctgtatcggagtcctaaccattggtgatggaagggacaagaaataattcttcatatatataagaaaaaaagagaatataagtggttccttttctttatatatgaaattcgattatttcatttgtgttcgcgtttgagattttagttgtgacttgtgagagaggccccagtcatctccattccttaggggttccccaattacacatcaaccacagctcattccttttctccaatcataaataaactataatctctatatttttctttcatccccattctcttctttctaattaaaatagaaacggcttgaaccatactcttagtatttttaaagttctacattcaattagggaggtagagcttggatatggatttttcagaacttccgcttggaggaaatggacgcttgattgcataatttgattgcatccaacaaattttagtaggccatgagtaccttttctttataggaaaagctctccttttgccattccttgaataccgtattatctctttcaccatcattttcttaacttctttctttcgccactattaagtggctattcagttctcttttgcgaccacaacctaaaaaattcctttctttcctttcttttttttttcagaatattatctttggtcaaagtcagttgaccattgcatatatttctcctaaaagaccattatgttctcatgtaactaaaaattataaggatattctacaaatcaaggaaaacatgattattaatttagtttttaatggatgagtaaacactttatgatatgaaaatttttagttagtttgcaatgtctccattcatagcttaaatgaaatatttcagatgaaaatatctcgtatatccacatatatgtattgcagaactatgaataataacaatgaaatagcaactataaattattttatgaaatatttaaaaccaaaaaatttccatgttgcttttttttaaagttaatcccaattagtttttctaaaaaaacatatttcaagtgcccaaaatttgtttccttgatatttttgtggcattcgctaaagtttcaagcgttattttgttttggaacatctttaaaagaaaaatggtcttccaaaaaaaaaggcagcctaggaggagatgtgacctcacagtcaggtgtcatcgacaagacgaagataacaaaacaaaagcgcactaccggaagaagagtaaaagagaaaaaatgacgacattaatttgagagaatatggtttcaaccgaaccacgaaaattgaaaaaagaaaaaaaattctcttctttgtatcgtgtggacaattataaccttatagcatttttgattggactccaactttaaattttaacttaagagtttagatttagagtgaaattgtgaagcagactaaacccagttttatttctgcagttcattttatgagagcattcttgctagctccacttctattttacgtgaaatcgaaacattttggctgaaaaaaagaaattgtttggctgtgggctctacctcaggagagatgtgtagcttagagctcggaggtcggcgtgccagccaaacaggaccttgaaaccaaaattattaaaatccggtgtaatacgccctctcgcaaatcccatccgttgctccgtaaacggacggccaggattcaaccacggcaaacgaagcctcgcctttatgaaacgagagaacgcaccacccatctctctccacctcctcctcctccctctttctccgcgagagagaggccgagcagcgaccgcggcggcgctctcccccctcccgccgcctccacccaccccgtgctcgccggcggggcgaagcctccggtgacaatccccgatccgatcgccgcgctcctctcctctacccccatcccctcctcctccgacgcctccgcccgcccgccgccgtacccgtaccaaccggaaagcgcagctgatccggtacgaaaccctagctgatccccgatctggtgcgcgcgcgagcgcgcgagatcttctggtgggtttgcggttggtgattggcctctctctctcttttaccctagtcgatctccccgttcgtccccttgacctcgagttcgaccgccgcgcgccgatctccaatcccgcgcgagcagcgggcgtctgtgcttccgcgcggaatcctcccgcgccggtgaccatccgtacgaaatcgcacgtccttctcatccctaggcacgcttttcggtcacctcgaatttgcgttaaccctggcttctcttgtagatctggaagctttttctatatgcctttaccatactagtaacaacagacactttgttccctcacaaaattcatagctagtgctggcttactgcaagacgtacccatattatgagattgtttccaaaaatccaaattactgtgattgcaataatgtaaataaggagccatatcagaaattttcatcgaaactgactggccatttcggacgcgaattcgagggcctatagctgcttctgccttgcaacggggaggagcatacgattgattggaaattgatgtggttgcgagaacgtaaatgagtaaccatgtgggaagtttttactgaaaatgtttgagcataagtatattttggctgcgtggtgtctcttggtggcagtcttgagcttatctgcagtagcttatcctttgaagctgaattgttgtcaatatgttaagataccagctgattaatttgttgttgtcaaaacctgctttggtccattcacaccatgtgctttaaccttttatctcataggttttactgagaaggccaaagtaaacagtgtgcattttcctgttcagctgtttctattcatcgtttgttcttattcctatcacttaccaaacatgtcaattttagatggatctcaaggatagcctctccaaatttaagcagcagcaagagaggtgccaatcatctttggccagcatagctgcatcgacctcaaaaccaaagcacagggcccaaccggttaatgctccatccgctccagcaaggccactacaacctattaagttttcaaatgatacagaaaggctacaacacatcaattcagttaggaaatctcctattggagcacagatcaaacttgtcattgaattgctgtacaaggtaaatctcactaagctacaaccttgtttcattttcctttccataatagtataaacaggaatgttcccccagttctggtatgtaatgtcttccaatgatcctgcaagtcaccatgttgattgagtttatatgccagtaaatgccaatggttctgtataatctgttaccatattagaatattatgcccttgattagtacttctttttttttttggatcaatggagcctgaattgttaacatattatatgagagtgcataagacgtttaccttttgctttgttctgttatttatcattgtttcacaccccttggtgcatgcaagatactcagccagcaaattcagatatgcaaaatttggtgccttgctgcttattctgtgttcaacaatgatgtgcatgttgatatctggttaaagatacaaggatgcattgacaataactattataagcaatatgtgaagtacacatttaatttgtattaatgctgcatacagtggtgcagccaggattatatgctcaggaagaaaatttgtaagggacaacccatacaacttgtagctacaaaagttgttaaaagtaacttatgtaatttatagaatcacagtattaaagagcactatgatgatttccgcgctggtccattttctgcattttagttatagttgtcaaaatggtttaccaatgtcttcatgaatgatagcaaaacaaatgttttgtgaacttccttataaatagcaatgctgtattgcgtattgttgttgtaactgagatgtcttcaaaatctgcagacaagacaagcttttactgcggagcaaataaatgaaacaacttatgttgatatccatgggaataagtctgtctttgacagtctgaggaacaatcctaaagtacattatgatgggagacgtttctcttacaaggtaaagaagtttgttattccagtaactactagtcttgctaacatcaatacttgtttcattggtatatttacccaattgtctatccttcctacctgaaataatattaatggctctcatcctatgttccccactaaacataattaattcagaagtattgcttaatgccttaatatcatattgcatttcgactattaatcactggtgtggcaagctaaacctgtcatgaccatggaatttgtaattgataatgaaatgtttttctttaatgcttgtttcggggaaaatgatataatgatgacaattatttatgggagaacatcagaaatgtttagtcttaagtttacataggcttcccatcttgtttgaagttgatttacttctacggtttcacgcgttaatcattgttgataaacgtgcagtccaagcatgatttgaagggaaaagatcaactacttgttttggtaagaaagtatccggagggtcttgctgtggtggaagtcaaggatgcgtacccaactgtaatggaagatttgcaggtgagccaaatttcttacattatgctttgaggcgatgtcttagatattactgttcttcaacgctcaccattttagtttttaattggatccttttttgtcctccctaagatgctgaatacttttctcctttcctcccctgagtttctggaatatcacactgagggtgtgctcatttcagtagttaggatgggctgattaaccgcacgtaaaacgagaaatgtgattaacatatgattaattaagtattaatatataaatttttgatgaataaatttgttggatttttttaaacaacttctttatagaaagttttcgcacgaaatagaccgtttagtagtttgaaaagcgtgctaacggaaaacgaggagaatctaatcctataagctgaaacgagcgcatcctgagtacagttaatggtagtacaagactggatttatctgccaattattgctttacgtccattcttttggtaaaattcaattggcatgatacagttgaaatatacttacgccccttacagaaagttattttaggtcctatgtcttttcaatgtgtatccatcatgaaaatgatgtctgtgtgaactccagaaatttccttgcaatagtaaaacagaaatgtataatattgggagttcagccctgcaagatctttgtccataaagctgtccatagatgcatttttaaaaacatttcttgtactcttcatttgtgccattattagatacttttggccttatttgcactatgtaggcgtattgtcccgacacagattagagccatgcaaatctagtagtcaaaatgtgcgt

SEQ ID NO: 19703 - DNA, 1797 bp, Oryza sativa
gcaagttgtttcttttgaatgttgaagtatctaaaagaaagatcaaatgatttccttgtttcaatctgcaacatttcataattgaaggaatcaaatgctacggatgcaatttgtttgctggtagttctcgttcagattataagtaagacgttttgagctgaatgttattatattcaaatgttcaggatttgttaagactattcaatttcctttttttttcttaagatgaatgaactattcaattgttgaggtctgggtatagtaatggagcatgatttaatcaatcctaatctctccattcatatgaccctatagttaccctagtggaagaatgggccgtatctaccacaacatctcatggttatatggcaatgtgtctacggccgttagatttggacttacctccaaatcggcgcccgatcctctaaagaaaatcggttggtcaaaagttacggttgaccaccagtgaaacattaagttatatatggtaaaacaaaaataatcagtcactggagcatttaaaaaatttgtgaaacacggtgaaacatgttactatcgcttatgaaatattgagtattaacggactgaaacatatgttgttgtgaagttttaattataacaaatacaacagtgctatcttgttgtgaagttttaattataacaaatacaacagtgctatcttgttgtgaagttttaattataacaaatacaacagtgctatcggatcgtagattagataagtagtttatgggaaaaaaatcattttgaaggttgctaaatacatgcatgcatggttagagagtaggggcaaggagttaaataaattttgtgaaacacagtgaattcacactttgaaatatgtcgctatcacatatgaaacattaaattttaacggtctgaaccatatatattttttttatcaaaatataatcatgtgatatcttattgtaaagatttaatcgcaacaaattcaatggtacgatcggatcgtaaatcggatataagcagtctaggagaaaaaaaatttaaagtgatgagaaaaaagaaaaagaaactagttggtactcattttgcatgcatgcagcagtagcaaggaggccgattttttctcttcaaatcaagctactgagcatgaggattctcgtttagattttgccaccataaaaccaatctccacaatgaagaaaccctccaactggaggacctaaatacatactctctccgtacttgtaaatgaaatcgttttggacagcgacacggtctccaaaacacaactttgacttcttgtttctgtaaaaatatttattaaaaagtgatatatgtatacttttatgaaagtatttttcaagacaaatctattcatataatttttatattttcaaactcaacaaattgagacttattcatgatttatattttcaaggtttgacttaaacattgtcctaaacgacttcttttacgaatacggagggagtacttgggtgtagttctttctcaatcccacattcacacgggtaaaagtgcacatgatgggtaacctagagccccagatccacaaaaagcaagacaaaatgccggtgtgccaagtaacattttactgtatatgaaataagggttatttattgggttggttacaggtgtaggtcctacaaaaccatacccacacccgtttatgcacttggtgctattgttttctcgttaacaggtaaatgggtgggtggattaatcaatccccatttcctgatggggtaattattcactaagttcctgggtagccacttgtcctgctaggggaag

SEQ ID NO: 19704 - DNA, 566 bp, Oryza sativa
cgggactaaagatcaacataagctttactcccggttggagttaccaaccgggactaaagatgtatttttagtcccggttggtaataccaaccgggagtaaagattcccatgctatccccgcctttaagtccccttttttttctctcctctttaagtctctcggtatccgcctccagcgcctcctcgatatcctcttcctcccctggcccttccccttcctccttcccctctctgctccccctttctatccccgcctcctcctcctccttcccctctctactgcggccgggcggcggcgacggaacgaggtggcggcgacggagcgaggcgactgcgcggcggcggctggtggggccgcggctgtgcggcggcggtggagcgaggcggccgcgcggcggcggcggagcgaagcggccgcgcggcaggcggccgtgcgacggcggccgatggggccgcggccggcggccggcaacagcggcagtcaacattgtttttttatttgtgattcactgtgatgtacttttgtatggacaatattgtgattcattgtacatttgtatggatct

SEQ ID NO: 19705 - DNA, 22130 bp, Oryza sativa
  unsure (1)..(22130): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtgtcagttacattatgttcaaactgttttttatggcaaatttacaattatagtttttttagttgcagatccacgatacctgttcaatccagtggcaaatatgcaattgacccttccgaataacaattttgttttagaaaagtttatgaaatatatctaacgaattgatgatatcgtgatatatagaacttttcaagccaaatttgatttcctttgtattaaaactaagtatttgagaaattattaatggtcagaattttaaaagttctctcaaatctttatgaccagacccttacgagaaataatttttagtggtctggtcatagatttttagtggaatttttagagctctagaaataattttaaccaattaaaattgagcacaagcaatatttaatcccaggaaaattcatttccttcttttttttctttttcccttcttctctttcgaatgggccgccggcccattctctcttctctccccctccccgctaggctggccgaaggccacggcccagccagccgcccgagccctggggcccacctgtcgggcccgtctcccacctccagccggcgccgccgtgccccgcaaccgccgccgcgccccgctcccgtgacttccgggccacgtcgccctcgcgcccgcgtcccccgcgcccactccccctctctcccgcccgcgcccgcgctcgagacggccgggattcaatttttgaatcccgcctctctctcctccccacctctccccactccgccaacgaaatcgcggtctcctggccacgatcgaccctcgtgggtctatataaagcaccaccgttctgtaacgccccgattttcgttcgggttttaaaatcatttaataatacattttctagaaattaaataaaagttaaatcaatttaatcaagtaaaataatgggagaatttgaaattttcctttaaaaatcattggtcgggaatattttgtaatattctttgtgccctaatgtactctccggaattttccgtgaattttcggagctcgagaaatagttttaatagcacaaagatcattacatcaattaaaataaaaaaagaaaaacaaataaaatcctccttcctctctttgggcccctttcagcccaatcccccttttctctccctctcgggccggccttctccctcggcccgctcggctctctctctccctcaagtctgctttacctccctcgcccgttttcccctctctctctccccgacaggtgggacccgaggccccacctgtcatcttcttccccaacctcccgtcgccccaaccgccgccatggccgccggattcgccccacgacgccgcggctcccgcgccccaccccgccccatgagtgcgtgaaaacgatccccttcacctcctccacctttccccccactctccccgcgaaaatcggcgccggttaacccctccaccaccccacgtcggcgccccacttcgccggccgattccgccacgtccggcctcgatcccgccttcccgagcccataaaaagcacccccgtgctcccctcgtccatttccccttgtttcccgaacccggcactctctccctcgctctccccacgccgctcccgcgcgccgccacacttcggcgaactccggccgccgtttcccgtcactagggtcgccgccacactgctccgccgccaccgccagctttgccaccggccgggcaagctcggccaccgctccatttcccccctccacctccgtagcgccgtagccacgcgaaccacctctctccgccgccgccgccgactccagccgcgtcgcgccgccgcttcggtcgacgccgacccgcgccgttgcaatgtttgctttgtatgtcgctagattccggttcctccgacgctccggtgtacttcgaaatagtcgccgaggttcctccagcagcagagcaaggcaagtcatgcttgtcacttgaacatgttgaacctatattgcaaatgctctattgtttttcttcaaatattgcatggttttataatgttactatggggtgtttaccaattgtcatagccatgctattgttgtaccatgtccctttgtcagcttgggggttataacatgactagagattggactagggattgcttagccatgcttagttcaactagtgcacaatggggaaaatcctattaatgtttagactgttggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttagcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcacaacgtgggatagcgttggacagcggatgattaatagtaattaattgttacaactgtttaaatctgtcaacttctgtttattaatgctcgctttatgcaaatgaaccactctagctctcctttgataattccctacatcatacccctattccggtgtgacttgctgagtacagtgggtagtactcagtcttgctctatttttcccaaccccagagcacgagtatgggtcagatgaaggtttctctgaggagtaggcttcgtccgtgccgtcgaggatgcctgtggagtggtgttcccgctgcagttctagtcaaggcttagctcctgttgtcttccgtttttccgctgcatttatgtaagacttttatgatgtttgtaagacgtggacctgaatgtcaacattgtcgtttgtgtaccccggccggtcctggacggggaatttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttctgggaaaattgggatctgttcttgtggttcaaggggaaaaatcttggtcgctcgtttaagtgagatttgtcaaaacaagtcagtctagggttttagtaaaactattgagatttattcgtcagtcagttgggatttgatgggtgaaatgcattaggtcctagctcaggaacatgggttgcaaggtatttatgctcttattgttattattagtatgtatctaatttcccatttattttatcattatgtgagtctgtcttctttattcgctctcatgcaaaatgatctatgcataaaatttcgctcttattcgattctcttatttgagtcttttattgctttatttaaatttggatttgagcatgcattgaccctactcctttgtcttctctagatggccggccacccacccaaccaccgcggagaaggcatgattgactttgtggcagagttggcacgtatgacgctggtggtgggctaccccaacgcgccagagtacacgactgttccaccgctcagtggcgagcttcctcaccgtgttcgcctggaggtccacggctacgtgggtacctgcctagctaatatggtggttgaggcatccggaggcacagcagatcacgcctgtcaggaggcagcatacctgatgatggccagactacgggagcgccacaactacatcttccacgacacggcgtaccgatttcaccctcgtcgagccagcggtgatgatgtcagtactttccgtccgacagccggcgagaacgacactacttttggtcacatgtgtgctgtgatgaggggattggataggatgcactcggacctgcacaaggcgtccaaggccttgaatgatgggaagctcatgaggatcgtcgctctgaaggacgcgatagcgcgcctgaagagggagaatgctcagttaaagggtcttcccgcgccaggaggagtccggatccgcactacgccccgcaagaagacgactgcacccgtgcgcatccagcttgcgcccaggaacccacctccgcccgcagttcccgcacctccagttccgcccgcagctccggcagttcctgcagctccagcaccagctccagctcccgttcacgtgtcagctcccgcgtccgctctctccttcgctctagcatcagccgccaggggtccagccagtggcaacggaggttggttgtccgctactcccagtggcagccgcgatctcagcagcagtagctccagtggctcagagtcgggcagcggcgagacttatctgccaggctccaggagtcgctcagagggacctggtgacgagcaggaggacgccttcgactccaccgaccgcaggagccgttccgagcattaggcccgttttccattagtttatcgacttgctagcttctgcttgttagtttgtgtgtttaggttgcttgcttggggtcagtcgacggtcgatatcatgtgcctatgatatggctgtcttaataaggatttttgcttgctttttaagtgttttaattcagatcagaacaattgcagtttaaattcctttataataaagcttagttcctgagcatctgtttttcttcttttcccccgtatgctcttcctcaagatggtctacaccaggaatggtagccgcgcaacaggcgagggcaacaacggcgaagagcgcactgagggtgtgcatcccaacagcaattccggcaatggtccgccaccacttcccgagaatccgacgctagcccaagtgatggcacatcagactcagatgatggcagccatgatgcagcagatgcagcagcagcaccagcagatgcaccagcggatgctgcagcacgctgaacagcagcatcagctgtttggtccccctccccctcagtccaagttgccagagtttctacgtgtcaggccacccaccttctccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccgccaggcactgaagtcacttgggcagagttctgtcgtagcttcaggaaggcgtaggtgccagacggggtcgtggcacaaaagaagagagaattccgagcactccatcagggtaacatgactgtgacggagtatctccatgagttcaatcgcctcgcgcgatatgcaccggaggatgtccgtactgacgccgagaagcaggaaaaattcctagcaggtctggatgatgagctaaccaaccagttgatatctggagattacgccaatttcgaaaggctggtggacaaggcaatccgtcaggaggatcaacgcaacaagatggacaggaagaggaaggccgctcagttcagggcacctcagggaagtcaccagaggccgcgcttcgctcccgggcagcagggtggacctaccaccatgatcgtccgccagtaccgcccgttcaaccctagcaattttccccagggcgccagtggcagtcagaaccaccatggaggtcagcccaaccgcggtgcagctccacgcccaccaacggcaccggcacagtcaggcctgtccgcgcaagccaagaaggagactggagcaaaaccagggtcctgcttcaactgtggcgagcttggccacttcgctgacaaatgcccgaagcctaggcgtgccgggccaaggtttatccaggctcgtgtcaaccacgcatctgcggaggaggcacaagcagcaccagaggttgtactgggtacgtttcctgttaactcaatccctgcaacagtactttttgattctggtgcaacgcatttgttcatttcaaagaagtttgtcgggatgcatgggttaaggaaagaagagcttagcacaccaatgagggttcatgccccgggaaatagttcaacctcagtcagttttagcccttcagtgctaatagaaatccaaagatcaccatttctagccaacctcattcttctcaaatccaaagacctagatgtcattcttgggatggattggttaacccagttcaagggagtcattgattgtgcgaatcgcacagtcaccttgaccaacgagaagggagaaacagtagtgtacaaatcaccagactcaccaaagcaaggggtctccttgaatcagattgaagcggaaatcccagtggtcaccgtggaaaagaatttgaggaaattggaagatatccccatagtctgcgagtatccagaagtgttccccgaagacctcactaccatgccacccaagagagagattgaattccggattgacttggcaccgggaaccgctccaatttacaagagaccgtacagaatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaagtcacaatcaagaacaaatatcctttgccgcgaatcgatgatttgtttgatcaactgaaaggagctaaagtgttttctaagatagacctgcgatcaggctaccaccagttgagaattcgggaagaggatattccaaagacggccttcaccactcggtacgggctatatgagtgcacggttatgtctttcggacttaccaacgcacctgcatttttcatgaatctgatgaacaaagtgttcatggaatttctggacaagtttgttgtggtattcatcgacgacatacttatctattcaaagtccgaagaagaacatgagcaacatctccgtctggtactcgagaagttgaaggagcaccagctatatgctaagttcagcaagtgtgacttctggttgacggaagtcaagtttctggggcatgtcattacagctcagggtgtggcagttgatccatcgaacgtggagtcagttaccaaatggaccccacctaagaccatgtcgcagattcggagttttcttggacttgcgggttattaccgccgattcattgaaaacttctccaggatcgcccgtcctatgactcagttgcttaagaaagatgagaagtttaaatggacagctgagtgcgataagagttttgaggagctcaagaagaaattagtatccgcaccagttttgattctgcccgaccagatgaaagacttccaagtctattgcgatgcatcccgtcacggacttggatgtgtcctgatgcaagagggcagagtggttgcgtatgcctcgcggcagttgcgtccacacgaagggaattatccaacccatgacctggaattggcagcagtggttcatgctttgaagatctggaggcactatctgattggcaaccgctgcgaagtatatacggaccataagagtttgaaatacatcttcacccaaccggacctaaatctccgacaacgaagatggttggaactaatcaaagactatgacatgaacattcactaccacccgggtaaagccaatgtggtggcagatgcattaagcaggaaaagttactgcactgccctatgcatcgagggcatgtgtgagaaattgcagcaggagttggagcgtctcaacgtgggaattgttgaacacgggttcgtagccgctctggaagcacggcctacgctcgtcgatcaagttagagccgctcaagtgaatgatgccgaaatagcagagctgaaaaagaacatgagagtcggaaaggctcgggatttccttgaggatgaacacggcacaatctggttgggagaaagattgtgtgtacctgacgacaaggaactgaaggatctgatactcaccgaggctcatcagacccagtactccattcatccaggcagcaccaaaatgtattaagacctcaaagaaaagttttggtgggtcagcatgaggagagaaatagctgaattcgtcgcactctgcgatgtttgccaacgagtgaaggtagagcaccaaagaccagcaggtttactccaacctcttcaaatcccggaatggaaatgggaggagatcggaatggactttataacaggattgccccggacatcatcgggtcacgattcaatctgggtagtcgtggatcgactcactaaggttgctcacttcataccagtacataccacgtatacgagcaaaaggttggcagagctctacctctcgagaatcatgtgtctacatggagtacccaaaaagattgtatctgaccgagggagtcagttcacctcaaaattttggcagaagctgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaaacttgccatatgcggaattctcttacaacaacagctaccaggccagtctacagatggcaccgttcgaagcattatacggccggaagtgccgcacacctctcttctgggatcagacaggcgagcgtcaactgttcgggacagaggtattagcggaagcagaagagaaagtcagaattatcagggaaaggttgaggattgcccagtctcgacagaagagctacgcggacaaccgccgaagggagctcacttttgaagcaggggattacgtgtatcttcgtgtcactccgctccggggagtgcaccgttttcaaaccaaaggcaagttggcagcacgtttcgtgggaccctacaaaatcttggaacgaaggggagaagttgcttatcagctagaacttccatccaatatgatcggcatccatgacgtgttccacgtgtcccaattaaagaagtgcttaagggtacccgaagaacaggccttttcggagcacatcgatctctaggaggatctgacctacgtggagaagccggttcgtatacttgataccagcgaaagaagaaccagaaacaaggtcaccaggttttgccgagttcagtggagtcaccattcagaggaggaagcaacctgggaaagggaagatgagttgaaagccgcccatccgcacctcttcgccagctcctccgaatctcggggtcgagattccgtttaagggggataggtttgtcacaccccaaagttctcctcccaagcctaaagtttaatttataagcgaccctaagaaaataccagtgcaaagcaagagtaaacccttttaaatcaatgcaaataataatcggaagtggcatgtggaattttttcttgagttctacatgtcgaaatccactaacaggatttttagtggaattttcagagccctagaaataattttaaccaattaaaattgagcaagcaatattttaattccaggaaaatccttttctttttttctttttctttttcccttccccttccgaatgggccgccggcccattctctccgttttctccccctcctccctgctgggccggccgcaggccgaggcccagccaggccgccccttcctccctctcccgagccactgaccggtggggcccgtttgccggcgccgcgccccgccttgatgacgtcagccctgggaattattgcgcaataaattatttaaggactttttgttatagtaataaacacagtgaatcttctaaaattcataactaattcatccgagttccgtttaagccaattcaagtctcagtaaatcaagaaaaatgtgtagaatccattaaaaatggttttgttccctgttttagtagtcttatagcctgtttgcaatgtttgctttgtatgtcgctagattctggttcctccgacgctccggtgtacttcgaaatagtcgccgaggttcctccagcagcagagcaaggcaagtcatgcttgtcacttgaacatgttgatcctatattggaaatgtcgtggtgacatgtcggcgcacggaaacgtgtcgtggggctatgtcttgtgggtacagttgtacacctctgatcagagtaaaactattcgaatagccgtgcccgcggttatgggcggtcaaccagattcaccgtgattagtctcaccctagtataatcttttgaatttggatagtttaggtggatggttgggcctgtcgcaacgtgggatagcgttggacagcagatgattaatagtaattaattgttacaactgtttaaatctgtcaacttctgtttattaatgctcgctttatgcatatgaactactctagctctcctttgataattccctgcatcatacccctattccggtgtgacttgctgagtacagtgggtagtactcagtcttgctctatttttcccaaccccagagcacgagtatgggtcagatgaaggtttctccgaggagtaggcttcgtccatgccgtcgaggatgcctgtggagtggtgttcccgctgcagttctagtcaaggcttagctcctgttgtcttccgtttttccgctgcatttatgtaagacttttatgatgtttgtaagacgtggacctgaatgtcaacattgtcgtttgtgtaccccgacctgtcctggacggggaatttaatgcacattctgcttggaattctattcgggaatttctgggtgtgacagagctcctccttcctcggtcgccgatcgaggccgagcccgtccgccccatcccgagcgacgcccgtcgccggagctccgtcgcgtcgtcttcctgaggagccccgccgccaccgttccttgccgtcggccgccccttcgccgtcgtgcatctcggtgagcactcccctccctctctcttttcctccccttcgtcagccgcctccaggtcgtcctcgcgacgcgctgccaccatcggtggccgtccgaccgggtcgctgccgccgcgctccgcgctccgtgcccgcgccgttgccggtggtgccgggcagacggttgccgcctcccccttgccgcgccgcgccgctgctctcgcgtgcgccgctttcgcccgcgggagctgtcgccggccgtcgccgcgggtggccgcgccgccgcgcgccgtcgtttggccagccgactttgtgccgtgctgtgccccagccgcgccgcccctggcagcctgatcggcttgggccgatccggaccgtcggttcccgtggaccggcggtggaccgcctcggtggtcccggtccacggtggaccggcgcccttgtgccgctgaccggtggggcccgcttgccggagccgcccctcccctttgatgacgtcagcaaccctcttttcctttggaaaaataaataataattgcgtcataattcgttaataattctagaaattcatttaaatgtctcaaaacttctaaaattcatatctaattcattcaaactccgaattgagccattcaacttgcaaaattcatctaaaattgagctctacatgtttgtttactttttatgtactgtttccttggtttttattagagtttttccttgttttgcgtgctagcgtgtagaatccgtcgtttcggaagtccgcagtcgcgaggaaaagagtccggaagattgttttgaagaagcaaggcaagtcacacattccccttgagcatgttgatcccaatttataaatgttttaccggttacaaataaatatgcatgttttgctaattacatgggatcagggtttacctatctgctcgcttgtgccatgtttacttgatatctgtcctttgtcaaccgtgggtaataaatcgcctagcttgtgttactttgatgacctagctagaactatatgcttagccatgcttaattaccactagctcagtcgatgggataattgcagtattagacattctagtatcttgttgagctgcgtgctcgagacatctggccaagttctatggtcgtaattatccaactaaaatgtgactgaatggtgggctgtgggtgcatggttttgcgagtcgcacccatggcaattaaggaccggttcacgggaaaccctggaagacttacagtgcttaccacaagcgggagtgggtaactgcttgatctgaagtatagctcgaccctttcctaggcatcggtggcgagggtgggcgtgatggagttgggtcggccggggtgtccggttgtccagttgccggattcacctcggcgcaagaggggaccgcccactgccttttgaggggtgggggtgaaaccttagcgtggtgtggatggttaggggagggttatgcggagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtcccatcttaataaatcgacccaatgcactgtagtacaggtgggttggttgggcctgttcaacgtggtgtagcgttgatcagtggagatttaatgttactttagttactcaacagttttacggttttgctcaataaaatgttttacaaccgcctttatgcaaatagccacaaaccatccttgtatccccttgcacatctgcatcgttggtgtggcttgctgagtacggtggttgtactcagtcttgctattattccccttttttcagaagtgtagtgcttttgagctgaagacgaagttagaggaccaaggctcagaccccagttgagttttgcctgtggagtggagctgaagccccgctaggatcgccttttaccgctgctgctgctttcgtttcggtgcgaggactaagtgcctcttttgtaagtattttacgctttatttacgtttggaactgtatattacttgtcgttttgtgtaccctggctggtcctggacagggatttaatacgcaaaatagtctggaaatttgggttaaatttctgggcgtgacacgttccctcctctctctttttatttttgcaatcgcccgctcccgtgcactccaccgccttagcgccgtcgtcctcctctccgccgccgccgctgccgccgccgctccggtcgccactagccgccgtgccgagccgcaccgtcgacgtcgtcgcgttcgccgtcgtgcgagccgtcccgtccacccctcctccgtagtaatccgccgctagaaccccgcccgtgccacgcgccggtgagcttcgccatggccggcgccttcggtcgccgccctacccatccatggtttccctctccctctctaactcatctatcttctaccctatagttgaacaaatggtttcacttatcactcatcactcattctttcattcctcgtggaacggttcggatcatctctgtgtaaaatccaacgctcagatcctctccacctcgcacctctcaactgcgccccctcccccatcccagcccacgcctccccagccctaatctctcttctctccctctcatgcaacgccagcccgccaccgatctccaccatcacgccgcccctgccgcgattcacgtcgccgccgaccccagccgcccctctctccccgccgcgtgccgcccctctctccatcgccgtccgttgtccatccggatttctcgatcccatcgccgtccgttctccatccggtcgccattgcgccgccgtcgattcccgcctccagattgatgccgccggcgcaccctcgcgctgaccgcgttccgccatcggatcgctcgccgtcctgtctccaccgcgcagccatcaggtcgtcgtcaatcactcgttatccgatctcatcataggtaagtgttaagttaggtcaatgtgttagggccaactaatatttagattgattaaataccgacatattttccaatgcattcattgtgatctggagactattcagaaagaaataaatttaatgttatgcattatgtagaaaaacagggcatctgatagtttactctacttaggtgctgctgctgaattttattttgtaagcaattaacaatctgtgagatggggaaggaagttagcctagatcttactccttttcactaagatctaggctaatgttgatcacgaccaggcattattacaccacaaaaaaatacacaaaaagattactgctagcaccatgtgacaattccatgggctgtgcagcaggggagtcgttaaaccatcaggcttgccttggcgatcctgacctggagcgaggaagactgatgcagccattgccgccatcaccacctttggcacgcaaatggaacctatccaccatgccccttgactgcaaatttcagtatggatgtttcttactatatccgtctgatgacatggatttcttgaaaccccaaagaatgggtgcctttcagtatattccgattgtcaaacttttacataatgcaagtttgttatttcccacaagtgtagttgggacgattaaaaaaaagttaaaatccactgaaaatcaaagcatctctatggaatgtgtgtaggaaagtagtaattcagacaaaacgatagcttgcttatgagaaattcttattatgctgttgagctgcagtggtaaataatgtgttcagtccgttgttctcactgttctcactgtctttatcctgactgatatttcgtacaaatatacaactcgtcgccaaaactctcaaggtaagagacacgtatttcggcaatgacctgcattcattactcaaaagggagggatttgccatgatagcaagcaccgagcctagcctagagataacatattccagaaattacctgcaaaggagccgtctttggcttcctgccctccggctcggtggcgtagtagcatccgatccccctagcaggccagcccgctggatgcttaagcggtgagatgcggcgaaggagagcctgatgccgcctccacatcttggctgttgaacggaattatgttcaaattatgttatgtgtataatgcaagtactacttgtcagtcatttcatgcagaggatatttacctcaacaaaagctttgtagtaactcttaattgttgggttagagaagtcgtatttataggctaattgtcaaactaatgttttgtcattttttctgccgttatactaatttcagacctaccatgcattgaggcctaacatgcctgtatatacagaactatcatgtgtttactcaactgggaacacatgagtattggatcgtcaaatgcaattcacagagtattggatagtgcaatggataatcatatcttcaaattcatgaatcatatagagagaaaagaataaaattatgacaaatttatagccttttatatatgttacccttacgatttattcactgtttaagaatggaccgaggcgtatatcctcttcaaatagcaagctttcaagggatctgtttgtcaatatgaaatcaaagaagaaacaatgtttgttggtaagtaaatacactatgtttgcattgacaaggataaacttggagcaaacataactgtagttgctatgatccaaaattgttctctgtgcatcgggtacaatggagcaaacatgtttttcacttccttcgcaggataacatgacaagcaaaaggaatctcttcatatcattggacgatgacaagcaaaatgaagggttccggcttcaaggtttaagttgtgactaccttctcgtataattgttggatgtcatacttagagtgttatagatttcagattattgtcatagaacaaattaaatttcgtttacctcctttgtattccaagatttgtgaatatgccttctcctttatttatgaggccgtgcaaacatattctgaagatcaaaatgtcttgagttacagaaaactagccttgcactgaccatgactgctttaatggatcgatgatgatcgaactgtgatggtgtgtatgcaatatgttgccttgttattgatctgtagcaaacaatatgtgtttcactactggtcaaagatagtgatagttattacctgcacagtatttatatattgtacagaactacctactttggacttatttatgtgcgtacaacagattgtacagaacagattgacttatttatatagtgatagtttttttaatttttgcttgatcttataactatgcaatatagtcttgtatatatttttggttgtttgaattgtgttattaaatgtcactatagcgttagcaggttgcttgaattatgttattaaatgtcaccgtagcggtagcacgggcaaattactatcccttttgatcccttaggtggtcccggagctcgtctcgccgtcgccatcaccctctgtcgctcgccgtcgtcgatcgtcgtcggtgaggcccctcctcccctttctccctctctcccgcaccgcttagtcgctgcgccgccgccctctgccgtcggccggtcgccgcctcgcgccgccgcgggccatggccgccgggctggcttgagccgtgcccgtgcacgccggccgcgagccgcatccgccgtctgatctaccgagcggtagatcggggccatccgatcccgtcgcccgcgtggctgccatgaggccgccacgtgcgcgccacgtgtgcaccacgtggtgcaccgccccttttccccggtccatggacccgatccaccatggaccagcgcccgcagccactgccatgtggggcccgcatgtcggcgtcgcctctctctctctctcccgggatttatttattgcgcaataaataaattaaggatttttttctgttatagtaaaaatacagtgaatcttctaaaatcatatctaattcatccgagctccgtttaagcccattcaagtctcagtaatcaagaaaaatgtatagaatccattaaaaatggttttgttctctgtttcagtagtcttgtagcctgtttgtattgtttgctttctatgtcgtctagattccggctctcccgacgctccggtgtactttgaaatagtcgccgaggttcctccagtagcagagcaaggcaagtcatgcttgtcacttgaacatgttgatcctatattggaaatgctccattgttttccttcaaatactgcattgttttatactgttaccatgggatgtttacctactgttatagccatgctattttgtaccatgttcctttgttagcttgggatataacatgattagatattggactagggattgcttagccatgcttagttcaactagcacacaatgggggaaatcatattaatggatagacttcaggttctagtgttgatgttgggttagagccaccgtcctggtgtcgcttcattaaaatatgttaaatggtgggctgtgggtgcatggttttgctagtcgcgcccatggcacttaaggaccagttcgcgggaaaccctggaagaattcctcgtacttaccacaagccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgctcgctgccttgcgaggagtgggggtgaaacctgaggtgtagtgtgcttggttagagggggttatgcgaagggtcctatcacggcctctatccggtatgtcgtggtggcatgtcggcgcacgaaaacgtatcgtggggctgtgtcttgtgtgtacagttgtacacctctgataagagtaaaactattcgaatagccgtgcccgcggttatgggcggtcaaccagattcaccgtgattagattcaccctagtctagtctaatggaattgaatagtataggtggatggttgggcctgttgcaacatggtatagcgttggacagtggatgattaatattgattaattattataattgttttactgcttccaactactgtttataaatgctcgctttatgcaaatgaacctctataactatcccttgataattccctgcatcatacccctattccggtatgacttgctgagtacagtgggtagtactcagtcttgctctattttccccaaaccccagagtttgagtatgcgttagatggtggcttctccgaggagtaggcttcgtccgtgccgtcaaggatgcttgtggagtggtgatcccgctgcggtccaagtcatggcttagctccagttatcttttaattttccgttgcatttatgtaaggctttatgatgtttgtaagacgtggatctgtatgtcaattttgtcgtttgtgtaccccggccggtcctggacgggggttttaatgcacattctgcttggaatcctattcgggaatttctgggcgtgacagaggggttggcggccgccgcggcagcaatggagctgacgacgacgctgccggatctagcagctcctcccatcccctcccctccctttcctctccctctcctagatctagccggagggaggggcagcggccgccgcggcggcgacggcaggcgggcagcggcggagctgacgacgacgacgctgccggatctggcggcttctcgcctccccttccctcccctccctctccttctcccagatctagccgaatggagggggtggtggcccccgcggcaccgatggcaggcgggcggcggtggagctgacgacgatgaccgcgaccgcggtgacggggccgatggtggcggtggctatgtcgcgggaggggacggggccgatggtggctagggttccattgctagatgtgattttttttgtgcatgttgttccagatgatgcctatgttgtgatttgtatttcatgtttgatttgtgtaaatgatgtttgatctgtgtaaatgatttgtatttcaaatttcctctttgctggtggctagggcagctgcattgggtctttttttcttggcccaaaatagattttcgctggcggttgatgccgccagcaaaaatgaattatcgctggcagtcggtgtaagacatccgccagtgaaaatggatctttgctgccttgctggcggatggcttaagacggctactagtgaaattgaattatcgctagcagtcgataaccgccagcgaagatcttgtttttcacttgcctttgctttgtggtgtctccaaattccgctaacgaaaacccaaaatggccaccacgaaagatggttttcgtagtagtgtacaatatatcacaactaatacccaaaccccaatattaatttactctcacatcttctttcacttttcttagagattgtgtggaggttgccccttgcacgagatgtggctcattctctttctcctaacttctctccttcacctcatcgtataatcctatatacatgtagaggcttgtagtacttcgccctcacacgctcaagagatggcaaattggcaatccaatgataaatccttagacctcattaaattcctattgaacactcatccgtctgtgtgtaatcacgagcattaagattttaatatggttggtggctcatcactctactatgacacaattaacttagagacctaggctttgtttggaacaaatctttcccaagttctatctttttcttccacgcaatgctaagctgctaaatgatgggttttgaaaaaaaatataggaaagttactttaaaatataatattaatctattttaagttttaaaacaatacttacctcgttttccacgtcaataagatgggttcgaaacgtgcactctcgtactcagccttatcatgttaattttgtgttaatatattgtttgctaagagaattaatacttgctggcgaagaggcaacgcatcatcctttacaaaacagctagtgattctcgcaacagactgcatgctttcaactatttatctaataaacttgtccattcatcagaaaaaatagaagagaaaatcctttgccgggatctcggtagtggattgtgaatcatccatgtgtgggttcaactcccgtagttcgcccatcactttattttaaattccataaatataattttctatatacctaattatttttttattcatttattcatttattgaacatataagatataagtattgcatgccaaacaaatgaattttgcattactagaattaacccatgttttcttttttttaaaaaaaagtagagaatcaacccatgtgttttgtgcacaattcttgaattccaaactactagactttaaattaggcgtgacttttgactcgaacgcttcaattttcttaagataatggacgaaagtctgccttcaattcaacaaaagctacaaccaattattacataattattggcttaaagccccgaaacttagctaccataaaatgaaatggaagacaaataacaactccaccaaaagaagtgatataacttattcaaacaacaatcctattagaaaataggcatccaaagtcggcgaaaatttgcataattgtaatttctaaatttaggcatggattccttctcctcatcactcatttgtagatttgcccaaaatcaaagctaatatgtttctctaagagtaactgcatataagatttagttggagttttataaaaaaaattatatcattcctacttagccatagaacctaacataaagtagatgctcctacttatataattttttttgtttttgagtctatgtaaacaagccaatttaggggtggcaacggggcgggcgaactaggctggaacgcccccaccctcacaaaggcaatgagtgaaaaacatcacccacctccacccccgcacaggacccggcgggtgagcatggccccgcattgccaacataattataaatcacaaaaatagacctcaaattgcttctgatagcaattcagagagaggcgcggttgcgcggagaagggcggtgaacagcagggctgggtggtggagatggaggtggggcggtggccgtgacggtgatagcccctagcagtggtgatccagatccagaggccgacggaggagagtggcaccgcaggaaggaagcacatgcattctacccgagcgtaggtggagggcgacgacgttaggaaaggagacgatgaaagacgtgctagaggtggagagggcctgcaacagctgtggggaggtgacgaattaacgatggctaggggcggcgacggggctgccggggcagccgagctctgggcgaggtgcgcatgccctggctagacccgaatcccccattccctcctggagcagcgctccaacggctcgttggctggggtgggaagttggcgattgaatggtgtggaggaaattagggcatagttatatactccttcccttaatgggtcggctgggccttgaaataggctatcccggggccctgcgggtgaccagcgggtcaaacccctcccccatccccgtccctgcatatttgcgaggcccccagtccccactcagatgcagataaaaattcttacccgtcccctgctccaacatgaaaattgtcacccctaagccaattactctctccatcccaatcatctcataaggtttttaagattttctcaaattgattatcatctaagatgttctattagtttattcatgtagaaataaatagtatcattgcatatctgtgcaggattaaataacttttgcatccaattgctcgtttgtgtgcccacatg

SEQ ID NO: 19706 - DNA, 10710 bp, Oryza sativa
  unsure (1)..(10710): unsure at all n locations
gacacaaacaagcaatttgtatgagggaaattcattttctcacttgaaactaaaggagataaaaaaggggagtgccatgacaaacttacctgcaccatgtcccagcgaagtagttggcatggcaacagcaattagaaccactagcacagtcaccaagaggagagagtgagcagaggctagctcttggctttgttcatccctatttttcttagggcatgtttagttcgcgaaaagaaaatttttaggtatcatatcagatgtttgaccggatgttgaaagaggttttcggacacgaatgaaaaaactaatttcaaaactcacctggaaaccacgagacgaatcttttgagcctaattaatccgtcattagcatatgtgggttactgtagcacttatagctaatcatggactaattaagctcaaaagattcgtctcgcgatttccgttctaactgggcaattagtttttttaatctatatttaatacttcatacatgtgttaaagattcgatgtaatatttttgggaaaaaattttgggaaataaaccagtccttaatttcacctttgtatcttggatagccttatcttgctctctcttatattaacccttcaagaagctttctggatagatataggcccggtttagatccaaccccaaaattttatactctgtcacatcgaacgtttgaatatctgcatgaagtattaaatataggctaaaaaattaattgcacagattgcgactaatttgtgaaacgaatcttttaagcctaattgcttcatgatttgacaatgtggcgctacactaatcattttctaatgattgattaattaggcttaataaattcatctcgcggtttactgacagattctgtaattagttttttattagtgcccgatataatatccgatgtaacacgctaaaactttacgcccctgaatctaaacacccccatagtgtcaaaagataaaaaaggaaaaacttctactatatttggtcagggtctcaggtataggaacttccggtaagcactcaccaccatgtagaccttataagagagcaaatttaatagtacagcccactactagctccaattcatctatagccaatctaatagccaattcatacaatagttgcttactatactattaatatatggtcccacctgccatacacatattgagtcttggagtccgcgctgtagctggctacagatctgtagcccgctgcttttatctctcatcgtttatcttactaaaatatatttacagctggctaatagcctgttattgtacctgctctaagcactcagtgccatgtagaccttataaggttacactttgaccactgactgacttatcacttgatggcatcactaaaatttactgcttgtctaaaaagaagtcaaattctaacgatgaatctgaatttgcttgtctagattaatcatcaggattggacattttttagacagataaagtactttcacagcgcgtagtcctgtggtttttaaaattcttgattatttatgccaaatcaaactgtggtacatcgatttcgaaataaaagtgtcaaattttgtgctttaacgttactagaatgcagactcgattgattcctacttcgggattgtacggtgtttgcatttcaaaaataataaaaatccaacggttcataataaaaggtaccatctcaaaggtataggtagttaggttggtagagagggtaaatatattgctaggagatgtaaaaatatagaattgtctttagtgttagttgtaggttagatatgtaccgtgtaggtagtttatctctatctctaattctgttttacgttatttgcatggtttctcttatatttacattttgctcataagaaacacaaatcgattaaaataccactgaatgtttgtatgattgtttgaagatttaaattttatccaaaaaacgtgaaatcttgataaaatcacttctggacgaaaccacaattaataaactgaaatatgaatattttagtgttggacagcaagacctggctttaatccttaataaaaccatcttgccatctttctgcacataaatttggaaacaacctcctgattgaggtctatttatcggctggtatttgcatgtatacaatggttgagaagatttagattgtttggcatgctgtccgacctcgcgtggcagcttcccgtgttctgcaagctcgtccttgccaatcttgccatcctcctcggtgccggcatacaagcaaaacccacaaatcgaatatgcagcttatatcggtgatcgaacgtgcatggtgttgacgccggtgatacgatggagtagagcgatttggctttgtgagtggtgtaatctgatccaattccaatcgatgcatattttttattagctatttactccactgctatcggttacaataattcattcccataccttacccctctctcgatcaattgtctacatagctaaacttctcaatacctctatgtacctcgcaaacatggtaaaacttctcccaaattatatggtacagcctgcatacttcgtagtacagaaaacaaataacaagatgactcctgtcggctcgccaaattcatgtcttcgttttattcaaacacaactatatagaggtacatgcaccatataacacaaggtacaacattctctgaaagaacgtacgaattctcgtcacaattcagatgttggttaatctatacgtttacttgtcatagttctcgtggtacaaacgtatagctttatcacctaatagtgtaaccatatatggctcaaaatcccctgctggagcaaaggaagcgaaggccttgagcatagctttgtttttgcccaggtttcatggcgagagaggtgatagtggaggtgggcatggagatggaacattcggatcgtttgtgttgcacgcaggacctacggcctgagcatcttgttgcatggcagctgtggattgaactccatgtggatcacccaaagcacgcctccctggtggaaaaattcatgtgagcacaaaataatctacagatgagatgctcattatctgctcgatcatataagatgctttaaattaacaattgtcagttaactcaagtttatttttagaaggccagatgaggcgactctcgaagaaaaatttgctcttttttttttcaagatagtggaaatggtttacatctcccgtctttgccgtatcatgggacgttacggccggccaaagaaaattttgtttctaacctgaaattgaagaggaaaaaaaatatatatgtggggataaggatctcaactgtacctatactgagccccagcaaagctgttggcatagcaagaacaattagaactgctagcacagtcaccaagataagggagtgtgtagagaaccttcgcttgttcatctctgtttctcttttaacttcaccgttgtattttatctacccttcaccttatgcttagctggtttgttttagcttgccttcttgctatctcttataccgaccatccaaaggaattctctcaaaggataaggcgtaaaaaggagaagataatattctactagatgtggttaggagtagaaagcttctggcaagcactcactgtcagatgggccccctcatgcttattcgagtggcgcttcatcaactgtttacgcttgctgtgagatacgttgatgcagaaagcaacatgcagcattctgaagattgcaagtgcaatataatgtccaaacaaacaaggatgtatgtatatagtcaccaattttttgttactccgtcactagctaacaaatataaagcttcaaacgtccaatggacgaagaaaattaaactgcacataaatggtttgatcattggattaagaaatggtttcatttgatctttcgagaaatgctttcaaatttttcacacaaatatattcctttgaaatggacatgttgatgcgagtgaatctgccatccccagcacctcattacattgtttatttatatactactctcctactttctttcacaatatatatagggacaattgcatctatgcccctactttcgaattgctgttttacctccactttttagggtttacagttttactcctactttttaaatctgaatcagtagtgtacccccacttctaacagctggtattaacggtgttagttgtagaaaaaatgacatttatacccttggtggttattgcatttgtgccccattttttcagctttgtgtgattttacctctattttgtgatttcagcttgtgtgatgagcatttcgaccaaatatgagcatctcttgtgatgtttttgtactttaaaaaaatcacaaatactaggcaattacaaaatttgaccaaaattcagaaatactagccttcatggtcgatgctctggaccatgaagaggacgacgcaggcgttggtgaggaactgcagcggcgacgcgaggtagtcgaggcggagccgcatccaccaggcgtaggaggcggcgaagaggccgtcgatggcgaagagcgacaccacctcctcgaggtgccacccctggaggtaggcggctaccttgacggcgagcagcagcagggacaggatgaggaacacccggatgcagccgtaggagcgtgcccgcagcaccgtgctctctcccgctagccctcgacgcggtcgccgcctgccttggccatgcaaggactgcggccgccgcctgccatgctgcgcccccggcaacgcgtccatcgcctcccttcgccgcacttggccgccgcttgcctcgaataggtacggccaccgcacgcgggaagctctgcgaccgccgcttgcgtcgccagggaggggccaccgcgtgcgggaagccctgtgaccgccgccccgccgaatagttcgcctaaacctgtgatgtttagagttgtctagagggtttgctgaactgttagtcctttcttggtagaaatttgtggctatgcccaaacttgtaaggtggtccaaccccaaacaagaatttacggttgtgccattttataaaagctgggcctatcactagaacggataccctcatctcaatcgggcacagcgtccgtcacaggctagaagtcactaatgtgaagagttatctcaatcgggcaaacggtcgtcacggatgaatctatctcaatcgggccctaagtaaagcccgtcaccgatagctttgacctagacgatcagtcaaactatagcccattacagatgaccaatctcaatcgggccacaattagcgcccgtcacagatgactactaacctttatcgggcctaaactagagcccgtcacagatgatactcatctcaatcgggcctaaactagagcccgtcacagatgactgctgacctcaatcgggcctaaactagagcccgtcacagatgactactgacctcaatcgggcctaaactagagcccatcacagatgactatcatctcaatcgggcatttagctatggcccgtcacagatgactataatccacaaaaaaataaaatttgttttttggctagcctcaggcctttgctagctatgcccgctgcagaaatgacagaaacaaacacagatatccaatatccccagccccccagcatcacccattcatatacatatgcattcacatacacatacatcaatatatttcacacaaccacacattcacagccatctcatatttcacatccattcacatatttcacatccattcaaatatttatcatatttcacctgcaaaactgagttaattggatcaaatatttatttagcaagtcttaacataaacatatgaaatatatacataaatataagcatcacagttacatcatcacagttgcataataagtgttaatcattgcctaaacataaaagttcaacattgttcatcattttagtttaagcctaaacattcctttggggttaattatttcgcggaggatgaagctggctatctcctcgcgaacctcctcaaagctggtaggcagagacttggttattgtgccctacattgtcataattccagattaattgatcgatcatatataagtactaaaatgtagttagtctatcacaattgagaccaccgacctcaaactctgccaaagtcttcaccttttctctgtacagaaggcgcatattgtggcacacatggaatccgcactggtcacctatttgttgtttcaccgggaagtcttttttgtggataagggtgtcatgtcctgtcttcctgaggcctcctctttgcacgtattggacccacgcttcatctatcgctagttgaattggggtccaatcatatgcgttcttatcaattctagagttcaggtagtgacatgtactccacttaggtgttatgaccagaaggatccaatgggtactgcggcattaatatagtgaaagttaattaagtactgaaggaatgtttcatgctgttgtgtatatttagataacacacttactattgattataggcgcacataatgtactccttatctcggtgggaccacaaggtgtcgtagatgtagttgaccattccttgacggtcattctggagatttgtgacagtgaccacttatggatcaaggaaggcaacttccggtgcattcttctgacaccattgccaacttaacctacacacaggataaacgatcttgttagcgagttaatccgattgttattaccagattaagttgtgcgacaatacttacaaggagtagcacttaaggaggcttgtgtccaccgctcggagcctgtagaggtcgaatagatccttgaagtcgacaacgatataatttgttggaccaaggaatggctttccatcgtgctctccaaggatattggtagctttattcggcttcctggcgttagatttctccatgtagtatgcgtgaaggtccttgcaagcggtgcccattgcggcaagcacgtcatctccaaccaatggcatgcctagttggaactcctgtggagcgacgtatttcttcttgacctctttgcccttagcctcttcctggcccttgcccagatctagcttccttggagctagaagcgaggactgcacctttcctccccttcctctcccctttgcttcgggtttatcgagagtaattctctgaggggaagagtgtgccttcctgctcttcttcatcggtgggggttcatgaatcgccttgctgtcggcctccgttcggtcctcccaaaaatccgtgtcgtactgcaactgcatatcgtaagattatgcatgacgatcttgagcaggagcaggagggactgaaggagcagaggcgggtctctttggtggacgaccgcctggtgcagtggttggcctcactgtaatcctgatctcaatgaggtccttgggccattggatgaaggtaccacgggcatttcctagtgagaggacctcgtcattcggtggatactttagtgggaatagctcatattccagcttcaccgagtcgacttgaacttttgcacagtcgctcctgagttgcgctccatgcactcttgtctctggggtcggcttgtacgcaagtccctcggctgctggaaccgtgaaggtcggcatcaccctaactgtgagggtgcagctcgttggttcctgcgatagattaatcaatttttttagaatattatatatcatatggattcgttaagtctttcatgcattgtggatgaaacttttaccgttatgtggtcgatggcgctgtcgaccgatgttggattttccgccacctcagttgatgtgcaactgctacgtttttgggtgggacttcctaactcttcgtgcgcaccagcggcggcagcctgggggttctgttgctcttctcggatctcttgcctaatcttggccctcatcgactcgagcttttcgtcgaattcagatgtcagctcagctcttatcaacgcccggatcttggcttcaaggcgtgcatctttctccgccttgttggaagtccacttcttgtactgccacgcgtagtctggaaatccatacttccagggaatagaagacccaacgccccgtgtccgtccacggtgttccttgttgcccaacactttcgtgaggaggtcatcctcatatctttgagagcaggcctcttgcgaggcttgttgctcagcaaccaactccttctgcattacaatttagtggggttaaataaactgcatgatcggaaacaatgcgaacatctagtttgactagacacttactatagcttcgtacactcgttgatcttctggatttggcatgaagattgtgccatcatccttcttctggtacctggctctggcccagttcctagcccgagggtgtgggatatcgccaaacacgagcggcgtgtttgattcctccgcttcttcatcctcacgctgccattcctcttccttaccggcatatccggcagtgccaagccgatgtggatgctggttcttggtctggagcaaacgatatgcctcgctactagatctggactcgggggtcgacttcttcgtatggaattcctcccagacctgttctgtgatccaaggaaatttctctcttggatctagattcgccgggttgtagacgaactcgccaactagcttagtcttgaagttcttccaagcattgcccataaccttgaatgcagcccacctgagacggtcctcatgctccgcaggataatcgaagctctccttgaacgttagccaagcaatgtccttctctgcggccggcacgagcttgatgtcatcttgcagaatattgaatttctgcctccctatgactccgcagatagacctaaatcggctcaatattttctttggagatgccggcaaccctacggcatccaccgctgttatgcggaaccgttccttagggattttgttcccagtcctaggagtacgtgcccttgaggacccactagttgtcgtcgacattggttcgccttgctgagacatcgtctactttttttcaaaataacaaaaatacacaattcagtgatacaatctattacaatgaattgaatgtcacttataaataaatgaagcatataaataaactaaattgcacatctcacagtaatagaatgaatggaatgtcacatataaataaattaaacatatcagtcaaatcctaaaatcataaattcacctcataccatctattcatccacatatcatgcatctatcactaaattcattaatgcaccacattccatctattcatcaacatgtcatccatcaaaaaaaatcattcgttcaccacatatcactcatcccaaaaaacaatctatcactaaaatcattttatcactaaattcattaatgcaccacatttcatctattcatcgtcatgtcatcaatccaactaaaatcatctatcactaaattcatcccaacatccacatttcatcagtcaccacatgcaggtagcagagggtggcgcgatggaggactcacctgaggtcgcccgggggggctcggtggtggcggcgccgggctcggtggcggcggcgccgggctcggcgaaggaggagttcgcggcggcagcaccgggctcggtggagggcgtcgccggtcggtggaggcggcggcgggctcggtggcggcggcggcgggctcggcgaaggaggagttcgcggcggcggcgccgggctcggtggaggtcagcgtcaggcgggcggcgtcgggcgtcggtgaggacgatgaggaaggccgacgccagttggtgtagaggctcggtggcggcggcggcgggctcggtggcggcggtggcggtctcagtggcggtggcggcgagggaggacgacggcggcgaagtaggagttggcggcggcgctagggttctaaggaggcgggaaactgtagcgggacttagaaaaaattttcgatccgatctgagaaaccctagttatagtagagtgatgagtcatctctatcgggctttgccgtagggcccgtcacagatgactcatcggtgacgggctccatactatgcctgattgagatgacatttaggcccgtcacggatgantcatctgtgacgggccctaagataatgcccgatagagatagattaatctctatcgggctttaactaaggcccgtcaccgatgattatttttccatttttccaaacaagtctttatatttatgcgtacaaaatatatagctgctgtataataattcattttattagtcataatatattttcagatactaaatgatttcaaatcgaaatatggtgaacaacaaaattgtagagattaccaagatctacaacttttatcttggtcatttgtgtacataactttgtttccaacagcttaaaattgtttttgataaaatttcaaatctaaacaacatttgtaaatactaaattatttcaaatggtaatatggtcaacaacaaagttgatcctctcatcaagatctacaacttttcttttggtcatttgtctatataactttgtttccaacagcttgaaattgattttgacaatatgacaaatgtaaacagcatttgtaaatactaactgatttcaaatgggaaagccataaatagcaaagttgtacaacatatcaagatctacaacttttattttggtcacttcttcatccgataaagtgatagtaccaatgtttacaaaattgacatatatgtgttgatgttcataacccagatgagagaaatgtgatttttgtgaataatataa

SEQ ID NO: 19707 - DNA, 1646 bp, Oryza sativa
ccgatgactaattttccatctttcatttgaagtttttgtatttgtgagtgcaaaatatatagctgctatgtaataattcattttattagctataatacatattcggatactaaatgatttcaaatggaaatatggtcaacaacaaagtgtagagcctttcaagatctacaaattttattttggtcatttttctatataacttttttcccaacagcttgaaattgaatttgaatatatgacaaatataaacagcaattgtaaatactaaatgatttcaaatggtaatatggtcaacaacaaagttgatcctctcatcaagatctacaacttttcttttggtcatttgtaataaaacaaaattagccatattaatgactacacatatcaagtctttgcaataaaacaataaaacaaaatactccattcattacaatagataagtacaaatgcatcagtcacaaggttatgccttccgtatgatctgaacgagcatatgccacaggctcttggggatcatcgtcacagtcaatgtgaggtcttacatgaagattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaatggttcatcggcgtatcccacctttgatagatctactaaagtgaaaccttccttgtcggctttgacaccagtgcgtagattcacccaacggcagcggaacaaaggaaccgtgaacttgacgtagtttagctcccagatctcctcaatgcggccgtagtatgtgtttgacccaacttgatcctggaatgcatctatacggacgccgctgttttgcactgtgcttttgtcatcttgtttgacggtgtaaaatgtgtatccatttatatcatatccttgccatgtgtctacggtctaagacggtcccatccccaacaactgtactgtctcatttgggacatccgtggacattgtcacacgattcttgaaccattcgttgaaccgagaattatgttctctgttaatcaatgcatcagatcgccccaagttctcatctcggattttcgctaagtgctcctcaaagtatgggccaacttctgttatatgttggagcacaacgtaatgagcctgcgcgtacgacgtttgatctggcctaattcttttccttccgattgtgccaacacctgacaaccttccctcgtgacgagacgcaggaactccgataggatcggcatcggacatgtaattgacacagaactcaatagcctcctcggtcgtgtaaccttcaatgatgctcccctcgggtttagctctgttacgaacgtacgacttcagaactcccatgtacctttcaaacggacacatttcccttagaaaagccgggccacatagttttgtttgcttcaccatatgaacagggagatgaaccattatatcaaagaaagacagtgggaaaaacatctccaggtgacagagggtattcacaatatcggtctgcaacccatctagatcttctggatctataaccttctgtccaattgcattgaagaaggagcacagacgttggatcgtgtgacgcacttt

SEQ ID NO: 19708 - DNA, 938 bp, Oryza sativa
  unsure (1)..(938): unsure at all n locations
aagcttgatggtcctgggaaagtgtcaactgaattatccctagtcaatctagaagctaaaaatttgcatcctaaacctgagtgcaaccaacctattgtgagtccccatttatcagtaacaatgtactctaaatttttaccatttgaaatttccatatgctcttaaattttcatgcatttcccaatctctttcctactgccgatcctatatatggtggttcagaaaaggaaaccaaactctaatatagttttatattatattgcttgataaatgtctcgcatattcgattggcacaaacaatttatatcacactgatttcttcccctaacaccttaggtccagttccggttgtgaacttgcacaaaacatctagtgtctactgcattcacatcgattttgaataatatttaattggcaccaacaattttatctcacatattgcttttccccttgacacctcaggtcaagagttcgggttgtgcacttgcacaaaaaacttctagcaagtgttttattaaaaaactttatatatataaattttctatgagatcttttaaaaaaagtaaaattatctatcagagaacttttacaatttcactagagaatataaattttcatatccgcctggagaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19709 - DNA, 1330 bp, Oryza sativa
aggacccagcccaaaatgaaagagatggaatgaagttcagcaggttggttagtgattccaagacgcctctgtacgctggatgcaaagcaaaatacattaagttgtcagttaccttagacctaatgaagctgaaggcaagtagtagatggacggacaagagtttcacagatcttttaggaattttgaaggctatgcttcctgttgagaacacattgcccgagacgacatccgaagcaaagcaggttctgtgtccactggggttagaggtccgtagaattcacgcttgtccaaacgactgcatattgtaccacaagcaatatgcggacttggatgcttgtcctgtatgcaaggcttctcgatacaagcgaaagaaaagtgctgacgaaggaaagaagtcaaagaggggtggtctagcaaaggttgtgtgttatctacctatcattgatcgtttcaagagaatctttgccaaccccaacgaagcgaagttagtacgttggcacgccacggagagaaagaattacgatatgcttagacacctagcggattcgattgaatggaggaatatcgatcgaaaacacaaagactttgctgccgaccctagaaacatgaggatatgtctgtgtacggatggcatgaatcctttcggtgacatgagtagtactcacaacacttggccagttcttattgcgaactataacttcccgccatggttatgctttaaacggaaatatattatgttgtgcttgttaatccaaggtccgaggcaacccggcaatgatatggatgtattcctggagcctgttatcgacgatctggagattctttggaaagaaggtgtggaaacttgggatgcatatggtcaggagaacttcaagctaagagttctattgttgtgcaccattaatgactaccctgcactcggtaatctttccggacaaactataaaaggaaagaaggcatgctccaattgcaaggaacatacacgaagccggtggctgaagaaatcacgaaagatggtatacatgggtcatcggaggtggctcccgctacgtcatgcatttagaagaaagaagaaaatttttaacggtaagagagaacttcagcctgctcccaaagatttgtccggagatgaggtccacaatatggtcaaggacataagcaatgagtttgggaagaaaagaaaacgtagcaagacaaaggagaagggtatgtggaagaaaaaatccatattttggcggctaccttattggaaagatcttgatgttcgtcattgcattgatctcatgcatgtagaaaagaatgtgtgtgagagtttggttggcctgatgtt

SEQ ID NO: 19710 - DNA, 5212 bp, Oryza sativa
cctatatacatttctatatatatatatatatattatatgtatatatatatatatatatgtatatatatatatgtatatatatatatatatatacatatatgtatatatatatatatatacatatacatatatgtatatatatacatatacatatatgtatatacatacatacatatatgtatatatatacatatacatatatgtatatacatactacatatatgtatatatatacatacatatatatatatacatatatatatacatacacatatatatatatgtatgtatgtatatatgtatgtatgtatatacaaatatgtgtgcacttaagtaattagaggccatatgcatatatatattaacaaaatatgagtttgcaagtaagtaaatatacatatatattaccaaaccaagtacacaaaagtaaatgcatgtgtgcatatatgaatacatagatatatatattacaattcgttcggacgttgtaatatttgtttctgctactacgacttggtgacatcggaagaagaaggaccggctttatgaatagttgatccatcgtaatagaattctcctgtgggatggagaatatgcttgttgatgaatcccattatctgttcttgaacagcccttatgaaatcatcgtgggtggtgttatctatcaggtaaatcatatgttatttggaaaaaaaatgggattatatatatgaaaccagtaagcaataattgacggaagaataaatttacgtacttcaaggtcctggccagtcctgatttggtgtgctaagcagtgcatgtaatggcatacgtagtagccgcacaagttagtccccttttcctgctttgcacactgaaagagaaacaacgagagatttagtatgcatatctgatttagaacaaagaagtgattcaatacaaaattggagctagcatgtaccaaccggaaaattgaacctccgggtgagtttttcattccagatcccgcggaccaatgtacggaaccgaatccatgctctatttagagttgttaggaaggattaatttattatccgagatctagtagttatacaatgattcataatgacagtgcaatatatgacaatacctatctatcacttcaaaaatctttgcgaaagttttctccggtttatccactgaatcgtagacatgaactttggatttctcaaggtcgaaaagaagaaggacccaatggaatctgcaatttgcattacatgatacatagtatgattgtaggaactttgtaggaacaaaattgaaggaacaaaattgaagttaattatgattgtaggaactcacgatgtgttgtagggaagaagtatgaacctcttataatgctgctgcaccaggaaatggacgatattgtcctcggtttgtttctcgtattgttgtatcatcagcgtgttcactttgcgtgggtccatgaattcagtattgaatttgttgtgttgacggcacaactgaatctccattctacaacggggaaaaggaatgtgtgtgagcaacgttcaaaggaggaacaaaattgaactataaacagtacttacaaagtccacgcgctgagaatagagacgtcgagggccttcaggtggtataagtcgaagacttctttgtagcggatccaaataacatcttctccttggtaataatctgagtttcgcaccctagctccgaacatctatctacccatcactgatttgtccatgtaccattgatggaaccggtacatctgtgtaggtagctctctgatcttatcaggcatgactagcggttcaccgagtttaaacgtgtacatgactggagccgtttcgataggtgcatcctctagcaactgctccatactcagtcccgtatctttcaagaagttgcatatctctagttgtgccggttctacgactaacgcttcaacctcttgtcgtggctgttgccccagctgagggacttcctttccgcacttcactgctaaaggcttggctttaagagccttcctcaatgttcgatcatagtcagaaacttcgaccggtttgcccggttcggccatcttaataaagtgatcctgaacctccggggctatagggatcttcttttccggactacgtggcttcaactgctccctaacttccgctctaacggcttcatcgagctcctccggagtcaagtcgtacgcccttttcttgagagcggggagccatggctcgtcagatctggctttcttcttcgaccttgatggtgcgggttcatatgggcgggaccttgacagtgtagacttggcagcaagtgcacgtggaggagtagttgcccgcgagcccgacggtgcagacttggcagctggtgcacgcggaggaggtggtggtgcaggggaaggagccagaggagactgacgaggcggtgatggcggaggagactgtgcttgcggcggggaaggaggagcgggcggccgttcttgcccgggaaacacgatgtacttcttacgccagagtatgatggcgtgggctatgtctccaagtttcttctccccgtctcctccggggatgtcaagctcgagatcctcgtaggttcgttccactagctctatctcgaccttcgcatatccatgtggaatgggcctgcaatggtatgtactcgaagggtccgtggatatggccatgcccgacgtgaccttcacaagaagtatagttcattaattactaatcaacatatatatgtaacaaatttcgcatttcgcataccttgatagacaagttcctgaatggagtatgcatatcgcagggtgttcgctgcgtgatatcaccaacggggaagtgggttgcttcgtgagctgccactgcctcaatgccctctgatccaacttggcccgttgatgcgcagctgctgcggttgcccgaggggctcaccatgacgggcgcttgtgtttccattccgcgctgctcggccaggcgttggtccacctgtcttgtcacctcctcttgcatccttgcctcgtaggtggacaccctgtactcaagatcgacgatcttagcttctgtatccctcttgctcctcatccaactcctatacgtgtggatgtcctctttgaatccatatttccaaggaatgacgccttttcctcgcattcgtcctagatgctcaggattctgtagtgcgagggtgagctcgtccttctctgtcgggccggaaagtcccctgcgtagaggcttcaattgcatccgcaagtcggcgtgctgcatctcgaatctcatcgccgaatatgagggagccatcacctggattgagcgatccaccgtgtgcatagaaccagttcctcgatcgctcaggccaattagccgtggccggctcgataccccttgctatcaagtcagcttccaacttgtcccacttggggattgcctttgcatatccgcctgacccaagccggtgatggtatttcttcttagctgcattggctttgttcttttctatctgtgcttgcccttgcgctccagtcttgtatgccacaaacgcatcccagtgatccctaaacttgttatgcacgttgaaattaggtatcaagcccttgaggatgtatctcttgtacagatctgatttgtagctctggaatagttctgccattttcttcagggtccattctttgcatctgggacgatctgcctcagggatcgtgaatgtctccagcatggtggtccacaacatgtccttctctgtgtcagggagaaagctatcttcatccccgcgtgacctagttcgacgccagtatactatgctgatggggacgttgtctctcacgacccaaccacaatgattcacaaactttcgtcctatacccgtcggggctactggttcgccgtctggggcaatctcagtaacgatgtgccttccctcaagcttcatcgcgggacctcttttcccacgtggcctcttctgtccggccgacggttgactatcaatcccctcctcggtcccctcctagttagcctcctggttaccctcatcgttgccctcctcgttcaggtattggttgggatcctcgttcccctcatcatccacccagtactgactgctgccatctgcgatcgtgtctaacaggatttgttcgtcatcgcggtctgccatctatgcgtgcaaagaaaaaaagacagtgaggtcatggacatcaacatgtacagctcagacgtctaaaccctacaagtatacatgtataattcgctaagtcgttgttctcgttaagtcgttaagtcgctaagtcgtcgttctcgctaagtcactaactcgctaagacgctaagtcgttgtccgtcaaagtcgctaagtcgtcgttcgtgaaagtcgctaagtcgctaagtcgtcgttcgtgaaagtcgctaagtcgtcattcgtgaaagtcgctaagtcgctaagtcattgtctgtcaaagtcgctaagtcgtcattcgtgaaagtcgtttagtcactaatacgtcgttctcgctaagtcgctaagtcgctaagacgtcgttctcgctaagtcgctaagtcgtcgttcgtgaaagtcgttaagtcgctaagttgctaagacgtcgttctcgctaagtcgctaagtcactaagtcatcgttcgctaaaacgttctcgttcaaacgttccaccgtggagtcggcggtggagtcggcgcacggcggcggcggcggtggcggcggcggtggagtcggcgcgtggcggcggcggtggtggagtcggcggcagcggtggcggcggtggcggcggcggaggtggagtcggtgcgcggcggcggcggcggcggtggaggtggagtcggcgcgcggcggcggcggccggcggtggagtcggcgacgaagatgacggcgaggtcgatccggtcggccggcgcgtgtcaagatcgatcgagagagagagaatgcgagatcggaggcgcaagatttgcgcccctcaccttgagggaggcaacgctgccggttgcgttcgcgagggcagatgagcgcggcgagcacgacgacgatgacggcggaggcggcgacgacgtctggggcggtaatggcgcgggaggaagaagatcgatcgtggagaagtctaagtgtggtgcagggaagccgatgcagtggatatttatacccggtaatcttttgtcccggttcgtggcttcaaccgggactaaagatatctttagtcccggttggtagttacaaccgggagtaaagaa

SEQ ID NO: 19711 - DNA, 10752 bp, Oryza sativa
ccacaaaccgggacaaaagatgttttcccgctattccaaaatttgtattggtcccggatactgttaatagccaggactaaagatgtgtacacaaaaccgatttatggccttcttaaattgtcttacaagtcgaaataaataccaataaatccaatataattagcacatggccgatttatatggtttcaaagtccaaataaattccaaaatcgtacgtaatttacgtatggccgaattaaatgttttcaaaattttaataaatagaaataaacatgatatgcctaagtaaatggtctcaaagtataaataaatagaaataatcatttataattaacataaggccaatttaattatattcaaagtgtaaataaatagaaattatcatttataattaagatatggcctacttaattgttttcaaagtggaaataaataccaataatcagttataaataacatattgcctaattaattgtattcaaagtgtaaatcaatggaagtgaccatttataaatatcatatggttgaaaaatagtaatacattacaaattaagcagttgagaataatatattgatccaaattgttcgaccttcaatacaatacaaataatttacatcttccatcaaacaacctaggtcactgtcttcctcacgtactttctcctcactattgttccttcgctatgatcgttgcgtgagtacggcgtgtcctcctatgatagtatgatgctcgggtcaaccatcactgcaaacggaggttgcccctcaaacagatcgtaattttcgtcagtcttatcctcgactccaacgattttcctcttgcctgggagaacaacatggcgtcttggctcatcgggccctttccccttctttggtttgctatccatgtccttcacgtaaaaaacttgtattacatcattggctagaacgaatggttcatctgagtatcctaccttatttaagtcaaccgttgtcatcccgctgtcatcaatcgttacgcctccaccagtcagcctaacccattggcaccgaaacagagggaccttcaggggtccatactctagttcccaaatgttgtcgatgacaccgtaatatgtgctagttggaccatcgtgtcctatggcatcgatacgaacaccactgttctggttcgtgttctttttgtcttaggctcttgtgtaaaaagtgtatccattgatttcataaccttggaatgtagttaccgagccggagggtcccctagccaagaaggctagttgtcggtcagttgtctcgttacccaggaggtgttcttgcagccaagcggggaaagtatcaatatgatggcgtgtaatccaggcttcggacttgccactgttttctgagcgaacaatcgcaaggtgctcatcgatgtaaggagcaaccaacgaagattattgcaaaaccgtgaaatgtgttttacggaataaatcgttgtctacagtcataattgctctccttccaagtgtgccctttccccgtagtctcccctcatggattgattcgggtaccccgattggctcgaggtcttcaataaaatctacgcagaactcaatgacctcctctgttccataccccttcgcgatgcttgcttccggacgagaacggttacgaacgtacttctttagaacgcccatgtacctctcgaaaggaaacatgttgtgtaggtacataggaccgagaataccgatctcttttacaaggtggcacagaagatgcgtcattatattgaagaatgagggtggaaagatcaactcaaagctgacaaggcattgcaccacgtcatgctgaagggcggctaaactttctagatcgatgactttctgtgaaattgcgttcatgaaagcacaaagcttcgttattgttgcccgcacattatcaggaaggataccacgaattataacaggaagcagctgtgtcataagcacgtgacagtcatgagactttagttttgtgaacttcttatccttcgtgcttattattctctttacattcgaggagtatccggacggtaccttgatgctctctaggcattgaaacatactctccttctcttccttgcttagggtgtagctcgccggacttaagtaatggattcctttatcgttcggttccggatgaaggccctcgcgttgttccatatgcttgagatcattgcgtgcttcgagtgtatctttggacttcccatatacacctaagaagcccagcaggtttatgcaaaggttcttagtaaggtgcatcacgtcgattgcgtggcgaatgtccaagacctcccaatagggtacctcccaaaaaatagagtttttcttccacatcgctgcgtgaccatcttcgctctctataggttggctaccaggcccctttccagatactactttcagatccttcaccatttcgaacactgctttcccgttgcgatgtttaggcttagtacgatggtctgccttttgttcgaagtgcttgccttttttccgtacagggtggtttgcagcaaggaatcgacgatggcccatgtacacaaccttcctgcaatgcttcagataagtactttcagtttcatccaaacagtgagtgcaggcgttgtaccccttgtttgattgtccggataggttactaagcgcaggccaatcgttaattgtaacgaatagcaacgctcgtaggttaaattgctcctgcttgtcctcatcccacacggggacaccctctttcctccacagcactttcagatcttcaaccaatagtcttaggtacacatcaatgtcgttaccaggttgcttcgggccttgaataataatcggcatcatgatgtacttccacttcatgcatagccaagggggaagattgtagatgcacatggtgactggccaggtgctatggccactgctcatctctccaaatggattcattccatccgtgcttaaaccgaacctcacgtttcgtgcatcttcgccgaagtctttaaatgttctgttgatatttcgccactgcgacccgtcagcggggtgtctcagcatcccatcctatttacgttcttctgcgtgccaccgcatcattctagcatgtgatttgttcctgaaaaaccgcttcagccttggtattatagggaaataccacatcactttagcaggaattctcttcttcaaaggctgtccgtcaacttcacctagatcatctcgtcttatcttgtatcgtagtgctttgcaaatagggcatgcttctaggttttcgtactcactgcgatacaggatatagtcgttcggacgcgcgtgaatcttctgtacttccagacctagagggcagactatcttcttagcttcgtacgtactttcgggcaattcgttcccctccggaagaatgttctttacgagtttcaataactcgccgaatgccttgtcactcacaccatttttagccttccattgcaagaattctaggatggtactcaactttttgtagcccttctcgcaacctgggtacaacgttgttctgtggtccgctaacatgcgctccagtttctgcacctccttttcactttcgcagtcctcctgtaagtcccgcaatatttgaccaagttcatcagcaccggcattcccttcaacatccagctccgcctcgcccattgtgttttcttcaaatccgccatactgagcccagtctggaatgttctcatcttctacttcatcttcttccattgcaaccccaacctctccgtgcgaggtccaacaattgtagctacgcatgaacccccactgaaacaggtgggcatgaatagttcgtgtggtggaatactccttctggtttttgcacttgtcacatggacagcttataaaaccgttacgcttgttatcattagccccacccaaaaaataatgcacgccgtcaataaactctttcgaccaccaatccgcgtacatccattgccgatccatctatatgaaatacatataaatcgtaattatacaaaatccaagatttacaaggtaattacataataacacaataattgaatataattattcatacaattaatcattattattaaattcattgtacatatttttcatgttttaattacattataaacaaatatttaatatgtttttcttattttaatattaaattagcttagttttataatttcatacaaaattatatgtaattattcaaacaagtatttataatcttctttattccctacaaacactttctctctcatcatcttccatcacattttctagagggaaaaatatgtaaaaaaaaatagctccaaatgtagatgctaagcaaaacaaagagtaggatgaagttgctaaccttttgaagacctcaaatttgtatattaccaccaaaaaaatttacttaaaattttgacagcacctccctccctcaaagcttaattttgaagcaatggctcgggctggaggaggaagaaggggtatataaagctgtgcaactttagtcccggttggtaacaccaatcgggcataaagatctcaaatcactttagtcccggttggtaacacgaaccgagactaaagatcccaagccccccgacagaggtctgacatgccctgtcaggaggtgaaccgggactaaagatgatctttagtcctggttggtgttaccaaccgggactaaaaatcccttcgtcccgttgaagtaataaaccgggactaataagccactttagtcccggttcgttttggaaccgggactattgtggaaattggccgaccctccaaatacctcttctccagtagtgaatccaccatcggaaccactggtatacattgctaatagttgctattatgtcatgtatgctccatctagtttgagataatgtgattgaaagagtcttgaggattgtatatgtcacctagagggatgaataggtatttccaaaaatttcttaaacttacaaacagcttagaactaactggatagtccggtaccactgcagacaatctgactatagagcagtcggatagtccgactgcatcagaacaatccaatcagagcatcgccagagaaaaactataagtgacctggaaaatagaaatagaaatgaaaaaataatggtggtggtggcaggatgtagcgtgggttgatcgtttagaagcacgaaagctccttgaggcagccggtggcagtgcccttggcattcttgcagacggccatggtcttgttgtttgtgccagagtactcgaccttgatgtcattcaaggtgacgccggtgcacggcagcttgtcggagcagaggaggctaacggcctcgggcgtggaggaggtgccggtgatgttcttgaaggtgatgtccttgatggtgaccttggagttgcagttggcagtgcagatcttgttggggcagtacttcatgtcgatgatgatggggttagcaacgtcctccatcttgatgttctcgtaggtaaacttggaggcggtgagcaccgaggcggcgtcctcataggacttgatccggacgccattggtggacttcttgagcacgcagttcttgacggtgacgtcggtcacgtccttctcgtccttgtatctgcccaggctgccgacgctgatgccgtagccggggccgcaggtgacgccggagatgttgatgccctcggtgccggggccgatggagatgcagtcatcgccggtgccgatgaccgtgtcgatgatgctgatcttggaggagtcgcatatgtggatgtcgtccgtgttcgggctgtcctccggcgcggtgatggtcaagtccttgatggttatgttcttgcacttgaacatgttcatgtggaagaacttggggttcaccagagagatgccgctgacgagcccgttgttcacgaagtcgagcaccaaactctgcatatatatttatgtccatggatcataccaaatgagatcgatgcatgtctctatcatcaatacatgttgtgtagatgcatgcatacgttggggaggatcttgcagatgtatttcttggcacaggtgttcttgctccagacggcggcgccctggccgtcgatcttgcccttgccgctgaattcgaggttatcgacgcgcatgatctccatccagttcaccttgaacaaggcgaggtcggtggagccgagcaggttgccgtcgagctggatgacgatgtcacccttacatggcccggtgaagttgaagggacccgtcacgaagtcgcccttggggaagacgatcgtctgcttgccggtgccagcgcacgccgccgtccacgcctcgttgaccgccttggtgctgtccgtcttgccgtcgcccttgccgcccagcttcaccacgtcgtgggtgctaccgccgccgccccccgaggcggcggccggcccctccgccttcgcgccctcctccttggggtagtccttcgcgtgcgccgccacgcacaccatcgccagcaggaacagggcacggacgaaccccatctttcttattcactctagatgtttctctccttattctctcttcgccactggtgggatgatctgggaggctggaggagtaggagaatataactggcgccaactgctatgttaaggcgcgccaattttagcgttttgcttttgctcgtgccatcactaacctttggatagtggcccatgcgacgtaggtgcatgtgtgagtgttgtccctgcatgtcctgtgtatcctctttgccgttgacgaccacttgaacctttcttccccaattgccggccacacatacatattttaatttcgtttgttttggtcgctaactcgatcgatctcaggcaccgcatccgccgccgcagagacctccgaggacgccgtcacggtccctatgtattcaacgtggttcatcagctaatcacgtcgatgacaagttagatgatttattgaactgcagtactaagctaatttgttggtctaaattatagtacatgtttcatttgtatgtattttgtgggaaatttacgcgttgtatttgtccccaaatttgtgtcgttcatttcttcctaatttatttgtgtactatttatcttgtattggcgtttatgagtttgtgtctgcttcatgtttgaaagagttttttttaagttttctatcgaaacaagatttcggcaataataaaagggggtggctatcaagctaggaaagtggatgggtttggagacaaggaattttatacaggttcaggccttcttattcaagaagtaataccctactcctgtccggggatgattccgccgagtatgttattgattgtatgattgggaaaaaagaatcgtcccgagaggaacccggacccctccttatataggggaagggatccataatacaaagtacaatccatatcctaacggaatatgggattacagataaaatacaatcgtaaccgactaggatcccgtgtagtttcttgacatacaagtttagaatctaacccgagtcctcataaagatattctatctatatttggtaccgtatatccggctggaatataaccgccatgtagatatggggtaaccataatctccatagtagcccccgagaccttcgcagttgaccaaaatagtcttctcaaaacaaaaaacaataatccgagtgcttcaattcaacttgctccggcttgccgagtgctaaaagactgtgaagggcgaaaataaaacatggtgcatcgagtagatgcacctaattaggtgtagcccccgactatgtgattagttgaaaaactaaacatatagtcaagaaccgagtggttttatagcgaagcacgcatggtacttagtaaaatacccagccgactgcttctcaacttgaatacatcaaggacaaaaaatacaataagggccgagtgatgaacactcaaaaggtccaagaatagacatatttgataggaatccgagtaagaaactcttaaaatgattcaccaaacatgataaaaaaatcatggtaattaatgagtctaatagcctaggctgtgacccttaccataactaaaagaagcatataacatgctaaaagaatgactatgaataaaccagtcatctcaaatcaacccaaacagcttttgcagcctaataaagcttacaaaaacggtataacacctttctgtcaggcaccttttgtttgcatcgtgttaattttaaagaattagcaaaccgcattaaaaaggatttaatcagcattgggccacaacattgtgagcacaaattgccaaagcaaaaagtgcctaagtccctaaggatcacaacaggccatgctggaaataaaattgggctgaagtactgtacaggcccaggcccattagcactcccgataccctaacaaaacaccgaagtctaagcgacgcttcgtcttccccgccgagactctcgccatttccccattcctcgctacagtacaagactgcaccgacggagctagggttcatcaatccgctccaatccaccctcaaaaacttcacgaaatttctccccgcgtccaccgctccgattccccattcctctccagccatatctcaaactaaatcaaatcatccagttcacatttatggcgggagaaagagaaagcttcgagagtcagtgggcgccctccgatgtgacggaagacaatttgaaggagatggtggcgcacggcgttcttccagcgaaggagattatcgggtggcgaccggcattcggcgaagcattcccgactcccgatacgcatgaaatcgtggtatttgctcacttcttctatggcggattttctcttccaacctcgagatttttccggggcattctgaacttctacgggattagcttgcatcacttgaatccaaactctatagtacatattgccaattttattcacgcctgcgaagcttttctaggcattaggcctcatttcgccttgttccgccgcatcttcttcctcaagccccagccaaacaaaagcaaaccgtgcattgttgggggagctggtttccaactcagaggaaccttgagccaaaaatatttctccatgcccttcaaaacctcaaacaaaggctggcatgcaaactggttctatgttcagaatcctgagcccgcactccccgagtactgctgtcttcctccagtttaccaggacacatggaactcattgcctatgggagatgaagccgctcaggcagtggaattgatggaacgcatgctaaaactgaaggaacaaggtttgcaaggagaacagatcaccaggcactttatcaagtgtcggttagctccaatcaaagaaagatcccgcacagccttcgaattcgacggcaagcatgacccaaaccgtgaagatctagattctcttgacttcaaggtcatgaaggaaaggatgtataagatcttctcaaacgccatcggtgtcagctactcacacttgctgctagtcgtaccgttcaatgcgttcaaccctcctccaccggtaagcactcaaacatttcaaccttcctcaaaagtatgcttttactctctgttaagctaattgaaagttcgaaatatcatgcccaggaattcgctttgatgaaatcggatcctccaattgctcaacgccgatcacctcgccagcagactggtcaagcgagtggaggaccaaaaattcgatctgacgctcgaccaagtgctcccgatccagtcagccagtcagatactcgcaagaggaagctggttctaagtgacgatgaagccgatgatactaccaggaggcctgaagaccgagagacgaccaagaaactaccaaaacaggctactccaaggaagaaaacatccagtcgccctgtgccaaagatcaggaagtcttctaggtgcaactcatataacgatctctcttatattgatgcgcacccattgcggcaataatactgataatcaaatttgcaggaaactatctgatatagacccatctgggaaagactctgacccgactaacatggacacgagttcttccaaagaaaccgggccaactgttggggatcacccgagtgacaatcagccggcaaccgataatgtagaatccagtgatcaacctccaactggaacccagtcggtcgaagctgaagccggagttaatcaggagcccccgactggaaaccagtcggacgcaaggtcaagccaagagactccagaagtcgaaacccaagcagatagccctcatggacaaaacgccagcaataaccagagatctggatctcctttaaaggcatccgaatccactcgtcctcgtccagaaatcattacgggtaaacacttttgtttgaaaccatgttgacccaaataaactctgatcaattgtctaacctttgttagcgaatacattaggaccaatgattagtgatgaagaagaaatcccccgtatacaagcagccgaagattcgtgccctcccattctggtcaagtggtgggatgataacttgcagcctcaaggaattgtaataaaccggcaaaaagaagacgaagaggtctgccaactgaaaaaggcactcaaccaagcgactcgcattgtaaatgtaagttctctggtacctgatctcaaccatcttgtttgccatttaattcatgcgctaattaaactgtcttgcagaggattcatctcaggaaggaagccaaaacggcaaccttagagaagttagtccctcatctcggaaccctcgaagccaccaggaatcaactgcacgaagcgaaagagcttgccaggaagaatgaacatgacctgagggatcggatcgctgagctccagaaatcaaat

SEQ ID NO: 19712 - DNA, 5873 bp, Oryza sativa
caaagagacctggctttaaaggaagttgaaggtatcaacaatcaatacctcaaaagccattatcctccatatgctgacttattaatgtgaatctgttggtgcagaccgcaagatcaaatctcaagctcaattcgacgtcctagtcggcaagatcaaaaaacttgaaggagcccgggatgaggtcgctaacgctgctgccccaattgttcaagcgatgttcttcaataacaacggcccgagtgcacttgatgcttctgaaattttcgatgaccaggcatcttcatcatcatgtaggtgtagtgtgggatggccatgaacttggctagagccggtcgtccgagtatagcatgatatgctgtctcgaaatcagcgacttcgaaacaaacatttcctgtgcgaaaattctcccgagtgccgaaggtgactggaagagtgatctggccgagtggtgtagctgacaatcctgggataacaccatggaagggtgcattactcggctttaattccgtgcgaggaatctgcatatcgtccagggtcttagcgaaaaggatgttgagtgcgctgccaccatcgatgagagtccgtcggagcttgacattgcgaaccactgggtctagtaccagggggtaccgccccgggtggaccactcggtcgggatgatccgagcggtcgaacttaattgctgtctctgaccaccgatattggggcgtgttaggctgaaccgcattgatctcccgttctgttagcttctgttttctcttggactcataagtcaggggtccgccgaagatgtaattaagttctttgcgatgatcttgaaaaccagtcggggcatcgtcttcatcatctctcttctttgatgtgccttgatctccgtctgaaggtttacgtgcgttcttgacatattgttctgtgaactatttgtagacgaagcaatctttggccacgtggttggagttgggatgatgcggacattgggagttcattatcttgtcgaaggtgttgacgtggggacattgtcgggaagatggagaggtggtcgccacaagttcttcgggcttacacttgtgatccttgtggttgttacttccactcccccctgcagtcggcgtgtccttctttggcttccaagtggtgcccgactgtttggacgcggtgatatcatcttcggctttggcatactcgttggctttttcgaacatctgcttaaccgtcctgggaggtttacgtccgaacttgccgactaggtcctcgtggcgaatgcctttggtgaaggcggcgatgatgacgtcgtcggtgatgtcggagatcttgttgcgttgttcggagaagcgccggatgtaatctcgaaaggattctccagacttctgaacgacgttgtagagaccaaactgtgttccggggcgttcgaaggtgccctggaagttggcgatgaagtgatcacgaagttccacccatgatccgatcgtgccacggggtagtccgtggagacaggatcgggcggagtccgctagggccacaagtagatagtttgccatggccttgctgtctcctcctgctgcgtggatcgcgagtccgtagacggtgagccaagactctggattagtggtgccgtcatacttctcgattccagtcggcttaaagccgactggccaatccactcgacgcaggtcattagtgaaggcagctactccatccacgtcgtcatcgtagcgatttggtgaatggcggtgacctcgtgctgcacggcgctagttgattgtgtcgcgaagatcgacggggcgctggtgaggtggagagcgaggccgttcgactcggcgctccctgtgacgttcgggaggcgagtgaatagatcgttcgtcgtgacccctgctcctgcgactagatcctgtgccggtgatgctgaggtttgactgatgatgatcatgagatcggaggtgagggactcggctaccagtcggggtacgggtgcttgcggagttggctggaaccgaggcagcgatcatggtcttcgtctggttcaagatgttgacgacatgatcagcttggttgagtgcgtcttctttgaggagggtgtcgagaagagtgattgctgcaaccgcgttctgctggggggtgcgaaagaccgctgttccatcgacgtcttgttgcccaatgaactctctcgctcgtcacccggattccaaagcgcgttgccgtcgatcttcagcctcctttgcaacccgttcgcgatcttgttgctcacgctgtattcgttctcgcttctgtcgctgtcgcacttcctccagtcggcgacgttcagcttcttgtcgtgcgcgatcttggtccgcttcttaggctcggcgctgttcttccgtttcgttgtcagccatgaatacgccgaagaagaggggcgtgtagttatcctcatagctgtcgtcgaagttgtcgaagtcaccgtagtcgtagtggtagccgaagtcgtcgtagtcgaggatctcggttggtcgagaactgacgccgggggagctgaggtagccatccaactcttccatcgagactgtcccaagaggttggagtataacgccaacctccctggatctagactggatcggggccgatgccggagctcgcctagatctccgagtgggagatgttttggatgtgaagacggcggccaagtcatcaggaagtttcatcaagattgagggataggactcgtcgtcttgatctggtcgcggaagagtagattggatctcgtccgagtggtttgaagccgactcgggagagatgatcttggagtaggactcggccgagttcggaataccgaatggcacgggaacctagtctctccccgactggtttgaatccgagtcaaggagagagatcttgccgaagtcattggtgatgaagttgaggctgccgaaccggaatgcttgcccgggagggaaggcgaagtcgtcgttgtcagaaatgaaacccatcgcacttagtcggcaagaacttgacgtcgcccctacctggcgcgccaactgttgaaacaagatttcggcaataataaaagggggtggctatcaagctaggaaagtggatgggtttggagacaaggaattttatacaggttcaggccttcttattcaagaagtaatatcctactcctgtccggggatgattccgccgagtatgtaattgattgtatgattgggaaaaaagaatcgtcccgagaggaacacggacccctccttatatagggaaagggatctgtaatacaaagtacaatccatatcctaacagaatatgggattacagataaaatacaatcgtaactgactaggatcccgggtagtttcttgacatacaagtttagaatctaacccgagtcctcgtaaagatattctatctatatttggtaccgtatatccggctggaatataaccgccatgtagatatggggtaatcataatctccacattttctttgagttgcactcattttgagtgatttagtgtaataattgattgtaactagcttaagcaaagatcaagatggttttctatttcattatctaaaaaatttaaataaaaatatgataaaaaaattgccgtccgaatatgaggatcgacacatgtttgttgccttgcagcattgctgagacgaaagcatctttgatactccatatgtctagtatacaaatgcttccaagtacccaatctaacttttggtttggatcgttttggttggtatgggatatgatgggctgagattccatcttggattggagtggattggactctcaacaaatgtgggttggattggagtggatgcagactgactaaaaatgttgattcatggactaaatccatgggttgaccacatggattggccccaaaactgaagaaatgagtactcgagtagttgctagggcagacagggccgttgctccactccgccgccatcatcgtcgggcggtgctgctggttgctggtcgccctcgccggcctcgttggctttctacaggtgactccatcggcttcctccgccagtcctctccaccaccgccggtgttgctgccccaatcgtcctctcccagcaccgctccgccacctctaacctcctctactccctactgtcggcaccaaaaatggttcaccaccggccttctagatcgtcatcgagttttctttccaggtgtgtcctaagctgattggatccttcacctcatggttcagtttactcttctaccaatctactctctgttttcatcgaacacttaattttcttatttaacatgatctttcttggttctgatcactaaccctgggtgatctcgtgtgtttggaagcagttattactttgcgagtttggttttctttacctttatagctctgtttctggcatgtttgatgctatctgctaactagagttcttgttttgctttgctttctgaatattgctgaacttctctgaatttcagaaaccaccatttgcatcatcataattaattattttgcttaccttctcaagaaagtgtgactgagaattggaaggaattttgattctcttagaaggtgatctaaagatggagacacaaataactgttgatgttctgttatttttcatggtgttgaatggcatgtttaggtagctttgctgaagatgtgaagtgttgagcctgtaatctgtagttattagtaacactataatttttagtaatgttgtaatccctggttagtagctgtaacctttggttagtaatttctaataaaattctgggattttcaagtctgctagtaggctgcatgtattgatgcatggtggtgttaggctgttttagctcacctgttttgcccctgcagcttctgcattcccctccgtgtggaggcaaaccagttcataatccatggattagctgtggtctgtgtcagagttacggataaggtataccatctatcctggatatacgatgagtaccgatacggtatacccgcgcgtatacggatagatcctatatgcgttaaggaaatctatcacgtgatagaaacagaatccacgggtggaaggagtcctactcggacgagactgagtctttaccatattgtgaggggtccgatatctctgagtcctacttggagatcaactgaccagcggtataaaagggaccccctgggcaagacctagggcatcgaatattaccgccaacacatccaccacagcctacgaagtcggagcctacaggagccaggtcgccgggtgatctagtcgaactaactcaactatggtctcgtcggtatcatcgagttccgttattccctttgtaatatgtggtttccatcatataatcccataccaactaaattagcgctattacctaccaaggggcctgaaccagtataatccttgtcttttgtttgcttgatatcgtactacgtagatcctcgtaccaacataccccaataccctctatatccggtttacaggtatgccccgtcaacagtcgacagtctgagaaatgggtttaacccatggattgggttgaacttggtttgaggaacgttgcaagttgggttgggtggggttagctaagagagtttttttgattggattggatcgacagagttgttacaagcgcttttggactgggttagattcggggtggattctgacccattagcaggcttaaattataccctcttatctgtttactaccgttaaagatcaacggtttgtatttatttaaaatccatcaccggtccctaaatttgtaccgctgtgtcatcctgatccctaaactcgtaaatcgaccgttcagatccacaaacttattcgactgtgtcatcccggttctaaacttgcagatcactcgtttaggtcatccaacttgttcagttgtgtca

SEQ ID NO: 19713 - DNA, 28738 bp, Oryza sativa
  unsure (1)..(28738): unsure at all n locations
atgatattcaaatccaaatttagggaccggggtgacacatctgaacaagttggaggacctaaatgagtgataagcaagtttagggaccgggataacacagtcgaacaagtttgaggacctgaacggtcgatttacgagtttagagaccggaatgacacagcggtacaagtttagagaccggtaatgaactttactctttattttactactagtaaacaacaccataggactcataatacagttgcagtgtggggatgtgactcccatgttcctccctctgtaccctgttcctgttccgaatccaccatattatgtaaccatgtaaatatttattttttcatcaattaattatcaaaatattcacatttgtataatataatattatcagtgttttttagctttataattatttgatgatttttctagcgagtagttgggaaaaattatctaagtagtttcagtagaattttatttagaatgcatatttttgagagcgagcacgaataaaattatgtaaatatatgtaggcacgttagaacgtgccctaataataatgagcagcagtagttcttattactagtaggtttagtcccaagtcaaaagtacgataaaaacttgactggcttataaggaatgtagccccgaagtttcgaatttttgccaaaggaaaaaagaaaaagtctatatacacatgtaaactttaggtgaaagtccatccggcacccctaaactttaaaaccaaatatcgaaccccctaaattttggaatatcatttatattatcccgtaagatggttttagatagtggttttgcgtattcggatgcttatatgagtgtttttgaatacttaatatgtcgacggggatacccatataccggatgaatagggtattggggtacgtacgttggtacgaggatatacatgatacgacatcaagcaaacgataagacaaggattatactgattcagacccctcgtaaggtaatagtcctaatccagtttatatgagattgatatagaaaagccacagattacaatagagaaccgatgatctcgagattaccggtgagatccctcgtcgagatggtttcgacgagatctcccggcgagtaggcttcacgttctccggattgtagactatggtggttgtgttggcgctgtgattcgattatttgaacccctcgggggtatgccttttataccgtgaatcaccttagtctccaagtagaactcagagactatggacccgcacgatatagcataaacccaatcctcttcgagtatgactctgatattcacttgcccgtgaggataatttctataatctcatgttagtttccttatcgtatatggaaatatatcgtttgcacgaagatatgccatatccgtatattccataagtcgtaggatagaatgtatgtcttatccataatcatgacataatataacatacttatatatcgtcctcgattctcaatttatactccatagtgatgtcatgtgtagtgatatattgttgacattcatttgttagtgagagcgaaagggtttaaaaagaaatatttgggtaaaaattttaacacatatgtccaattcgtatcttacgtagtcaaatttatctaaagtatatagagataagatataaaaccactctaaaaagttatataaacggtactgtaaagagtggagggttggatgttcggttttaaagtttacggtgctatagaaactctcgatcaaatttaaggtagtatttggattttattttaaaaaagaaaaagcataaagggtgttgcaaattgcaatgtagctagatatgtagcatgaacaatatttcagacacataattttgaattgcacctttttcaaatctgtttgttacaatctaaaaacagcctgtaaaaaaaattcaaaatttgatcatttaaacctgccgtgtatcctagagctattaaaaggttaaaacgacccgaaaaacctatagaaaattagaaaccgagctatgcacaaaagaatttcgatcgagacgcggagaactcgccggcgggcggcgccgtcatcagaagtcgacgctgccgtcgccggctgccctgcacatgcacccgggcgtcctcggctgccggtacacgctccgcccccgcggccgcgcgctgacccgcttgtactcctccaccatgttcctcaccctcctctcgaatccgccccacccgatcccctcctcctcgcccaggatctgcgcgtatcgcttccggttcgggtgcagcgtcggcgccctccccctgccgtggtacacccggtacccggacaccagcgacgacagctggctgccggagtccgtcaccgcgaacacgtccgccgaggcgcacgcgatgaagtccagcgccgcgagctgcattttgtttttttttttctttcggatgtcagaataacggaggagatggcgttgcttgcaggggaggtgtttgatgttttaccgacccgggaggagaagttcttgaatggggctagctcggcggaggagaggacgtcctccttggtgaccaggttggggaagaggcgcgtcagtggcggagccgcgcggcgccgccgtatatctgtgacccggcgacgtagatgaacgtcccgcggtcgtagccgagcgcggtgagcacgagcccggcttcctccggcgtcagcgggcaccgccccaggctgcgctgctcctccgggacaccgacctgcacacacacaaacgcacgcgatggcggcggcgccaccgtgtcagacaagacaccacgccggcgatcgggttcttccgcaagagatcgagacggagacgtacgtgttccggaggcgcatggcgagcgtcgggaagtgggtctccctgtacgcctgcagctcctccctctccgagtcgccgcgcctgaagtcgcagagcgagtacgccaccatgtcctcctcgaacctcatgtgcagcgccaggtacctgctcggctcgccgccggcgaggagggcggggacgtcgagcatgttgctcccgaacagctgcttgtccatctccgtccgcatcgcgccggcgcggcgcagccgctggaccagcagggagcccgcccgctggatctccgggacgaacttgagcgcgtggaagttgcacctgcatcgcagcctctgcaagaaccgacgccgacgccatgagcaaagcagaggatggatggcaatggtgcttctctcatctcgacaagtgcgacgatcgaggaagatgaactgtgtgcgtgacctgcagatgaacgggcaccgaatcgaagccgagccggttgccgaatccgaggaaatggacaacgccattctgctggagaattgggagcacagctttgatgaattcagatggcgcagcttctttcgagatgtccatgtctgtgatctgtcatgaaacagagagatttcgcatctgtttagactttagagggcatgaattctacagaaatttctcaagatttagtgaaaaaattatgatcttcaaactgatcatagatttttttttctcagaatcaggtagcataattgttagagtagagacactaacttggctgccgattgcttcgagatccagtgactgaagatggggaggcaaatctttcacaatgtgcacatcgctcttcatgtagttcacaaagtagtcctcctgatatatgtcaccgaactggctggtcgaaacgaaaggttcggcgaagcatatcagacaaaagttaccaaaaattatttcttgataaaaagatggcaaatagtatcgcagtttatcaatttcagttcaactgataattgatacatgtcagcaaaagcataaactcagttcggtgtgcttttctttccataatgcgattagtagaactgcaatgattacttacaataaaagtaaaagaaaaaggtagaaccaagcttatactggcagtcatagttgcagttctaaccttgtgtccttccaaacgctgctgtaaagaaacctggggaggactagtgtagcattaagcagagctgcaacaacaacagcattacacacctggaagataaaaattcaactattagctactgaatctgaaaataacgtagtatggattttgtgagcatttcagcactagatccttacagccacacgctgttggttcagaccaccattcgcgctgatcagaatgaacccattgttgttctcttcaggcactgtgaagcacaaatccagtgtgagagatgaaatagttgtgttaaaccatagtattttcccatgcttcagaaacatttcagggtgtaggcatatgctagatgttgatggtttaagaattcaaattgcagaggcttcaagcatcaataaaaaaaagctgcaataagggctttcattcttttaatacagaaggggtgggttaagaattctttttgtcacctgatatggtgatgataatgaaactaattgcaattgcttgaaaggaaaggcttcaccttcatcaggtaaactatgctttgcagcacagggcttccatttacgtgcttgtttgtagggctcttcccatagtgaaaattttacactgtcactgtcagactcgttctgcactggcagggagggaaaatttgacatgagtaaaagctaaatatatgatgtcgtaaattacactacttctgaagctaattggcagtttggtgccgcgtatgatggcagcgtgaaacctttgtgacaactgaagttgccatttgcagaagccttgggtgcattatctgctctgctttctccgtccttacagaattttgcttcagttccttcaattcacaaaatgggattatcaggtcgactgattcgacgagaatatgaagaaatcaattaccggtgttctatctaaatttgcaatacgatttataatatgtcagcagtcagcgtgtcatataatgctgctaggtcctgatcattccttctacaggaaccgtacttcatttgaatggaaattcaagctgctagactgacttccattcagttttttattgcattgagagcgcattggttccaatgaccatgccaaatcagtacatttttgttttcattttgaaaaaaaaaacgcaccatcagatatttttttggatgaaatatcattgcaatccgagtttgtaagaaagcccatcataccatgagacttcaaccaaaacaagtcaaggactagaaaaaatgatgaaaatgggatgcaatttggggacgcttttgtgatgatcaaactgagcttaatttgccatgatttgattcgatgagaggagagcagagcagaggtaggcagcgtacctgaaggcccctgaagctcctggaaatggctgcgttcctgaactgcacctggtggacggcggacatcatcagggacgccaccagcaggaggcaccccatcactcccaccacgccggcgaacaccctcaggtgccacgccgtcacgccgccgcccctcgccgccaccgccgccgccgacgacgacgacgtcttcccatgccgcagcctcccgatgttggtcgccccgaccctcccctgccacgccgccatctgcccggcgccgccgccgccgccaccgccgcaagaaccttccatggatgcccggccgtcccgatcaagaaaccatcgtccttcacacctagcttgtcatcgaggacaacctcctcaccagctcacaaaagcctaacgcaacacggcaacaaccattcgtgtaccgagctgttgaatgattcgcttctcctttttctatttctcttcgtcctcctcttgaccagttcatggacaacgtggccatccaatggcagcacactatagcacgtatgctgctggcgccagattaaagaaacggtaggtcaaacgaggcagcagcagcagggtggacagacagaaacacaaccaccggatgagcaggtgatgattctgatccgatcggatgcagatcgaagcttcggcgcccacgcgcgaggcaacgacgattaaacaaacgtgctcgcctcacaggccaggagggagatggtggtgttaaaaatatgtgatttctatgatagaaaatggttaggaattcaggggaagggaacaacctaacgtgagagggactctcccctggagctatcctgacgatggcttgatcgttgtcaggtagtagccatagcgtagcggagtagaggcgttttgtggaagcaaaagggatggcatttcggttgggaagttgattggattattgtgattgatagcgagaaaaagcaagggagtgggtagccgcctagctagcttagccgcttattagcaggttggttggtgcacagtacatgttatgttagtgttacaagtgtacctgcgagattgtaggtagctgaatactcgtagtagctgattcgctcaactgttgatcccttaatcattgctaatctgacgctgtcaccgattaaacagtgtctgtttggtgtgcagcagctgtgaactgtgaggtatcaagcataattcgattgatccccaaatgtgctgcactgcatgtgtgtgcaaccgaaatggcgacttagtattattgagatcggcgggtgatgacgccgggcgggcggcgtttgatggccggagctaaaagggagaaggcggcttcacgagccgtggctacggtgactcgtgaacaaacacggctttgggttggggaagtcagagcagcgccggccgcacggaccacggtacggggatgtcgccttaacggtgaagcagacggtgcaccggaaagaagttgacccaggaaataaccaacggacggccgcacgttctttaacccgtgatggggtatttcaaatagcatggtggcccatacagctttcgcgactaacatcactatattttctctcatataatagcatatatgttttctcaatatattattcaaatatattaaaatgacaacataattttaaattttgcaataaatttacgaaactactactaatgggtaatattcatattgtattttgtatatgtggtagttattaattatttttaatatcaaattttaattatttgtaaattatatctattcctatatggactctagactcgtcttttaatatttcttttttttagttccaaattttctgtaaattgtatttctatatagactctatgctcttctttcaatattatttatttttatttctgaatttttattatttttaattgtatttctatgtggattctaaactcatctttcaatattctttaatttttaattccgaatttcagttacttctaaattgcattcctatattgactatattgactttaaattgttctttccatgattttcttaatctcgaattttagttatttgtaaattgtttttatatatggactataaactctacttttaatttatttatgtttattccgaattttagttagttttaaattcctatatggactctatactctacttctaatattccttattttttaattccgaatttctatttttttcttaattgtatttctatagactctatactctacttctaatattccttatttttaattctgaatttttattatttcctaattgtatttctatatggactctatactctacttctaatatttcttatttttaattctgaatttcagttatttcttaattgtatttccatatgaactctagtctactcttctaatattccttattttttaattttgaatttcaactatttctaaattgtatttctatatggactctagtctcctcttataatatttctttttttaatttcaaatttcagctatttctaaattgtatttctatatgaactgtcttttttttctctgattaatatgagaatttctaaaccatgagagcgaacgtggaggctcctttttctattcctctaataatataatagattgcttttaaaaaaattttaataaatgttttattaccaggagcaacactcaaactatagttatcaaatgtgacggtgaagtgtgccgctcagttttcgtgatggttagacttatcgagttgttcgaatcaataaactgctcggtaaaccgggtaaccaagaaaaaaattaaactaaaattcaaactttttcgtaaattttgtattattttgatcagtttttttttcttaaccaagcaataatcgtgattctcgacagaaccgataaagtgttgttaagttaggctctgtttgattcagcttaggattattataatctaacttattagtagtaagctaaaacaaacaagtaaattattatagcagattattactctctccattttttaatagatgacgccattgactttttctcacatgtttgaccattcgtcttattcaaaaaatttacgtaattataatttattttgttatgagttgttttatcactcatagtactttaagtgtgatttatatcttatacattcgcataaaatttttgaataagacgaatggtcaaacatgtgagaaaaagtcaacgacgtcatctattaaaaaacagaggtagtatcatctgataagttgctctagaggagcttttttcagattattgagtggctaaagacccactactcctacatatttgagaaaaattacccacctataccatcgacctaacagatagctgagggcattatagactttagcctttcaaacccaataatccatacctccaataatccagacaaacaaacaactcacagcttattatatatcagcttattataatccagcttatagtaatctggattaataatctagattataataatcataaactgaaacaaacatggccttaatccctcccacgaaggttgagggggatttggaggggtggaattaatccacctcaattccctccaacccttaggcctgcgttcttttctgtgggctgagaactccttccctccgcatggcaaatagagcaatttattaacgtttgattaattaagtgtttgtttttttaaaaaaaatggatcaatgtgattttttaaagcaacttttatatagaattttttttttcaaaaaacacaccgtgtaacagtttgaaaagcgtgcgcacggaatacgaggaaaaggggttgggaacactgagcaaagaacacagccttagttttgttaatccttatggttttgttcggttaatccattcactgagagagattgaagcctgggcttatttgtttaggcttagacttattggcacttatatgatttataagccgataaattgaaagttctaagtttaatggtggtgtcataagccaaaaaaaactttttttttcttaacagtgagtgatttatagttttagaaaagccaaatgaaaagtactttttggcttataagcctataaacaaagagggtcttaagtgagattaatttcacacctcaataaaaccttatcggaagaatataaagagcggcgggaggggcgtgggtggaatttttgcaaaaaggtcctccgcttcgcgtgtaattcggtcgagcccccccccggtgaacagtatccctaagtggatgctttacttataggcccttcgaaagactggatattctatgcgaaggagagaaaaatcgctaattaggaccacgctgtagaacttgaaaggagaggggcttttgtgcaaaacggtgcgcactaaccccccgccccaaccctagtgtatataaattgaataggccctcaaggagcagcattccctgaatgcaccgggctgtaacagtaacatagtagtattctttctcggattgactccatcaaatattgctccaatataattcgcatccctcaatcgtgataacaaatatattaaccctcaccccctaactattgaaacggatgtaatttaattcccttagcggctttgagagttgttttcgctaacatggcatgttgacggctgactcaagatgtggaacccatatgtcagtgtcacatttccttttcccttcccttttcttctctcactcttcctttcctctctgctaccatgacgacggcagcctcgagaggccggtcagtctagatagtggcatgtgcggcaaagaagctagcgccctgacggcgggcatggtcaaccatcctcatgccccctacccacgtcgacgtcaaacagtattagccagcatccccacctcctccctctctgccctggtgtaggcatcgagctcactccctgccttcctctctagtggtatggcggggacgtactagtcaaggaagtcgaataggagacggttgatggtgtcggcgctgtaggtggcgtcaatgagccatccgatcccaggttaggggagagcggtgttccaattgagggcaacgctttgggctcgagcttcggcgccaaccggctctagtgaggcccacgtgcatggagacggagtggatatggcggcacagacgctggaggaacaagcatggttggaggaagcagatctagtggcaggcaagatgctgaatctcgagtaggggtgaaaacggagcagatattatccgatccgatctgctctgaatccgtccgaagtgaagatatggtaagggttttgatatatccgtccggatgcggatagttgcatgcggatgcggatatggtatcggtaatatccggcggatacggattatccgctattttaagcggattatccgataaacgttttggcgaataatccgaatttcacagcccatataaccactcaaattggcccatttgacatgagcgttttcattgtgtaaagattcagcccatccaggtccaccttatccatcaatctatccaggagttcagtccgtgactccgtcggcatcgcgtcaaccaattttttcatcgagacttctctcgatcatctccttttgaccttagctgcatatgtgtaattatgtcatatgcaatatgcaattcattagtagtactgtatgagaattggacatcatttgtggacctccaatgttctatcacctatgtcatgtgatattatttttttctaacatttgtgaacttctatgtcttacatgttatgtgaatacgatatatcatgatgtcaatattgtatgtgtcgattacatacttttggacagaagacaggtcaatgttaacaacttgacattatattatgatgtgatcggtgctttcatgagtcatatgaattgtgatattggtacctcattgttgctcattgtatagatgatcagatgttatatcaattgtatatacatgtcacatccgattattttcatccgttttcgagccgagtccgcaccgactccgcactatttccgacatccgaaataatccgctccgcatctgcatccgcacattatccgcaccgcctccgaatccgattaaaaaatatggtataggatatggtatgactactatccgtctgaactcgatccattttcacccctaagaaagaggagaaaataagaaaaggaataattccactttgactcccttaaaagtgatccgaatctaattcatgaccctcaaccgcaaaaccggataggacgactcctcgaactattgaaaccagtgcaagttgactcccttagtggttttggagagcggttttgctgatgtggcgctgacgtggcgatgctgacctagtcttcatcccacgtggcgcttacgtggcagtagaattaaaaattcatctgtgggacctatctgtgatgcacacattaaaaaatattatggcccactgacatgtggagcccacatatcatcccctctctcttctccttcctcctccatctctcccttctctcttttatctctcatggcgcaatcggcggtctgggcggcgacggtgggtgggagttggagcgggcggcggtggtgggcaagggttccccacctgcgagcggagcagcagaagcaaagcagagcggagcgcgtacgaagaagccaccgccaccactggcggccgccgccttcctcggccccgactcccccatccaggagacctcccagacggcctacatctcgccgactcctcaagatcctcgtccacagtatgcgcgcgcgacacgcgtcgaacaccttgtgtttcttggggtcggtgctcatgtgcggcgacgtgcagcggcgcgggagtcgccgtggcgccgatgggggtgatcctgggcaaggaggtggacggattctcggtgtgtggaaattatggataccccatacctacacgacatgtatagttcgactgagtatggggtgccatgtatagatagaatatccttaaaaggactcgggttaaattccaaacttgtacgtcaaggaaatacccgggatctagtcggttacgattgtatcttatctgtaactacctattccgttagggatatggactgtgctttgtaatgcggaccccttcccctatataaggaggggtccgggtgcctctaggggcacgatttttctcccagatcatacgatcaataatacactcggcggatcaatccccggacagaagtagggtattacttcttaattaagaaggcctgaacctgtataaaattcattgtctctcaacccttccacttttctagcttgatagccacctcctttagtattgccgaaatcttgtttcgacacggtgcgtgtcgtcgacgccttcccgctgccgcgttgcgccggtggcgccttcatccaggccatcgacctccgctacatcgagggcatgctcgccatgctcaacaaaaccgacaggtaacgagcgcacgttgatctgttcttcttgtgttcttggtcgtgtcgtggtttcttcttgccttgcttacctacctgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtgttattgattgtatgatttggagaaaatccaacatccgcccctagaggcacccggaccccccttatatatgggaaagagtccgtgttacaaaagataatctatatccctaacggaatatgtaaatacagataaaatacagtcgtgaccgactaagtctcaaggtgtttccttgatgaacaagttaagaaacaaacccaggatacacataagatattctatctatattcggtatcctatattcagtccaaatatcatcgccgtgtagatatgggatatccataatctccacagtagcccccgagacctttgcagtcaaccatcagagccttctcaaagataataatccgagtgcttcaaaacttatcatgccaaggcctgccgagtagcgaagacgaagactgtaaagggcgaaaagataaaaatatggtgcatcgaatagatgcacctaattaggtgtagcccccaactatgtgattagttaacgaactaaacatatagttgagaaacaaaataataacacaattgtgcatcatatgacaaaagcatacacggcgcctagataggcatgctagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctgggccatgactatttaccataatgaaaataggtatatagcataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaggtactgttcaggcctaggcccatttgcacctccgatacccttaacaagaagtcccgagatccaagcgacgcttcgtcttccccgccggaactctcgccattttccccactccctgctacagtaaagaactgcgccggcaaactagggttcaccattccactcaaatccaccttcgaaaagtgatcaaaatccttcccgtgatccaccgcctcaattccttacctctcccaagccatccctcgaatcagatcagcgcattcggggaaaatcgatggcggaagagaaagaaagctttgaaggccaatgggcgccgtccgacgtaacggaagagaacctgaaggagatggtggcgcacggcgttctccctgccaaggagatcatcgggtggcggccagcgtgtggtgagattttttcgacccccgatacacacgagattgtggtcttctctcatttcttctatggcggcttcgctcttccgacctcgaaatttttccgcgggatattaagcttctatggaatcagcttgcatcacctaaacccgaattccatagtccacattgccaatttcatccatgtctgtgaagcctttttgggaattaggccccacttcgctctgtttcgccggatcttctttctcaagccccaaccgaacaagaataagccatgtgtagtcggaggggcaggatttcagttgaggggaactctgagtcagaagtacttctctatgcccttcaagacctcaaacaaagggtggcatgcgaactggttttatgttcagaatcctgagcctgctcttcccgagtattcttgtcttcctccggtgtaccaagacacttggaactctcttccaatcggagatgaagctgcccaagccttggaattgttggatcgcatgttaaaactcaaagaacaaggcttgcaaggagagcagatcactcggcatttcatcaaatgccgactggcgccaattaaagaaagatcccatacagcttttgagtttgacggcaagcatgatcctaatcgcgaagaaccagactctctggatttcaaaatcatgaaggagagaatgtataaaatcttctcaaatgccatcgtcgtcagctactcacatcggctgccagttgtgccatataatgcattcaatccgcctccgcaggtatgcatctgaaatcttcaatctatgaccaaaacattatcttgtcttcatgttgaattaattaaccgtggaagcatctcatttaggaatatgcattgatgaaatcactcagcgccggtcacctcgtcagcacaccgttcagggaagtggagggccgacaatcaggtcagacccacaacctcaaacctccaaaccggctgggcagataggtcctcgcaagagaaagctggtgcttaatgacgatgagggcgatgacagcaacaaatctggggacaagggcactcccaacaaactcccaaagcataccatgcccaggaaaaaactggctggccgtcaaattccaaagattagaacatcttccaggtataaacctctcgataccattttatttcggcatgcttctcttatagaaattatgctaaatgtcaaaaggacactttgcaggaaaccatccgacatagatccaactggaaaagatcctgatccggctgtgacagagccaaatttatccaaagacgctgagccgactgccgaaaatcagccgactgccgaaagccagccgactgccgaaagtcagccgactggcacccaagcttcggacgacaaggccaatccgagtgatcagccgccgactggaaaccagtcggcaacaactgaaactgcaacaacccgagaacccccgactggaaaccagtcggatgtagatctaaatcaagagattcctgaagctgaagcgcagacaacttctcaaggaccaaaagttggtaatgactcagtgattgggtctccagataaagagcaaggatcccctcacgctcagccaggcacatcctcaggtaactcatcttctcaagtgatgccactctgaataactccagcttgttcgtctaatatcttgggaatacatcaggtccactaggcggcgacgaagaagaaattctccgcataaaggcagctaatgactctcgtcctcctatcttactcaaatggtgggacgagaactctcaagtttccggcattgttataaatcgccaaaaagaagacgaggaagtgtgccagctgaagaaagtacttggagaagccactcgcattgtgaatgtaagtcttctaggtggttgcctttgatgactttgtttttttgttagcaaaactaatccctgaaccaccgtgcagagaatccatcttcgtaatgaagccaagactgcaaccttagaaaagctggttccacatttgggaactcttgaagccgttagggaacagctacacgaggctaaggagcatgccaagaaaacggagaaggaattaagggagcgaattgcacagctccaggactccaacttcgagctgagtggttcatcaaaaggtaatctctagatctgtcccatttgtgctgtcataactggatcctcaaacatttggatttcaaacagcgcaagccaccaggatgactcaaatggagaagcaaatagaagccttgaaaaaagacaaggtagaactggctgcggaaagggattcagccttgaaggaggttgaaggtactgccagctgacaatttgaactgccctctctgtaaggcagcagattcttattataaatgtgttttgtagaccgtaaaatcaaatctcaagctcagtttgatgtcctggttggtaagatcaagaagcttgaaggagcaagagacgaagtcgccaatgtcgctacaccacttgtccaagctatgtttcttaataacagtggtccgagtgcacttgatgcaaccgagatctttgacaagctaagagttgcaccggatgtgtacttcaagaacatcaagaaagctggaagtatgggagctagcatggcattggcaatgaccaaatccttgtacccgagaatcgaaattgataccattgatggctttgcagacgggacaagtgaagaagctgctcttgatcttatcagtaatgctcaaagtgcggctgacaagattgcaagtgatgttgtagagcaattccgcaacaacgaccttcagccgagcaataataactctgatgatgaaaggattgattctgactgagtgtaaatgtagcaaatggaggctcaatttgtacaatactggtgtatttatgctgtgcttgatagttctagccaagtctttgatttcttaaaagcttttatcaagctttgttgagcctaaaacccaaagaagctattaaaaactttcagtcctcgcagactaagtagaaaaaatcaaacaaggcaatgatagaccaagtaagcaaattaaattgataaaaaatcacactccattattatgatgatagcccccgactgacaacggcaagaagaaaacttgatgttgacagtcaagatagggaaatacaatgataagcttaagcatagaaacgacgaagatgttcaatgttccaagagttgtcgacgagagtaccgtcttcgtgcttgagtcggtaggaacctggtcgggtgacttcagagatgataaatggcccctcccataaaggagataacttgtgccgatcccgtgtagtttgaattttcctcaaaaccaggtcgccgactagaaaggcacgggatcgaacattgcgattatgataacgccgcaacccttgtaaatatcgagccgaccgaatcaaagctgcttcgcggacttcttccaatcggtgcaagtcatccactcggtcctcttcgtagcgttcttcacggaaatttcgaaagcgcaaagattcgaattcgacttcactcggcaacattgcttctgccccatagacaaggaaaaaaggtgactggcctgtggcccgactgggtgtagttcgcaaagaccaaagcactgatggcagctgttgcacccatttgccggcatagggttttagccggtcaaaaacacgtgctttaatcccttgaagtatcatgccattggctcgctccacctgtccattgctcatggggtgtgccactgaggcataacaaatcttaattccaaagtcctcacaaaagtctttaaaaactccaccagtgaattgtgtgccattatcagtgatgatccgattgggtactccaaatctatgcacaatgtgatgaagaagtctcgagcgttatctgctgtgattgtgacaaccggtttagcttcaatccacttggagaatttgtcaatggccacaaagagatgtgtgtaaccgccgactgcctttttaaacgggccaaccatgtcgagcccccaaaccgcaaacggccaagacagcgggatagtttgcaactcttgagctggcaagtgaatttgtctagcgaaaaattggcaaccttcgcacgtgcgcacaatcttgtcggcgtcggacactgcagtaggccagaaaaaaccctgccggtaagctttgccgacaatggtgcgtgcagcggcatggtttccgcatatcccagaatgtatgtcctgcagcaattgtctcccttcctctaaagatacgcagcgttgcagaattcctgaagggcttttcttgtataactcagcttcatgcataacataaagtttgctccgccttgaaatccgctcggcttcatctttgtcttgagggagttcttgagaagtcaaaaatcgtatgaggggttttcgccagtcggtttcaaccatagcgacgtcatgagtgcccgcaacttgagtggtatctttgtgaggtactgtcggcgtataaaggtgttcgacgaaaacatcagagggcgccacctcgcgcttggatccaaagttgacaagtctatcggcgtcttcattattatgtcgaagaacatgactgagctcgagtccatcgaacttatcttccaatttgcgtacctcttgtcgatatgccatcatgttgtcgtcaaggcaggaccactccttcataacttggttgacaaccagctgtgaatcgcctcgaactattagacgctttatccctagggaaattgcaatccgcagtccatgaaggagggcctcatattcggcgacgttgtgggacgccgaaaaatgtatccaaagcacgtagctcaatctttctccagttggggaaatcaaaaccactcctgctccagtgcccgaaagtcgtttagatccgtcaaaatgcatggtccagtgctccatgttctccgcgggggcatcctcctggcactcggtccattcggcgacaaaatcagctaacgcttgggacttgattgaaattcggggcttgaatgatatgtccaaagacatcaactccaaagcccacttagcaatacgtccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggtcgttggactttctggacatggccttcttcgtcgcgttcaacgaccaagactgtgctcacaacctgggaggtggctgatacatacagcaacaacggctcctgcgggtgtggtgaggctaagactggtggctcagtgaggagtttcttgaaatcttcgaaggccttctgtgcttcgggtccccactggaagttatctgttttcttcagcagcttaaagaagggcatccccctgtggagattatgggtaccccatacccacacggcatggttatccgactagttataggggataacttatatatatggaatatgtaacagatcatgacttgggtattacgtttccttatatattacggaacagcctaaagtcctagtttgataatattgtaaagtagatttaggaaaccgataccgtattggttaaggtttctatcttgtaatcctgccccccaccctatataaggtgggcaggaggccctctagggggcatgagacaacctgatcgtcagatctatactacacccggcggattcaaatccccaaacaggagtagggtattacctctcattgagagggcctgaacctgtctaaatcctttgtccctgcatccatccactttaggtctcgtgcgctacccccttttattattgccgaattcatgttttgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatactgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgagtggatcctccgcctacacggctggcctattatgccgccgctgttgggcgtctacgacttcaccgccggcctgcctccgtcgccgccgagtggatcctccgcctacacggctggcctattatgccgccgctgttgggcgtctacgacttcaccgccggcctgcctccgtcgccgccgagtggtgcctccgcctacacggctggcctattatgccgccgctgttgggcgttacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccactggccgcctcgtccgccgccgactagtacttccgcctgcacggctgacttattatgccaccgttgttgggcgtctacgtcttcaccgactggcttgccttcgccgctgccgactggtgtttccgcctgcacggctggcctttatgccgccgttgttgggcgtctacgtcttcaccgaccggcttgccttcgtcgccgccgactggtgtttccgcctgcacggctggcctttatgccgccgttgttgggcgtctacgtcttcaccgaccggcatgccttcgccgctgccgactggtgtttccgcctgcacggctggcctttatgccaccgttgttgggcgtctacgtcttcaccgaccggcttgccttcgtcaccgccgactggtgtttccgcctgcacggctggcctttatgccgccgttgttgggcgtctacgtcttcaccgaccggccgccttcgtccgccgccgactggtacttccgcctgcacggctgacttattatgccaccgttgttgggcgtctacgtcttcaccgaccggcttgccttcgccgctgccgattggtgcttccgcctgcacagctggcctattatgccgccgttgttgggcgcctacgtcttcaccgaccggcttgccttcgccgccgccgactggtgtccacgcctgcacggctggcctattatgccgccgttgttgggcgcctacgtcttcaccgaccggctcgcctttgtcgccgccgactggtgtcctcgcctgcacggctggcctttatgccgccgttgttgggcgtctacgtcttcaccgaccggctcgccttcgtcgccgccgactggtgtcctcgcctgcacggctggcctattatgccgccgttgttgggcgcctacgtcttcaccgaccggctcgccttcgtcgccgccgactggtgtcctcgcctgcacagctggcctattatgccgccgttgttgggcgcctacgtcttcaccgaccggctcgccttcgccgccgccgactggtgtcctcgcctgcacggctggcctattatgccgtcgttgttgggcgcctacgtcttcaccgaccggcttgccttcgccgccgccgactggtgtttccgcctgcacggctggcctttatgccgccgttgttgggcgtctgcgtcttcaccgaccggcttgccttcgccgctaccgattggtgcttccgcctgcacggcagacttattatgctgccgttgttgggcgtctacgtcttcaccgaccggccgccgcatccgctgctgactggtgtcaccgcctgcacggctggcctgttataacgccaactgatgctaccttcttcacggctggctacatcgctgtcactactaataggcatcagtatcttcaaaacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgacttcatctttattatcttcggcactggcaaactctattgctgctacttcgcaagttttactacttcaccaaccacgacgtctttgtgaacctcgacatctcggcatgcaataccatgatattttactacaacaagtgactctccaatattcaggatttctacttggacaccttcaacacatatcttcaatcaagcaatgactactcgacgacaagaagctataattctcgactctatgttcagttgtttctcaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactaccgatagaggatctcctcgttatcatcggctgctacatcgctatcgactggatcaccgacatcgtcatcttcatcaacatcttgtcaagcctcatcaacatagccaactctgctgccgttgatgggaaacttcgtcatcatagtcggctatctcggttgccgctaatcatcagtaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgttagctgacctgactgttgccgactggtttcttcgcctccacggctatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaagacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatatattttggagtatctcataagggataatcactcagatcagaagctattcatatgagctacacctggtctatatcacccggaagatttattactcgagagcatgttacatgcgtcatcctttaaagggtgtcgaaggcatattttttggtctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttacccggattttataccacatatgccatatatttccaggtgtggtggaaccatgtgtcttctagggacttaagcacatctgttaaagcagtgtgcgcatggcgtatgcccaatactttggaaatttctttattcacagcattcaagcttctttatagctattttgctatatcactcatcatgttttgcaaagcagttggtatatcactcggatcatgttatttggagaatcacaccgcatatgctatatattgatatcaagtcacttggttgattacgattatcaaaaccactcggttggttggattatttattccttgactacatgcttggtttgttcaattaaccacattgtcgggggctacacctattaggtgcatctagtcggtgcacctgactttatttccagccctccacagtcttcagatttggtaaaagtactcgggagaccatgacaaagatgattgaagcactcagctttggagtaatctggttcgagagaagattatcttttcgactgcgaaggtctcaggggctactgtggagattatgggtaccccatacccacacggcatggttatccgactagttataggggataacttatatatatggaatatgtaacagatcatgacttgggtattacgtttccttatatattacggaccagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctatactacacccggcggattcaaatccccaaacaggagtagggtattacctctcattgagagggcctgaacctgtctaaatcctttgtccctgcatccatccactttaggtctcgtgcgctacccccttttattattgccgaattcatgtttcgacacccccgctcgccaagtcgtgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcacggatgctcgcaaaggtttcttctagatccgagatcaaatcatccttttgcttggtcttgacgactacgtcatccacataggcttcaacgttgcggccgatctgcgttgagaagcatctctgaatcatgcgttgataagttgctcctgcgttttttagtccgaacggcatggtgacgtagcagtatgccccaaaaggcgtgatgaatgaagtcttcaagcagtcggattccttcagtcggatctgatgataccccgagtagcaatccaaaaaactgagaagctcacggccggcggtcgagtcgactacctggtcaatgcgaggcaacccaaaaggatctttagggcaggatttgttgaggtcggtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactctttgaaatcttggtagcgggctcttctccttcgctcgccgtggctgcagccagtcggatatcctctcgggcagacgccatctcgcgagtttgggccatgtcgcaactctccttgtcgcatgtgacggcttgcttgatgtcactccgtagggataggactcctcggggaccaggcatcttcatcatcatataagtgtagtgcgggacggccatgaacttggctaacgccgggcgtccgagtatggcatggtatgctgtctcgaaatcagcgacttcaaagctgatgttctctgtgcgaaagttttcccgagtgccaaaagtgactgggagggtgatctggccgagtggagttgcggataatcctggaatcactccgtgaaaaggcgcattgcttggttttaactcggagcgagggatctgcatatcatccagggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcgatctctgaccatcgaagatattggggcgtgtcgggctgaacagcattgatctcccgttcagttaacttctgcttccgtttagactcataagccagggggccgccgaagatatggttgagctccttgcggtgatcttgaaaacctgccggggtgtcgtcgtcgtccttcttcctcgacgtgctttgttcttcgtcagaattcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccacctcctcccgtagccggcgtacccttgttttgcttccaactgggacccgactgctttgatgcggtgacggcgtcttcagccttggcgtactcgttggctttttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19714 - DNA, 19009 bp, Oryza sativa
  unsure (1)..(19009): unsure at all n locations
tccacctgatggtgtaaaagccattgagtgcaaatgggtctttaagaaaaagacagacgtagatggaaatcttcacatctacaaggcacgattggtggtgaaaggtttcaaacaaattcaaggtgttgattatgatgaaacattctcaccagtcaccatactaaaatctattcggattgttttagcgatgctgcctatttcgattatgagatatggcaaatggatgtcacaacagctttccttaatggaaatctcgatgaggatgtgtacatgacacaacacaagggatttgttgatccacaatcagctaaaaagatatgcaagttgcagaaatccatttttgaggcaatcatctcggagttggaatattcgttttgacgaagtagtcaaggcgttgggctttgtcaaaaacgaagaagagccttgtgtatacaagaagattagtgggagcacactagtgtttttaatcctatatgtagatgacatattgttgattggaaatgatattcctatgcttgaatccgttaagacatcgttgaaaaatagtttttcaatgaaggacttaggggaagcagcatatattctaggcataaagatctatagagatagatcaaagaggctaattggattaagccagagtacatacattgacaaggtgttgaagaggttcaacatgcaagattctaagaaaggtttattacccatgtcacatggcattaatcttggcaagaatcagtgtcctcaaacgactgatgagcgaaacaagatgagtgtgattccatatgcttcggcaattggatccatcatgtatgccatggtatgtacacgtccagatgtttcatatgcacttagtgcaacaaactgataccaattagatccaggtgagagttactggatagctgtaaagaatatcctgaagtacttgagaagaactaaggatatgttcatattctatggaggacaggaagagctcgttgtaaatggttacaccgacgcaagcttccaaacagacaaagatgattttagatcgcagtctggatttgtgttctggctaaatggaggtgctgtgagttggaagagttccaagcaagatacagtcactgactctacaacagaagccgaatacattgccacttctgaagcaacaaaggaggctgtttggataaagaaatttgtttctcaattcggtgtgatggctagtgctcccagccctatggacctctattgagataatagtggtgccattgcacaagccaaggagactagatcgtatcaaaagtccaaacacattttacggcagtatcacctcattcgtgagatagtggatagaggagatgtgaagatatgtaaaatacatacggatttgaatgttgcagatctattgaaaaaaccactccctcagcctaagcataaggcacacactagggcaatgggcattagatacgtgcatgattgactccagtgcaagtgggagactattggtgatatgccctagaggcaattatagagatgattgaatcacatactatgtttacatacttatccaacattgtttcttgaaatagataactcattattgattaatgaatatgtgattctttcatgagactctttatgttgtatgttgtaatttctaaaggatccctgatcaaatatcatatgtggaacaaatatgtttaataatcagcacatgtattaaatgatgatcatgtctcatggatcatggtatagagataccaaattaataatgtggatacatgttggggaacaagttgttggatagacccaatatgagacactgtaagagccatatgtgttatgtcatcagtgatctcatttagtgttggtgttgaatccttagacctgaggttatcacggttcccaacatgtgtagtagcttacttagggactgctaaacgctactccataattgggtagttataaaagtagttttcgggtatgctatgacatatgtagtgggatataaataatcaagatgggatttgcccatcctatggagagatatctctgggaccctcgatgtatagattatggaagtgcacggctatgccaaagatgattgaggagtcaatcacaagttatataatctatcacaggttcgagtgaatgattgagctattagaggatgacacatatccagccttgagcttaatcgatattgtgagacaaaggggttcatacaagtatacactagaggttcagccgatatgatctttatgtatgcacggtgggtcaatacgttctgctaagtgccgctgttgacacgtggaccgaaaaggagttttcgggttacagccgagtgtatatgagcctataggtcgcacgcttaaagggccggaataaaggaattggatggagatccaatacgcattcaatcggatagggatccgagtaggactcctatgggcctcgaaggcccagtcgcggatcctatatattcgtgaggggaagtgaccggcggaattaacacaccacgtgaaaccctagccgtcactcccctccccgagcaaaatcctagccgcgcgcgggtgctagcacatctgcgcgtggcgttccgtccctgtacgtgtggataccagtagaggcgttgctggtttgcggtgctgatttgcgtgggagtacgacgagaagaacgcacgaggaggagaaggtcgagccggtgcgatcgactacttcctctacatcgacgcgcgccacatcgcgaaggttccttcgccttcttagcgccttcttccactgcgcagcacgtcgagtggtaacgatctatgatctaatactttcatggttcctggtttatgcgctagaacattttggtttatgcgctagaaaattgagcgctcgccggtgatatcacaactacgcaaccgtggcacagagcaggcaaagtcatggatcggaggcacggtggatgtaaggtgtctgacgcctaggctgcatcttgagtgctccatggcccgctcaacacaccgtgcctcggtcagctctaccgcgtcctcctaggctcctctcaccctccgccacaactccaacggtgcgcgcggcgtgatggcaatgccggcgaaagaggggatggcgacggcggcgaaatagatggctgcacgaggtgaatcagaaccagggcggtgttggaggggcgcgcggcaaggactattagccgatcaaggcgcaccggggaggatcagcatccaagcggagtggagcggagcgcgactgggagaaacgatgaccaagtgtgattgatgggacaactggataaggcgatgggcgcgagggtgattgagggtatagatgcggaattgctaatgcgctatactcctccctcttctcccccttcctcctccccttcttctctttctactaccgtgcaccacaaatttttttaaaaaaacaaaagttagaaaaaattatgtatagaaatactatatgtaaaaaaatttgaattgacttataaactttggatctactttagttgtataaactttagatgtatagaaatactatatatagaaaatatttgaattcaaattcaaatttgaatcagatataattcaaatttaaatttgaatcgggtatgtatacttttgacttataaactttaggtctataaactttaggtgtataaactttagatgtatagaaatactatatatagaaaatatttgaattcaaattcaaatttgaatcagaattaattcaaattaaaatttgaaacggctatctaaacttttgacttataaactttaggtgtataaactttagatgtatagaaatactatatataaaaaatatttgaattcaaattcaaatttgaatcggatatataaacttttggtctctaaattttataaacttgaggtgtataaactttaggtgaataaatttactaaaataggaaagtaatgcggtgctaaaaaagaaaaccaggtggagggaggaaggagggaggggggcaaatctgattgctacccgatccccagggcgatcgatcgcccattagaagtccccgtatagatggccaaacgagcagcatggcctaggcacggccgtgctcgggccagaatttatcgggccggcatggcccgaccaacacaccgggtcgtgtcgtgccggcccacgtggtcaacctgtggcccaggcacggcccaataatggtcggaccgtgccgggccgacccaaaggcacgggcaacccatcgtgctttctttgaattaagtctatttctcctccctcgtctttcagcatatacatagctaaaataagtctattttacgtctctaatctttgggccgtgccataaaataagtctattttacgtctctaatctattgggtcctccctaatctttgtgccatgtcttacatgcggttaaaaataagtctataatctccttgaagttcgtgccgtgctgggccggcccaccgtgccaagccataggcctaggcacggcccaacagccgggccgtgtcgtgcctggtccgggacaaaatcccgtgccgtgggccgggccatcgggcatcgggccttatggccaactatagttgaggggaggcgtcgtttgtggggaagtcggtgggtagatcgtgattcctatcttcaattgctaggcacagccgtcagtgttcaatttaagccgttgaatgaaaagatcgaacagttgttaaatgaagaggggatttctatgtacgttttgtttggtgaatgtagcaaagaatacaacttctacttttatattttatattagtatagataataataaaacctcctgtatcttgtcaaactacataaagggctatataagaagtattattgaaagggaaaaaaatccaaattacaccctaacagtgttcgcatagagcgtagtctggattgtctggaccatgtctagacactagacgatggattatcatctagtttagggcctaaaccatgaattacactgtttcaccgtctagtcggtcaaagaaggtcctagattatctagactgcacaattagacaacagcaaaatgagtatagaccatttaactgttgtttaaactgtggtctgggcaatggagcaatgcattttttttagtaggagctaaaacttcgtgccccacccaaggcccataggtcttagtgtttttacccccattccaaagccttcccctctgctctaatacactcacaaacacaaagctacgttgccttgcctctactagttgccactgcggaccttgctctcacctctctctggtctatggctctacgcgagtggatgcacctatcataacatcgctagttcttcaatattttattagacataataagtgccaaaaaaaatacgaatagtgtaccatatagtatatcttctagactagctagattcttgtaacgacccgcctctcctaggccgggcccgcttacatcctcactccgtgcgccccggggagaattntccggtccgtcacccatccccaattgctccaagccaagcacgcttaaccctggagttctttggagatcggcttccggaaaagaagttgcaacttgttaatatgagcattctattaatcctattaagccctaggccgggttgttacatcctcacccccttaagagagatcgacgcccccgtcgatctaccccaggcaggcgggcccgcttacatctggcagctttcataggtcatagactgccctcacagaccaacacatgtcttttctacacactttgtcctcactcgtgcgtacccgggaagaattttccggtcggtcacccatcccaaattgctccaggccaagcacgcttaaccctggagttctttggagatcggcttctggaaaagaagttgcaacttgttgatatgagtattctattaatcctaaacttgtcacgcccggaatttctatccaaaattccaaacgcttacatgtgtgcgaaccctcgtccaggaatcagccgaggcacacaataacaaattgataatagagtacaattattactctaattaataagcgaataaaatgtcattacagagatagatagttcctctcaatcaataaagatctaagcagcggaaaaataagataaacggcgcagacgactattgacagaaaacacgaggcctgggagatctgcttaactccagtgcaggtccaaaactcgccttcggatgtatgagcgtgccagttgatttgatcctgcaatcaacaagaaataaaacaaagaaaccgcaattaatcctataaatgatagccgatcggctaggtgccgatgacatatcatttatttcaagccgatgtcatgcgtacatcgatcggcaaatatcaataagcaaatcagaactaaatctacttgatcggctgtagatattaatgatatataatccttatatcgatatatacttaaatcaagtgattgggatatatcggtcgccttgccgagacagtataaatcacttagatcgaaatatatattaataatgggattatatacatttatagcatagccgatcaagtggatctagcatgtatcggctaatactccgataccactctatattaagatgttaaagcaagtagaatataccaaacagaagcctaatatacttagatgcgccaagatcttaacataaagggcagatttaacatataggttaagcatatggaataaaagtagttagatcagataagatcggctgaaactccgatactaccctaatcggcaactgtggacccccgtttttataacaggaatcaatcgtgtaaacagtaccatttccctggatcaagtagtttggtacacacgaattcatagctgaaataccaagtgcacatacacgagagtctagtacgaattattacatcataagctcgcagccgcagtcttaaatcatcggaccgagcggtccggaatacattccaaaaacagaagtaggtaaggcagcggagttaaggcagcggcacgctattgccacaggcaacgaccgtaactaagacctactgagtgccatcgtcttcatcaccctcctggtaatatgcatagggatcctccgaagcttcatcttaggcctctaattaagtttatatttgcaagggtaagtaccaaccgtactcaacaagccaccatagcaacaatgcatatgacaggggtattcaaaagatggctatggttcttttgcgcaaagcaagttttgtaattcttttcacaaacctaagacctagcacagactgatcaaattttagtaccagtgttcatattaaataatgacggttctgtccaccatccattgtgatcccaaggatagcttcccgccattgaatcgtcatggttttctgaggacgtccaccttccctcctctcaggaagtggctccatcagcatagaaatcatcatgcaacatcccatcccacacaagttaagaatttagagtctagccaagtgtaatacatgtcccgatgctcaataaccgcgagcatggctattcgaatagatttggtttactcacactgcagtggatgtacactttacccgcactccgcgactgcccaacacatgagccttgtcccaacacatgagacatgtcacggcaaagcttttcgataacctcgcattggcagtacccgctccatgaactttacatcctcatgcactttaggcgtacacggtttctagcagtgagaggagttctggcgcacccgggaagggaagacttacacatgcattaagttataatttagattctcacatggcagtcctaccgatggcgacatcattgtagacacccgcctcgcggtcctaccaatggctgccccaccgtagagcccctgcctcacacatcaagaaaccactatgcatggatattgcctccgctcagctatctactccgctaggtctatacccattcgagaagtacggttatacgggggtcgtttcatgcttaacttcatggctcggtccttaattgaccagggacggcactagccttttttcggataccacccaaatcctccatccgccccagtcgaaaacatttgtttagtttcattttcctttcacaaatcatgtcatcaatatcgtggcaatgtggcgctcatgtctccacatgccgcatctcaattaccttcccaaaggtaattgctcaagcatatatcatttgataaatatgaatatgcataaatctagagtagcatttctaagcatttgtcatagttgactaaggacttatacgtaaatcatggttacaaggatttaagggtaaacaataatcaaggcatggcataatcacaagtaggatgttcatcattgcatacaattttatttgtaaacaaaataatttcgcacttgggatcaacatgttcaaagaatagtgatgacttgccttgctcaaagtcttgcgggtcttggccttcacttggccttcacttgctcaaattgatttgaattcggttagaattcaaataaaaatccaaataaatccaaatggaagtcaaatgcgaaagtcgattctttttattaactttactattcgctaactagggcaaaccctatttcgatttatacatcctaaactatttttgcgggtataaatattttgttaccataagtttttaatttaatctacccgagcattatatccatataataggttagaaatttctatcgcgagctaaatatcggacaaaatcctaaaattatcttataatattgtacgatttaatttagtctatgactaaacgattaaatataatacacggctaaaattcctagtaattgaatctgaattcctaccgtgaatcgatgacttatagagattacgaaaaataatctataataatctttaagaattcacctaattgtttagttattaattacatctaaattactaccgcgaattgatttcttatagaaattaccaagaataatccataatttatattaaactttgcaattctacgactataattaatctataattaaattctaattattttaaattttctaaacttccctaatctccctctaatttctatttatttttttcttttctttttctctcctcttttctctcttttcttttctttttccttctctttctctcttttcttttctttttccttctctttctctcctcccggtttctctccttctttctttctttctctcccttggcttctcccttcctctctctctccctaccagaggcggcggcggcgacagcgcgcaaggaggggggggggggggcggcggcttaccgacggcggcggcggcgacataaggcgacggcgacacccggcgcggcacacggtgcggcgcggcggcactgagggcggcggcgcgaggacggcagcgcggcggcccgagggtggcggcacggcggcacaaggacggcagcgcggtggagggaaagaggggaggaagaggaaaatggagtggggaataatggagaggggtggggtgtttatagggaaaaggagaaagagggagagaaggaggggggtgacgcgacggcgggcggcgcggcgcagggatcggggcggccgggcgcaagatgacagggcgctcgcgcggcgacgggacggcacgtggcgcgaggcgcgaggcgcgacggcgacggccgacggcgcacggcgcggcaggcgacagcggcacagcggcgatggcgacaggcggcgatggcgacggctcggggcgcgaggcgcgcacggctcggggctcgcggcgaccgcggcacgcacagtgatggcgacgacgacggcagaggggaggcggatcggcgggcggcgcacggggcgcgagggcagcgcggcagaggaggggctagggctagggaacgcgatcgaacaccttgggagcaatgaatagtgacttttcctatttatcccgattttagtctatttcctatataaattccattctataattcctaatttttacatatactaattttactcaatatttgtgttattccaaccaatgcattcactcaagattaattttacccatattttatctttatataatttactttaattagagttaattcctattccatcgcatttaaatttaattgataccaatatggtcgtgataatattttatttatttctatcctcacctaatctttattttaaattatatttattttgccaatttatttttagggtttattcctaattaactattctttattcgcaattaatgaacttcgaaatcaaatccaaataaaatatgcgaatgaaatcggcatgatgcaattaatttaaaaagttattgaaaatccgtatttttagagttttgtttttattggttaaatttttagggtgttacagcaaccagaaagcaggctggagattgcaattctaagcacgacttaatagatcaaactcaactaatgcagcattaagtatgaaaagaagaacaatatctagacaatcaagccaccggaagtttcatagagtggtagatatatcacataatctaagttaacgtcattgtctaacctaatcggctgccttccattaacagatgttagccgattataggttagataaagatattatcgaagattatgtgagatatatgataactcgacgaattatacagacaagattagagtatcataaagatggaagcactaatcctgagaacataagtcgtcatgacaagttttacctcttgttgaggatcgaaaccgatgcagctcaacccgagagtacgaactcatcgaaataaaagtaaagcaaaatgggtggcgatgcgccgagattgtattggatgtgtgtcttttttttacatagggctcgggtctatttatacccgagaattacaagatacgtccataacagacatgactattatctctaacaaactctaagataccataagtctttacggcagacttttgcccaaacatatctctaaggaaattacatagaatatcctaattaatagatacaattgcctttccaggactctatccatgcgtggcaatcatcttgaagcacatcaacttgaacccgatgacgtacaccgagtcatattatcggaatcggctgtatcggctagccccgtccgactcgaactctgccgacctgaccttagccgatttggactgcagccgattcttactctattttcgcaacgatcttcatcttggattccacttcaatctgatcttcacctccgatgccaatagtgatagaatttactaaatttggtcgttaacacatgccccccaagtccggaatattggataatgtttcggatttgccatataccgactctgagagaaactcgcacttgctgttttcccgaccgttatcgctctgctttaaatactaatcgttgcccccaagaatcttcacgccgtgattttcgtcttcaccgctttaaacagatcccgtcctctctctctccagtgacctcctcaacgcgcattgcgatttccaggcgattccactcccggccagatcttcacccgcgacgatgtcgacctccaccaatccgaccgccgcatcatcagccgaatatgctgaggtaagtccccatcagctagatccccttttgcgttcatcagaccggttttcgctcaccttatcttgttttcttcttcgctattcttgtagcatgtttccaatcttgttgcggttcccagtctgttgcatgaccaacaatactttctcggtccaatcggcaatctagaccccgctgagtttatcatagccgaaaccaacagaaccccttttaggtcggccaatccaaacacaagccattggaaaaacaccttcaaatcctggccttctctggagaaaagctggcctgtatggtataagaggatatcggctagcaaacaagcctattgggatgagatcggaatcagccaagccctagccctcacaatagcaaattcggccaaagatgaacccctgatggctgctgcaacttatttctggtccaacactctcaatgctttccttttcaaccaagggccgatgaccccaacgctgctggatattatcatgctcactggcctagatgtaacctcatcagctaaccccatgaacctgaacaccaagaacacttttgagttcaaaactaagagcattgggggttggtcaggatatatcacagcatatatgggcaaagggccagtcactcctagagaacacgtagcttttttgctaatgtggttggaaaaattccttttctgcggatcaagctgcggtcctacaaccaactagcaattcttagccaaggccctagcaacgaagaaacaatttcccttaggcaaaatccttctctgctatctataccagatattaaacaacgcatcggccaagataattatcggctcagtggttggagcaggtggaccatggtggctcttgcaatcctggctgaacctggtagtcatgaaagttgtcaatcggccatctgtgacagaagctgaatttccaaggttggagccgattgtggaagatgatggagaagaacgcacccatcgtagatgtatgtcatacggagaatatgcatctactccagccgatgcaggagcaaagttatcggctgaacttctgaaggactggttcttcagcttttatgacggattccaaaaagatgcccgagtctggttcttctatgccgactcaatggatttcgaactgccagccgatttcaggttcgaggatattaatcatgaaaagtttcagcaatccagagaaatctttactactgctatcagcccatgtatcctcccagtcggcatccatcaaggaagaaatatccaagtcttggaatgggacaattgccaatcggccagacaacttggaatgggacaattgccaatcggcctgtactttgccaacaagatccaatgcagaggcgacatctcctcaactttaatgatggatcggctgttgaacatccctggacctccgttgggcagcattgagaacataaagctggcaaggttcaggagtagggcatttgacagatggtggggcgagtggaagctgcatctgttccatcaatcggcttccatgtacatgacagacttatttcctgatgctatccctcaggttaatcttcatttcttcaatcttgcttgaatagtcactcagccgatttgaaccttgactaacttttcttctgttttgtagacaacagaatcttctcctcctcgccagagcaatagcggcaaggtcattaagtatgctccgggtctaattcaaaatggaggtgggccatctccttctaccatcggcttcaatgcccccaagtctttagcacttcttcaagggctcatcagagaaccagccgatgctagcaagaagcggagaaccagatcatcagctgcagatacttcagctccggctccgaagaaaaaaactaaaacaaagaaagctaagccagctgatgatctgcccgccctagatccatccattgaacaagctctggatgaagaagaaatcgaggaagacatcgaccaggctacagccgaaataagcgatactgaaagaacaccatcggcttcacctaagcaggctcctccatccccttctgcttcagctcaattggcaaaggtaagcaactttctctgtccacttttgcagtcatttacttttgcagccgattcctcacaattttaataaataaagagaaagaaaatcgctgtgaggaagagatcggctacttcaacccctaaaccagctccaccagtaagatacttttatcatctcattaactgatttgggctgattatatctaatatttatccctttaacagcctcctcctccttcttcccctcttgtgcaggcagaatcagcggccgcactccatcggctgcaggcagtcatcatgttgaagaggaagaacaatgagctgcacctactatcccagtaagttttataaatttgagatcagccaatcatatcttgatccttaatcatccatgatattgtctcttgcaggtcttagccgatctgttctcctttgacatcaaagattacctcgatgaaacagaagaagacaccaccagtaaagcaacagttctcctgtctgatgatgtgaagaaaacactcgaagacatctcccatcggctaggagcatcactagataacctggtgaccaattgtggctcaatccgggcaagatttgcagatatccaagcctttcttccggacgaattaaccgacgctcttactccagctgtttacctcgagcagcatcaattcaaactggagaaagccaggcagaggttagccgatcgccgggagcgcaaggacatcgaggctacaatccaaaccaatcggcagtgtgttcatgaagagaaagccaagcttgatcatttatctgaaggcccgatcaaatctaatattgattggcttgaagctcgcaagattgaactcttggcacaactttaagaatgcaatgctgaactggatctagagcacaggaagttagccgatctcccgcaagctgtcgaagaacagaaggcaaggctaaaatcagctatcaagaacgttgctgagatgactaaatccttgaaagtcattcctggaaccgatgctcaagacgcccaaactatcgaagaaatagatcaaattaggcaaagggctatatcggctatccagcgatacttgtctcagtgatttccatgtaatagtctgcagaaaactgttgtaatcggctaagacaccctaattactttgctgtttatacaatccctgtgccatccttgtgccggcttgttcaaaaatttgcaattttctttgcaattctctatgtatgtgcccccctaattttacaatgttgaaaacattgacaaaattatagaaacaactaagggcgatataacaatatcggccatttgcacatcggcaaaccacaaccgattacaatagtgaaaagcaactaagggcgatataacaatatcggccatctcaaggcgatgtaaacacatcggctatcatgtatcggcaacactagccgatcatgcattaacccaaacactgggataatatttcttcaagtatttgccatttagagctcggccataaacttctccatcgagtccttgcaacatgtatgctcccttagataccaccttataaatttggaacggtccttcccaattcggcgaccacttgccaaatttgttatcccgagtcccaatcggcagaatcaacttccatacaagttcaccttccgaaaagtccttgggtactactttcttattataatgccgggcaacgcgctccttatccctagtaacctttgcaagggtcgtagccatgattgaaccagatcttccctttcatcggccataaggttataatactcattggcagttaaagtattttgcaactctgtcctcctcgagccgattcgaacttcccatggcagaacagcctcatgaccataaacaagtttataaggaggaacctgtatcaatccatgacaagccatccgataagaccacaatgcttcagccagccgagtatgccattgccgaggataatcagaaatcttcatcttaatcaacttgatcaaactcttattagatgcctcggcctgcccattagcttgtgcataatacggtgaagaattcaacaatttaattcccatgctatcggcaaattgaacaaactcatcggatacgaaaattgaaccttgatcagtcgtaatagtttgagggataccaaatcgatagattatatgctcttgaacgaactggatagcgtccccagaatcaactttctttaaaggaatggcctctacccacttggtagaataatcggttgccaccaatataaacttatgtcttttactcgagggtggattaatcataccgatcatatcaattccccaacctttaaaaggccacggtttaataataggattcatagccgatgccggcgccctttggattgctccaaacttctgacaatcttgacaacttttataatatctgaaacgatcctccagcattgtcagccaaaaatatccagcacgtcggagcaaccacttcattttatgagccgactgatgtgtaccacatatccttcatgaacttcgccgattgcaacttttgcctgatcgacactcaaacatttaagcaacactccatcaatcgtccgataatagaggtcatcatccaataaagtatatttcaaagccttataatgcaatttccacgaagccgattgagatggattctgtaaatactgaaacacatcatatctccaatcatcggctataatagtagcaatctctatctcgatatcttttgtcattggcttatatcccaacgctccttgagccaaactattacgactctatattctgttctcgagatatgtgcttcaaattcaccagcctagattcacttatcaacgttcggaacttttcgtaataaaccatcaatgtatcatccttgcattcatactctcctgccaattgactaatcaccaacaacgaatcacccatgatttcaatagcatcggctgctacttcctgaagcaactgtaacccttttaagaccgcctcatactcagcctgattattagtcacacggtgtttaatagcataggcaattcaaaacttgccccccaaggcgcaattataaccaagccgataccataaccatgactgcatacagatccatcaaagaataatacccaaggcataatgtcaaccaagccgattgaatcatcatgatgacccacaataaaatcggctacatcctgtcccttaatcgcctttggtgattcatgctgaagatcaaactccgttaaagaaaatatccacttgccaactctcccttttaaaatcggagccgatagcatgtacttaatcacatcggctttacacaccatagtgcattcattggacaacaagtaatgcctcaacttagtgcaagagaaatataaacacaaacacaatttctccacaggagaataccttgtttctgcatccaagagccgacggcttaaataaaacacaaccctctcttttccttcaagttcctgaatcaagaccgagccgattgacttatcaccggccgacaaatataaccggaaaggaatccctttttgtggaggaatcaatactggaggagaacttaaatattctttaatattatccaaagctttctgttattctgccccccaagtgaattgctgatcggctctcaatcttaacaatggtgtaaaaggttccagtcttccagacaaattagaaataaaccttcgaacaaaattaattttgccgatcatctcctataactctgtcttgttttccggaggcttaatctttttgatcgcattgatactcctctgaggtatttcaatccccctctcatgaaaaagaaatcccaagaactggccagccgatacaccgaaagcccattttgtcggattcatcttcaaaccatatttcctagtcctctcgaaaacctttctcaaatcggctatgtggtcctctatttctctggatttaacaaccacatcatcaatgtagacctcaaccaaccatccgatcagatcatgatatatataattcatagccctctagtacgtagctccagcgctttttaagccgaaagtcattacaacccattcaaacaagccgattgcaccaggacatctgaaggccgtcttatggatatcttcttcggccataaagatttgattatatcccgcgttcccatccataaaacttagtatcttatgtcctgaagcagcatcaaccaactgatcggatattcatccttcggggtagctttattcaagtccctgaaatcaatacagaccctcaccttaccatttttcttgataacaggaactacactagaaacccatttagcatatcggcaaggacgaataaaaccatcatcatacaaacgtttgatttcagccttgacaggttcaagcatatcggctttgcatcttctcggaggctgctggtgtggtctaatccctggttttaaaggtaatcgatgctcgacgatcgatcggctgagtcctggcatctcataatactcccaaccaaagcaatctctaaactctttcaaaagctccatcagcttggttctaaattccgaagacaaattcttactaatgaatgtcggccttggtcgatcacccggacctatatccacttcttccaaatcatcggccgacataaaaccctgaccttgcttgtatcgagatcatctaccgtgtccttggcgtagacgcttgaaccctccacaacgccctcaaaataatagcttggattcttcatcttcaatcagctgtcggctggcacaatctcaaccttgtcaccttgccattgaatcaagcattggtgcatggtcgaaggaatacaacaattggcatgaatccaatcccttccgagcaataagctgtaagaaccttttccatcgatgacaaaaaatgtggtagggatagttttactgccgattgtcaattattctacattcagaacaccctttgttcccgatgggttgccaccaaagtctttaagcaccatgtttgtcttgatgagatcctcagtagttctacctaactttctgaacgtagtataaggcatcaaatttaccgcagccccaccatcgaccatcatcttagacatcggcttcccattgacatagccatttatatacaatggtttaagatgccgattttctatcccctcaggcttttcaaagactgctcgttccggtgatagaaccaacttagccgattcctcttccagttcgtcaacatcggcctagtcaatcccgaattcggctggcaaagtaaagaccatgttaattggcgccgttaaaatacttttcccttttgccaacctctttgcttcgtcggctgcaatatcatcggctccaagaacttgattcttaacacgccactccttccttggctttgctttcctcagccgataccaatttcttgctcgacctcctgaaagcgctccctgctcctcaacctttgaacccttctttt

SEQ ID NO: 19715 - DNA, 11196 bp, Oryza sativa
cggtatgcaccatgttaacagggaaaggattaccatcaaccttcatcggctttttggaatcatcaaacttaatcttccctccttcaatggctacttgaatttgctgtctaaaaaccttgcaatcattagtagaatgagatctagaattatgccatttgcaatacctccttttgcctagttcctcagccgatggaattacatgaccagcggggagttgaatttgcttctcccggagtagcagatcaaaaatcttgtcagctttggtaatatcaaaatcatatttctcctcttttccagaattctttacccactgacaggtataacatttttactccttacccattcggctgcagctatttcggagtcatcgtcgtcatcatccgatccatacatgtaagggcagacatgattaaccctcttagagcttctcctggcctctgcaaacctctgttcatgcaatgttaccttctacacgagatgcgacaggctatcaaaatctccagatgagaatttcttcctaatcggaggaatcatgccttgaaaagccaaatcggctaactgggcatcagtcaaactcaagctaaaacacttgttcctcatctccctgattctctgaatatactcatgtacaggttcatcatgcctttgtttgattgctgtcaaatcagataacttcatctcatgaactccactatagaaatagctatgaaactgcttctccaaatcggcccaactattgacgcacccatacggcaaagaagaaaaccatataaaagccgacccagacaaggacaaccggaacaatctaactctgagagcgtctacagccgatgcttcgccgcactgagctaaaaatcggctaatgtgttcataagttgacacaccatcttgtcctgaaaatttggagaagtctgggattttaaatcaattttaaaccactcagggtaaggttgccgatacaattttccagtatctttcggcttaagcccaaattattctctcatcacatcggcaattacatcagcccatggtcgttgttgagctgctccttgcgactgttgccgtattggttcaaactgattatattgagaagcaaactgaggttgagttagccctccttgctgatactgaacttgtggggaaggaggctgatattgataatttatattgcctccttggtaattctggtaatttggctgaatactttgtaccaagtgctccggcacaatctgaggcatcgtcgtaccatctggctgtatatggtgaactaaatgttctggaacaacctgattcagggcatgtccagcctattgcccagccgattgattcatcaaggcttgctgcggaatcggttgtatagtttgttgtcccggaggtgttggctgaactggctgcacaacctgctgccttggtggagtctgttgaatcggctgcacaacctgttgccttggtggcgtctgctgaatcgaattgacagtagattggaggggtagaaacatagcagccacctgatcctatgctggccgatttaccgtctgcccgctatgctgtggctgctccctcatcaatagccgaggattaatcggctggcctggtgtcgacgatgatggagcaagcaaagaagtcaagtgcgcgggataagaaaggatggcataatatagtctcatttgcataaatagcatttaataaacatttcagaatttcataaaacagtaaagtatttcattaaacagtattaatccaacgctatacaacaaaccctgttgcataggcccaaccattctgaacaaccaatcccggctgcacagttctatctccaaaccaggaatatatcattccaaaccaggagctaaacaaattattaacatcatcatttattatggtgtgaaatatgagactaatcacgaaagacattgttagacctgcccattaccgcgggcacagctattcgaatagtttaaactctggccagaggtgtaccactgtacccacaagacacaacctcaacatcatgtcaaccatgcgtcgcgatacttaacaagtacccgaatagagattgtgacaataccctctatataacacaattcaaagcagtgcaccattcccggatcataatcacccccttgcaaacaaggcatggactccccagcgacccccgtgggcttatctccgccacttcacagtctggtgctctacaatgaaccatactatacagaaagtaaagccgttgcccacgctggcttgtggttggcacggtaaatgtttcacaaccaaaaatcgtgaaccggtccttaattgtcatgagcacgaccatcaataccatgtgctcacatcccaccattatcaggttttagttggcaaattaattaattaaccaatcatgattaaccatcatgagctatcattaagccatcattcaataatagtgaatcataagttatcccatttatatgagctagtgtctctaagcatggctaagcatcctattcactttagctaaaaccatataatgttctagctaatcaaattattaacaaagtgacaaagaatagggaaccaatagcaaaagggctataacaaggcaataggttatttccacccaatgacattcaaaaataaatgcagtagttgaatagaaacaatagctttaaacgggatcaacatgctcaaaggattgttttgggatctgtgtgacttgccttgctggccttggaactcttcaaaatcttctcctgcaaacacagactctccgggaacgtcggaatctaaacagaaaagagcaaaatcaccaaaacagcacataaacaagcatgaacagtacatgtggatatttttaacatgtagatctcaattttagaaaaatttagagacttgaaccaactaaatccgaacaaagatgacttagttatgaattttcaaagattaaatcggattaaatcctttatatagattttaattgaattatgacgcaataaagaattatttttgaaaaggaaaagaggattattgcatcagcgggctcggctcacggaacgaacggccgagatctatcctatccacaacggacggccgggatctatgggcccacgaccggtccacgggacacagtgacgatgacgtcggcgatgacgtcaccaccggcagcgactcgggcgcacatgctcgccggtgaacgacggcgcggcggctcaaacggaggacaccaacgggttgcgggcatcacggtgaactcactggtgacctaaacgacggcggacgatgaccggacggcgacggcgtcgaggaagaagcggcggcgaccttcggcttgacgacgacggcggtgttccggcggtcttcggcaaaacggaggacgggacgaggacggcgacgacttggcgaacccgacggtggccttcccaagcaacgacgacgaccggagcggtggcggcgcatggctggacaagtggcggtgacggcggcgcacgggctcacgaggctagggcgctacaggcggcggcgagctaaggtgagggtggcgacggatagaggaggtcccggggttctttttatagcggctaggggcggcgatggaggcccacagcgaccggtgacggaaaggaaaggttagggttcgagtgagagagaggaatccgattcgagatcgaatccaccgctttccaaacgattttagccgacgattccaaaagagaaaagatagaggggatcccggggatcatttcccctctattgatttcatcggagaaggaaaggcgcagccgaatttggaaggagacggcggcgtggctcggctagggttcggccacgcgacagcgcgaggaagacgacggccttgacaggtgggccccacctgtcagcgggtggacgcgcacgcgcgagcggcggctcggctgtgggccgacttgggccggggaggagagagagaaggttttggccgactttcggcccaaagccaaaagagaatttttaaaacctttttcaatttaaattattcatgaaatgcaattccatttattaaaaatacttccttggctcaaataaatcccagaaaaatctaggaactatagaatcaagtaaagtatttaataaaattttatctggcccacttttatattggaatttattatttaaaaattagatcttttcttctagacttttaaaatcatttctaataattccaattaaacaacaatttatatatttaggatttttagggtgtgacaaacctaccccccttaaacagaatcttgccctcgagattcggaagaattggcgaacagatgcggataagctgactttaattcatcttctcgttgccaagtagcttcttcttccgagtgattactccattggaccttacacaaaaggataactcgattcctggttcttctctcatctgtctccaaaatacggattggtttctcaacatatgacagatcctcttggatttctatctgttcaagattagcttcctcagtgggtacccttaaacactttttcaactgtgacacatggaacacattatggactcctgccaacgattgaggtaactccaactgataagcagcctcacctcttcgactgacaatcttataaggtcccacgaaacgcggtgccaattttcctttggtatgaaaacgatgaacccctcgaagaggcgtgacacgaaggtacacatgatctccttcttcaaaactcaaatctctgcggcgattgtcggcataactcttttgacgagactaagccacacgcaatctttcttgaatgatctttaccttctcttctgcttcccttagaatatcagtcccgaaaacctgacgttctctcgtttgatcccacaaaagcggggtgcggcacttccgaccatacagtgctttgtaaggagccatttgaagactagcttgataactgttgttgtacgagaattccgcgtaaggcagattcttatcccaacttccaccgaagtctaaagcacaagctctcaacatgtcttccaaaatctgatttaccctttcggtttgtcggtctatctgcggatgataagcagtactaaagttcaacttggaactcatctcttcctgaagtttcttccaaaattttgaagtaaactggctacctcgatctgacactattttcttaggaacaccatgcaaacacacaatccttgccatatacaattccgccaaacgacttccggaataggtggtccttaccgggatgaaatgagccaccttggtaagcctgtcgactatcacccaaatagagtcatgacctgatgacgttcttggtagaccagtgatgaaatccataccgatttcctcccacttccattctggtatcttcaagggctgcagcaaacctgcgggtttctgatgttctgccttgactcgctgacatacatcacatactgctacatattccgctatctcacgcttcatacttgcccaccaaaatctttccttgagatcctggtacatcttagtactaccagggtgaacggagtataaagtttcttgggcttcctttagaattgcatatttcaaatctttgttgtctgggacacagattctctcacccaaccatacagttccttgctcatcttccaagaaaccgatagcttttcctcttctcatattcttcttgacctcatgaatatcaggatcattaatttgagcttctctaacttgatcaatgaagtgggcctcgcttttaaggatcattaatttgagcttctctaacttgatcaatgagagtgggcctcgcctttaaggctgcaacgaaacctctactgacaattcccaaatttaatttttcaaattccttgcacaattccaatggcaactgttgcccttccatagcattacaatagcctttcctgctgagggcatctgctacaacattagcctttcccgggtgataatgaattcccaggtcataatccttaatcagttccaaccatctccgctgtctcatgttcagatccggctgggtaaagatatatttcaaacttttgtgatccgtatacacctccgtacgagtaccgaaaagatagtgacgccaaatcatcaacgcatgaaccactacagctaactcgagatcatgagtagggtagttcttctcatgcggacgtaactgacgagatgcataggcgaccaccttcccatcttgcatcagtacacaacctaactcaagcttggatgcatcgcaatacacttggaaacccttctttggatcaggcaaaatcaaaatgggagctgatattaagcgtcttttcaactcttgaaaactctgctcacattcttctgaccacttgtacttcacatctttctgaagcagtcgtgtcatgggcttggcaatcttggagaaattctctatgaacctccggtaataacctgcgagacctaggaaactgcgaatctctgaaactgtcttcggttgtttccagttggttacggattccacattactaggatcaacgacaactcctcctgctgagatgacgtgaccaaggaacttcacttcagacaaccagaattcacatttgctaaacttggcatacaactgatgttctcgcagcttctctagtgcaagacgaagatattcttcatgctcttctttagttcaggagtagatgagaatgtcatcaatcaagacaaccacgaacttgtctaggtattccataaacaccttgttcatcaagttcatgaagaaagcgggggcattgataagtccaaaagacataagagtacattcaaacaacccataccgagaggtaaaagcccgtcttaggtatgtcttcctctttaatcctcaactggtgataccctaatcgaagatctatcttggagaaaacggtggcacctttaagccgatcaaacaaatcatcaattctgggcagcgggtacttattcttgatagtcacatcatttagtaaatgatagtccacacacatcctctgggtatgatctttcttttccacaaaaatagctggagctccccatggagatgaacttggtctgatgtatcctttctgaagcaaatcatctacttgcctcttgacttctctaattcattggctgccattctataaagtctcttatggatcggagttgttcctggtaccagatctattctgaattctatatcccttttaggcggcataccaggtaaatcatcagggaacacatcggggtactctcgtactataagaatctcttccaaagttatttggttcagacttgactctaaagtctcagaaggcagtgcatgaacagttacgacttgaccgtcattgctggtgagagttactttcctattggcacaatctatcacacctttatatctggctaaccagtccatccctaggatgacatcaagatctttggattctaacagaataaggttggccagaaagggtacaccttggatctctattctgacagaggggctacgttgtggtgagagtgcttggttactcggggtactacccatcaaaggacgtctaagctcttctacctccatcccatgatttcccgcaaaactcatagataaaaatgaatgcgtagcaccagaattgaagagcactgttgcaggaactgagttaacggggaacgtacccaaaatgacatctagagcaccttgaggttctgcagcagcaacatggttgacacgagccttggctgctggtacggaggacttgttctgagcagggacaacctttacgcggcgggacttcggacacttgtcagagtaatggcctggttcgccacagttgaagcacactccgggcttgtttccttgttccctcttggcaggctgatgttgtgtcggagctgccacaggacgtggagcttggttgcagttgttgttgccagcattgttgttgaagaactaacgctgcggacgaacaacagacgaagaacctccctgtgacattaactggggtcccaaagtaagacgcggcctctgactattcccctgctgtgccttgaagtgaacaatccggcgtttcttctgctctatgcggttgtacttgtcctcctgacgaatagccttatccactaacttctgaaaatcatgataatccccagtcatgagtgggtacgaaagctcatcattcagcccttcaaagaacttctcttggcgctattaatcagtgcgcacatcttccggagcataacgagccaggcgattaaattcatgcagatactcggtaacagtgtgggatccctgagtgagcgacctgaactccttcttcttgagagacaccactcccgatggtatatgcgtctttcggaaagcagcggtgaactcaagccaagagataggttcagcagtagtcctgttgaggcggaaatgatcccaccactcagaggcagggccatgaagctgatgcgaagcgaaggagactttctcttgatcggtgcactgaagcaggtccaacttcttctctatggcgtgcagccaatcaccagcctcgactggattagtagtgctagaaaaagtgggcggcctcacacgaagaaattctgctaacttgttctggggaggtgcatggttatttctctggttctgctggttctggagttgctgcatcatcatgttcataagctgtgcctgttgtgccaggacatgggcaagcgttggattctctccattgttgttgttgttgttgttgttgttgttgttgttgttgttgttgttgttgttgttaccattcccaacgctgcgagtgagcaccatctggcatggacaggagcagaagaagagaaacgggggaaaaactacttaggacagagaattatttttttctactaacttaacttttattgatcttaactgagtttcattattacaaaactgaagactctcacaccactaaactcaccaactacctaacactcgaaagcaaacaaacgcatgcacttacaacccaccactgatgtaaaccacatgcaagacccacacacacaaccaaacttaaaacaagtaaaccaacacaacgatctagggcaacggcttgacaaggcattctagatcttccgggcatcggagttgattgaaggctcgtttggctcgtctccatcatcttgagtagctccccactcgacctttgaatgggtgcgcttcgattcttctccttcatcatcacttacgttgacgaccggaggatccactagggctggggtagcttctttttccaccacacgaacctttggcgccaactggtagcgagggacaaatagagctctcttccttgcggtaagacgaaccctggccttttgtggtggtgcttctcccttcaatgcggctagctccttctccaaccgatccaccttgtcctccagcttgcaaatcttaccacggttccggtcttcacgatcttgagctgctaacacaatctccgcgcgggtctcatccatggcccacagcatcttgaccaaatgccttgtggtagcatcattctcaatccccgcaggttcaaggtagctaccacggtcacttccctggggttggcgaggatggtagcgatactcggtgtcggccaaccgatcattatagctttcgcggagctctcctatagcgatccttgccacctcttgacaagcatgaatgtagcttccccctccagcctcgaacatcaccgatgggatatcttcacgattactattcaaggtgactttgacacggcacttctcttcatcacgatcatgaggaatctgggcatacaaaggggcaatcccaaatcctatgaggaaggacattgtacgcaactcctggacaaatccttcggtaccgaacaagtactcaggcttgtagcgcggcatctaagacaagtgaaaggagggaattaagtcatttatcccgttaatagcacaagtttttgggttaatttgaataaagttagaaaatcaaagtaaaaggtaaataaataaagtaaaccaagcttgcaagataagttgaaacagttggaaacaggatcacaaattttgcacttttgaacaacaggtttcaaaaaaaaaaaaagagggttataaaatcaacatgctaaatttatttcattgcagcaagattaaataaaacaatgttgtaaaacgctttgctggtaaatgggccattagtacagtaatagatgtacggtactgataacacaggaataataaataaattttaaatgagaacaattaaaggaattataaactgcatgtgccattagtttggtttaattaaaagagaaagggaggagaacagttctacttttccaatatttttagagggcttgtatgggtaaccatttggcataacctagggtcaaggaggctctgataccaacttgtcacgcccggaatttctatccaaaattccaaacgcttacatgtgtgaaccctcgtccaggaatcagccgaggcacacaataacaaattgataatagagtacaattattactctaattaataagcgaataaaatgtcattacagatgtagatagttcctctcaatcaataaagatctaagcagcggaaaaataagataaacggcgcagacgactccactccacaggcagcttgaccagggctacacctaatcctccacaccatcagcatcactgtagaactcctcctctgatgaatgattgcaaggtgagtatatgacatactcagcaagccacgcagcaaatatgcaagtgcacgggataacaaaggatggcataatatagtctcatttgcataaatagcatttaataaacatttcagaatttcataaaacagtaaagtatttaattaaacagtattaatccaacgctatacaacagaccctgttgcataggcccaaccattgtgaacaaccaatcccggctgcacagttctatctccaaaccaggaatatatcattccaaaccaggagctaaacaaattattaacatcatcatttattatggtgtgaaatatgagactaatcacgaaagacattgttagacccgcccattaccgcgggcacggtattcgaatagtttaactctggccaaaggtgtaccactgtacccacaagacacaacctcaacatcatgtcaaccatgcgtcgcgatacttaacaagtaccgaaatagagattgtgacaataccttctaataacacaattcaaagcagtgcaccgttcctggatcataatcacccccttgcaaacaacgcatggact

SEQ ID NO: 19716 - DNA, 313 bp, Oryza sativa
aaccgcggcggcgggcggctggcgagagtggcgcgcaccccatggcgacggtgatggcgatgcaagctcccacgtcgactgatctctccgacagcggcggtggcggcgtcgggctagcggctgggctcgccggggaggtggcaacggcggcggcctgagagtaagaagacgaggtgggtgggctccttggcctggctgtcgcggacctcgcggaggtagaggcggacggcgcgggcgcgaaacgggttggcctcggggtggccgccgtgttcctcgaaggcggcgtggaggcggccgacgagcgcgtcaaggc

SEQ ID NO: 19717 - DNA, 418 bp, Oryza sativa
tatgttatgcatgaagctgagttatacaagaaaagcccttcaggaattctgcaacgctgcgtatctttagaggaagggagacaattgctgcaggacatacattctgggatatgcggaaaccatgccgctgcacgcaccattgtcggcaaagcttaccggcagggttttttctggcctactgcagtgtccgacgccgacaagattgtgcgcacgtgcgaaggttgccaatttttcgctagacaaattcacttgccagctcaagagttgcaaactatcccgctgtcttggccgtttgcggtttgggggctcgacatggttggcccgtttaaaaaggcagtcggcggttacacacatctctttgtggccattgacaaattctccaagtggattgaagctaaaccggttgtcacaatcacag

SEQ ID NO: 19718 - DNA, 753 bp, Oryza sativa
cggtgaggatgtagacatccaacaacggcggcataataggccagccgtgtagcggaggcaccactcggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggatccactcggcggcgacggaggcaggccggcggtgaagtcgtagacgcccaacagcggcggcataataggccagccgtgtaggcggaggatccactcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcagtatgataaataatgataaaaatcagatt

SEQ ID NO: 19719 - DNA, 3675 bp, Oryza sativa
taaattattcatgaaatgcaattccatttattaaaaatacttccttggctcaaataaatcccagaaaaatctaggaactatagaatcaagtgaagtatttaataaaattttatctggcccacttttatattggaatttattatttaaaaattagatcttttcttctagacttttaaaatcatttataataattccaattaaacaacaatttatatatttaggattttttgggtgtgaaaattctagaccaagggtcacggtccgtctagcatttagcatctaggtgaacattgcccactaactattgtggtagtcagatttaccctctccccaaaactatacaatgctagacatttcctgtcaactcttcaaacctgacgagtattccccgaactcaatccaaaatgtttttgatctttggtgatacatacagggtagtccaggcagccaaaaacggcggggctcacctatcagtgcttcctttcctttcacctcctttcctttccctcgatccccattccccaatcgtacggaggtgggcaacagcctccatgagctgccgaagaagggcaacagcctgcatgagctatcggaaaaaggtacccacctgattcaccgttttcttcatccatgcttcccttcccttccctccccatatccccccttctcccatggagggtagcagccaacgagcatgtggaggacactagtggtgtgggcttgggggatcgctaatgggcgagtgatcgctgtaggcgatcacccccattccctccgctaacacgctcctctccccttcctcccccttcttctcttcctactacaccataaattttaaaaataaaaaacacaagttagaaaaaaaataaaaataaatctaatactcttatttatgtgtatagactttgcacgtataaactttatgtatagaaatacaatatatgaaaatatttgaattcaaattcaaatttgacttgggtatataaacttttaacttataaactttgggcacgtataagctttatatctagaaatactatatataaaaaatatttgaattcaaatttaaatttgacttgggtatataaacttttaacttataaactttgggcacgtataaactttatatctagaaatactatatataaaaaatatttgaattcaaatacaaatttgaatcgggtatataaacttttgacttataaactttgggtctataaactttaggtgtataaactttagatgtataaactttagatgtgtaaacttgaggtgtacaaactttaggtgcataaatttactaaaatatgaaagtaatgcggtcccaaaaaaaggataccacgtgaggagggctgatcgtgcggggggacgatcgcccattaggatttctggtgggcttgtggaggtagaggttggtggaggtgatggccggcgtgggaggcaaatcttacgttcgagctgagaacatggtggatctctataggaagaggcggtggaagacctcgaggacacgatgggggtcaggctcgtgggagccagcatcaaggccaacacacaactgggagaacctgacctcctcctcccacctcccaatgagctgcttgtaggatcgaaacacaagaactaagccaaccagaggggggaggtgaatggttggtatgcccaaaaaccaaattttcagcggaattaaaagttaccctcaactttgatgtagatcagtgatgcgaacccgctagggtttgtggcccgatctttcgatgagaggtaagggataactcgattggatgaagacgacgttcacggcccgactacaaccgtccaaagacgctgcgccttagcaaccgatacaccgtctccaatggtcgacgcgaacttgtggtgcgcgtcaacccggccacgagggcactcgtcctgcaagcaattgaagaacaagcaagaacaagtagaacaagcactgaaattgctatataaagatgaaagtttcactatcaaatacaatatggtggggttccgattacaggcagacgagcggtttagccaacacgcgcgctgtgagccggtagcaagtagctatctctatcatcaaaacccgaatgttcttggcggcgactagaggtataagaagaggggaagaacgaccatagggtcgtgctccaaccctaggacgtgcccctaatgggcccaacttggatacacagcccattgggccaaaagaggtgacgcaacaccatggacagaaaacagtcgggagtaaaatgacaattgcggccgctccagaatagatatggacatgtggctggatccatttgaaagtagacttgataagctttccatgaaatacttgcacgcccaaatcggagttcgcttgaagtcgtggcggccgtcagaagttggcgctgccctgcagtccgaatccaccccgcgcgaatcctcttccctttggatcctctccatcgttcctgagtaaaacacaagtgcacgcgtctccggggtataaagaagaggaatatgaactcaagaaagaactcacctgataatttagttgacgtgcacgagcgcgggtaatagaaccatcatgttgtacatggggggacgtggatgtatcgatggtgttgatgtcctcatcatcctccccttcttgcatttgagtcgtcctcgactcatgctcatcttcttctcccaaatacggcttcaaatctgcaacgttaaatgtgggactaaccccgaaatctgcaggcaaatcaagcttatacgcattctcattaatctttgctaacactttaaatggtccatcagctctaggcatcaatttagactttcttaaatcaggaaatcgttcttttcgcaaatgcaaccaaaccaaatctctaggttcaaaattcaattcccttctacctttgtcaccagcaaacttatacttagcattcatgcgctctatgttttctttagttgtctcatgcagttttaacatcaactcagcacattgcttagcatcaaaattcagtttttcagaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtgtcacgatcagaaacaattgtgtttggcacaccatgcaagcgaacaatttctcgaaagaacaaatcagcgatatgagaagcatcatcagttttatgacatggtatgaaatgtgccattttagaaaatctatcaacaaccacaaaagtgctatcacgtcccctcttggtcctaggcaatcctaacacaaaatccattgaaatatcttcccaaggaacagtaggaacaggaagaggcatatacaaaccatgtggatgtaagcgtgacttagccttttgacatgtagtgcagcgagcaacgaacctgccaacatctcttcgcatctgtggccaaaagaaatgactagcaaggatgtcatgtgtcttcttgg

SEQ ID NO: 19720 - DNA, 807 bp, Oryza sativa
agactgttttaggagtcggccaactttgaattgcctcaacttggcttgatcaacctcaatcccctgcggagttacaacatagccaagaaaagaaactcgatctgtgcaaaagctgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtgctgggtgcattagttaaaccaaaaggcatcactaaccactcatacaacctaaacttcgttttaaatgcaattttccattcatcacccaacttcatacgaatctggtggtaaccactacgcaaatcaactttggagaacacaatagagccactcaattcatcaagcatatcatcaaacctaggaaaacgatgacgatatcgaatgataatgttattaatagctctacaatcaacacacatacgccatgaaccatctttctttggtaccaaaattaccggaaccgcacatggactaagagactcgcgtacataccctttatcaagcaactcatgaacttaacgctgaatctccttggtttcctcagggttggtccggtatggcgcacggttgggtagggaagcacctgggatcaagtcgatttgatgctcaatgccgcgcaccggtggcagccccggtggcacttccttgggaaacacatcagagtactcctgcaaaatgttagcaacagcagggggcaa

SEQ ID NO: 19721 - DNA, 3608 bp, Oryza sativa
  unsure (1)..(3608): unsure at all n locations
aagtgcaagcttctccaccatctcgctgctagccaagttgttgcagctacctccatcaatgatcatgcggcaacaacgctctttgacgacacactttgtttggaacaacgtgtgttgctgattttgctccgccttctccatttgtgcgccaaggacacgctgcacaatgaggctctcatagtgatccgcaaatgcagccccaatgtgctcttccggtggctcattatctgcatggtcagccgcaagcaaagcaagtgtatcatcatcgaaatcactagcagaggagtactcaccatcttttttgactaccaaaactcgcttgctagggcagtcacgctgcacatgcccaaagcccttgcaacggtggcactgaacatctctcgttcggcctgtggatgccattgaagaagcactcagtgctggctgagcagcctttgtcgctgacttgtcactagatggaggaggtgctgctcgactgattgtgggtgtggaagatggagaagcagtacggccggccggaggagtggtgcgtgtctgccatgatgaagttttacctgcagaaaaattagccttggcactagcacgtcgtccctgcacttccctttcagccttacaagtaagatgaaacaatcgggtcatattagtgtaatctttatagtctacgatgtcaaaaatctcgcggtttaacccacccaaaaatctagccatggcagcgtcctcagtttcctctaaattacaacgaagcaagcccatttgtaactcctgataatattcctctacactttttgcaccttgtctcaattgttgtaacctattcagcaagtcacgtgtatagtaagaaggaacaaatctagcccgcatgacccgtttcaaagcatcccaagtttgtggcatgttattaggatttttcttgccatgttctatccaccaaaccaaagcaaaatcgatgaactcactagtagcagctctaactctagtgttctcaggaaactcatggcatgcaaatttttggtcaacagcaatctcccaagagaggtacgcatcaggatcatattttccatcaaaagtaggaatcttaaatttaattttagaaaaagcatcatcattgttgcgtacctcgcgtcagcagcgaccacccatacctcgtcgattgttgtgtagccgtcgacgatctcgagcatctcgatcatcttgttcagtgtcagcaatatattcatcctccaaattatctcgacgtactttccgtcaatgtcatcgtcattacccccaccattgcctccagcattgagagcatcaaaatgcctcacaagagcagcaaggcaagtgtcaatgcgggcgaccgctgtctccagcactgtaagcttagtgttggtggagatctgcgtggacttcaattgtccaatcttctcatttgtcacctgcaaatctgtatcaagtccttctgtgtgctacttcacttgccttgtaaagtattggatgatgcctttggtgcgtggggaatgagatgcaccctcctcatctttattctctggacctgccatgggttagaaatgaaggacaacaaaacaatggaggatgtaatgtaagccctacacaactattgggatgtagcttttgcaagacgctcactctcacttcactcgcagcttgtctcacaagctcttaccagttcttaccttgcccacaggagggggacagcaacccacaagttagcaaccgtggaacaaggtgtatcggtgctgtagcaacaagacctgtcaagctgtagtcgggtttgtggtggagctgttggtggctgaaagcaatgctcaagagaaaactagaaaccacattagccaaagcaaattgaataatcgctcaagggtatagtgtacagtgctggtcctaggctagtcgaagtagagacacgagtctaaccacaaaggacgccacaaaacacaaacccaaacagcaacgaaaacaagaaacggtggtgcaaggtggtgacaaagggggaatggtggggtgtgctcgctggatcctcttcttccttttttttttgcttgctctctctagtgctgaggagagacaacttttttttttattatttttattttattttattgatatttttttcacaaccaggagcacactggaaccaaccacagaaaatcttgtctcaaacggacaaagtatgaagcttatagaattttttcaaagttctatgcgaataggtcccgaagcttctcgccacaaaaacagaattttgcaagtggaatttggcgattttaaatttgccgaacccggcaaagcgggggagaatcggatgtaactttttttgtagatgtccgtggatatattataagcctaatttcgagtccgtatgagaaaaatatgactgttttaaggaaggtcactcgaatcagggttctatttcctttctagtggcggcaggatacaaggcaactcacaaaagctatcggcaacagatcaaacacaaatagaaagtgatttggtgggtgactgcgacggcggtgacggtggtgatgatggcaaaattgatgaaggtggcgatgtgcggtggtggcaagaactcgaaactctaatcgcctaacactaagaccagcaaattaacacaaccgatgcaatcaaaaactcaacaagccttaactaagcagtactagtaaaaaggcacaatggtctataggatcacgggaaaactaatctactattttttttgttggtcttttctggactataggaaaaaaaattaatgacgaagggaagggtaaattctctcaccgaagaaccacgctctaataccacatgatgcgaacccgctagggtttgtggcccgatctttcgatgagaggtaagggataactcgattggatgaagatgacattcacggcccgactacaaccgtccaaagacgctgcgccttagcaaccgatacaccgtctccaatggtcaccgcgaacttgtggtgcgcgtcaacctggccacaagggcactcgtcctgcaagcaatcgaagaacaagcaagaacaagtagaaaaagcactgaaattgctagataaagatgaaagtttcactatcaaacacaatatggtggggttccgattacaggcagacgggcggtttagccaacacgcgcgctgcgagccggtagcaagtagctatctctatcatcaaaacccgaatgttcttggcggcgactagaggtataagaagaggggaagaacgaccatagggtcgtgctccaaccctaggacgcgcccctaatgtgcccaacttggatacacagcccattgggccaaaagaggtgacgcagcaccatggacagaaaacagtcgggaataaaatgacaattgcggccgctccagaacagatatggacatgtggctggatccatttgaaagtagacttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19722 - DNA, 733 bp, Oryza sativa
caacggtggcataataagtcagccgtgcaggcggaagtaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggtggcataataggccagccgtgcaggcggaaacaccagtcggccgcggcgaaggcaagccggtcggtgaagacgtagacgcccaacaacggcggcataataggccagccgtgcaggcggaagcaccaatcggcagcggcgaaggcaagccggtcggtgaagacgtagacgcccaacaacggtggcataataagtcagccgtgcaggcggaagtaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggtggcataataggccagccgtgcaggcggaaacaccagtcggcagcggcgaaggcaagccggtcggtgaagacgtagacgcccaacaacggcggcataataggccagccgtgcaggcggaaacaccagtcggcggcgacgaaggcaagccggtcggtgaagacgtagacgcccaacaacggcggcataaagg

SEQ ID NO: 19723 - DNA, 691 bp, Oryza sativa
tcctcccgggccaagtggcccgcagccgagccgccgctcgcgcgtggggtccgcccgctgacaggtggggcccacctgtcaaggcagtcgtcttccttgcgccgtcgcctggccgaaccctagcggagccgcgccgccgtctccttccaaaatcggccgcgcctttccttttccggtgaaatcaatagaggggaaatgatccccgggatcccctctatcttttctcttttggaatcgtcggctaaaatcgtttggaaagcggtggattcgatctcgaatcggattcctctctctctctcgaaccctaacctttcctttccgtcgccggttgccttgggcctccatcgctgcccctagccactataaaaagacccccgggacctcctctatccgtcgccaccctcgccttagctcgccgccgcctgtagcgccctagcctcgtgagccgtgcgccgccgttgccgccgcttgtctagccgtgatccgccgccgctccggtcgtcgtcgtcactcgggaaggccaccgtcgggttcgccaagtcatcgccatcctcgtcccatcctccgttttgccgaagaccaccggaacaccgctgttgtcgtcaagccgaaggtcgccgccgctttttcctcgacgccgtcgccgtccggtcatcgtccgccgtcgtttaggtcccggtgagttcccgca

SEQ ID NO: 19724 - DNA, 3379 bp, Oryza sativa
atatatatatatatatatagtatgcaatattatatattagataagatcagctgaaactccgatactatccctaattatgattaattacaggttagtttttagggttctagacaagactagggttgatgcatctcaaagtatgtaaagaaacctaaagtccaaacaatcaagtaattaactaattttcaggatggtagattccttagctaacctaatctagcgaggtaatttagccaataccagtataaacctaaagcgagtctcagccgatactaaatcgagatactagactagattaagtaagatatatgataaactatgctacaaaaatgagactaatacatctaaagcgacgcaatagccccgataatgaaaaccatcaagacaagttacctcttgtcgagagatcacaaccgatgccccgactcaaagcaaaaactcatctaaaagttaaagaaaaaggtggcgatgcaccgaaagttgtattggttggatgtacgtcctgttttacaatgatcttggatttatatttatacctagagtacaaaacttgtctattatggacatgactcaaactttccaaaagataaaaacaacaaacaagttcacatggaggactcataccatatctttaatttaaaacgacattaaaatcctaattaataaatacaattgacttaaatatgccatatctctatatggcaatgtcagttatctcaatcgaggcccaaaccgagcccaagtcaagctatatcggccactttcaatatcgactgaattggttcccgactgaattgatacgctgtctgtttttggtaagatttaatctccttcaaatccatttcgatatatgtctccaaatccgagtatatcttgccaaatttcgttgttaacacagtgaaaccagagagagtgcgatgcaagacatcagtgtgaactgactcccacggaaccgcgatgccggtactagtcctaggaaacaattcctggtacccacagtcaaccgagatacatcattgcaactaaacatagtatagttaggttatacatttagaagttacatgttcagagcaactcctgaagtgaaaccgtcaagcaaagaagcaataatggaacctagcgcaactaaacccaatccacaagcaatgacttgggtttagtacagaaatgcggaccttcaacttcacttcactttgctctccctggggaaatcaataacaattgagtacatacgtacttagcaagccatgggaaatgtgagtatgcaagcttcaaagaagggttggtttggtttcgcagacttttgaaaacatttttcaaaaggacaattgcttatttgaccccgttttgaaccgtaactaccaatttgaccctactttttgaagtttgcttatttgaccctccattttagaaacaaagctcccgtctgaccccctttcgatgactccgttagggttgaatttaaaaagaaaaaagaaaatgcttctaatattcctaatgtccaaaataccctccaaaccctatcctttcactcttctctggtttagggcgctctctctcgtgcaaactgcaaagtgtgcggcagcggcgagctgagggggcacagggcgacggcgactgagggggcgacggcggcgatttgctggggcggcggcggcgatttgagggggcggggcggcgacgatctgaggggcgacggtggcggcgtgaagcagagccccgccgaggcccccttgtgaaggtggagggcggcggcgatctgagggggcggcacgcgcgcggaggaagtggtggcggtggctgctgcagggtggagaaggagcggcggcgagcagaaggagcaacgtcaagtggcggctgcccgagcggaaggagtggcggctgctcgacgacgacaaggaggagctaccgcggtgggtcggctatggctgagcggcagcggtctccgcgactgcgggttgacaacgacgcgctatcctgcgccggctagttctccggcactggatgccgctcgccgccgtcctccgcatctctctcccgcgtgctggcgagctccgtcaccgcacatcctttgtgcgccggcctccttcctccgtgcgcgtgatgccaccgcccacccaccgcacgccggcgacctccggcgccgcaaagggcagcgctccctcccttcccacgtgccggcctccgtcttcctccgtgcgagcgccgccgccacaaaaatgacgctgccatgcccaagtgtcaaataagcaagggcatattggacattttttgctccagttaacactgttacatgcccttaacagaatagggtcagattgtatcttcaattttgaaaaagagggtcaaatgagtaaagttgaaaaaagagggtcaaattggcaatttgctcctaaaacagggtcagatgcgcaattgcccctttttcaaaacactaagtgtgtaattgtcccatttggtcgaaaagaaactctccccttgatcctgtctacaagttgctttgcaacaactcaagtagatgagacaaattttagttgattaataactatcctcccgcgcgacctaccatgataccgacacacaaacttcttccaataggcagtttccaactatttctcgtttattagtttcttttcattttccatatccatcaaccatcagctcaactcatgtctcatatctttggttcccacagctgtccaaaatctctagcccacaccgtgttctgttgggaagcctcaactatgatgtcattcgacatcccagttcacataggactgtttcagaccatgtaatggtcatccagtagacatcatgaccgattttggtaacgatttccaatcccacaaaatgtttgtcacaacactttgcaagcaaacctatgctagaggaatcaccttccattcgcccataaccatatgcatggttgttcgaacagtttggtaacctttgcagagggtgtgcactttactcacaagatgtgatcttaccttatcactggccaagtagggggttcgcgacaaggcctttccaaagctaaccgaggatacatcatgccacacaaaagggttctctctgaatcgagtatcagacaaatctcgaccatcttctatctaggaatctaggatgtcaccaatcaaccgtgcccaacatgttaaaatttagggaaattttgctacaggacacttgttatgtgtggttttagccctagaacactgcccaaacccacttttgggggaaaacactccataaacgtggtaatttgccagtggacaccgcgctgattaaaataatacttttccgttgggaaggagagagaaatccgtgaaatgtcaaaaatgccctgggccccacatgtcagctctatctgctatctctg

SEQ ID NO: 19725 - DNA, 10233 bp, Oryza sativa
ggaggtacaggcgtaccgtgtgggcgcgaaacgggttggcctgggggtggcagctgtgttccccgaaggcggcgtaaagtcggccgacgagcgcgtcaaggctgccccacgcctcgcggagcaggcacgggcacggtgccggcagtgaggggtggctccgccggccgcacgcttgtccaccgccgccgccgcccactccactccgccggccgccgtcctcgccatctccgccgcgaccaatgccaccccgtgcgagcacgctctgagagagaaaagagagagagataggagagaaataggatatagagatgacatgtgggcccaagggcatttttgacatttcacgcgatttctctctcctccccaaccggaaagtattattttaatcggcgcggtgtccattggtaaattaccacgtatatggagtgttttcccctaaaagtgagtttgggcagtgtcctagtgctaaaaccacacataacaagtgtcctgtagcaaaatttccctaaaatttaatgtgtgcctagtgcatcatatcaactcacatcttctcatcccaacatttatcaactattggcacacaaggtagagcatcaccaccatggcgtccactttgcatcgtggatttttgaaaacaaattgtgatttgcaaacacgctgacaccaccaatcgagttttcaaaggtttataaacccattttcctatatcaacaagcaagtgtgaagtgtgtggtattgtcgacacctatgctcggggcatggttgccgaggtaccattagggggagcgacaaaggataaccctaatcaacatcctataggtatagtgcaactattaggtaggtttgttagtttgtttcgtgaactagggccagtcatatttatcatgcacactaggaatgcatttttttatttttttttaaaaattataggctaggagcaatatgatcaaataatgacttgcctctgtcttcattttcaaaatcttcgaacttgcttgtctagactaattttcgtcgacgtggactacacaggaaacaaataaaaccaagcaaaactaaacataaaataccattattaataactaatcatgccattatcaatatctcatttttaaaaaaattagagacttgaacgaggttgatcggagttaccaatagggagatatgaagtttgaaagattacaaggtttttctagaattagaaacaaaattaaaggttttctgtgaaagaaaaagaaaaggataggtggggttggttggattgggtagagggaggatgtaaagtagactttgtttgagtgggaggagattgttgggccgggggagagagaggaagaggggcaaggaccttttaggcttagcaggccacacaagccagctaaagccatggcgttgcctataagcgaggacacgcgggggcgcggtgtggtttgctgcctatgggccatgacctagccacgtaagcgccaccacatgggctgtagaccgggccagcgttgacccttaccagcatcaacagttggtggaagttggtggcgcatcaacgaatagcgtcttgccagactaggattagccaagaactattcgacgacatgtaatcaacggctagccattgacttcctcccgcctgtttctcaatgtggcgggtggctagggcttgtgattcaatgtcctaccctcttgtggggctttgtatatatactactagacaactttctcttcgaatagaactcagatactctaagtagggcacaaatagatataaacttgcctttcacgaatcggagtccaacaacgtactactctactatgttcttaattatccattgtattttcataattgcgtatacgtttccgcacaatattaggtatgtggtatttcagggcgttatgattccaattatagatgtgataccttatctaatacttactcacaggtttaactgtggcatataggaccatgacgctcatcaataatgccaatgttttctagattgataaaagtgccaatgtgcaccatataatctattttatatctattatattatgaaaacaaccttgaaaaaaggcaccacgttcgctgtggaggttagaaattttcacattaatcggagaaaaagaaaagaagagttcaagttgaacacaatttagaaatatctgaaattcggaattaaaaataactaatattggaagaagagtccatatagaaccgaatacgacattaattaaaattcggaattaaaaataaaataaattctgaaattagaaaaaaagagtctaactaggaatacaatttagaattatctgaaatcggaattaaaaataactaatatctaaataagggtccatatagaacaaatatgatattaattaaaacccgaaattaaaaataaaataaattctgaaattagaaaagagaaggatagttcaaataggaatacaatatagaaataactgaaatttgaaattaaaaataagcaatattagaagaagagtccatgtaagaacccgatacaagattaattaaaattctaaataaaaataaagttaattacaaaatttttagaataataaaaaatagagttcaactaggaatacgattttgaaacaactaaaattgagaataaaaaataaggaatattgaaataatagtccatatagaacacaatacgagattaattaaaatttaaattaaaaaataaaataaattcagaaattagaaaaaaaataaaagtttaacaaggaatacaatttataagtaactgaaattcgtaataaaaaataaagactattgaaaaagagaccatatagaacacatgacaagattaattaaaattcgaaataaaaaataaaataaattccaaaaatagaaaaataactataagagtccaagtaggaatacaattttttaaaaatatcatggtgaaagatgtggaattttttttttaaaaaagtccatctcgaacacaacaatgacaaatgaggggagaagcaatagggctgtaaaggagtagagtggtggcggttgatgggacatctaaagttataagaaaaaccccaaatagaatctcaacgacgattaagaggagggataattggtaggccattaacagcacagtcacagtggttgacgggtcttatagaaagtaaaaaataaaccttaatgataatcataaatctcaatgacaatagatagggggaggttgtgggcccgcccgtaaaaggagtacagtgggtaaagtcgctgacagtttgacgggacttttagaaaataaaaaatgaacccaaatgatagttatagttatgttcgatttttaaaaccccggtgacaataaagagaggacgcaacgggcgggccgtagaggagtactgttatggtgtttgacggaatttttaataattataaaaatgacaaccaatgagacaatgaactctaaaaactacaaggtccaatttttaaaggtttcaaggaggatgaataaaaacagtggtagatcgacaaataaataaaggggtgacaatggaacaagcggtagcgattggcgtgagttataaaaatataaaattagaaacaattggatgataaagttcagtctttcaaagtactaagataacgagttatctatttaacaaaatttaagtaaaatcatatatagaaagtagataattttgtatgggttgctagccgcgcaattgcgcgggccacccaactagctatattattaagctagcatgaaaagtaagcatcacattctctctagaggctagaagttcacacattaattggatataaaaagagaaacgagagtttaagtagtaagacaatttactaacaaaaattagttcatatagaacacaatacgaggttaattacaattaaaattttatgctagaataatttaataattctgcatcgtaacataattttgcttcgatgctagccatacatttgcacggaccaccttgctatgctagttgaatgaagcctgtagcaaaactctagtaattatgtatgtgcgccatttgggaaacaaaaagaggttaagtgttgtcaacgtctcaacgacaaagaagagatcatgcgcctagctacaggacatgcatggacagacacaccgtccagaggttagcgatggcgcgaggaaatgcaaacgctaaaattggcgcgccttaacatagcagttggcggcaccatatattctcctactcctcccagatcatcccaccagtggctaagagaggaagaaggagagaaacatctagagtgaataagaaagatggggttcgtccgtgccctgttcctgctggcgatggtgtgcgtggcggcgcacgcgaaggactaccccaaggaggagggcgcgaaggcggaggggccggccgccgcctcggggggcggcggcggtagcacccacgacgtggtgaagctgggcggcaagggcgacggcaagacggacagcaccaaggcggtcaacgaggcgtggacggcggcgtgcgctggcaccggcaagcagacgatcgtcgtccccaagggcgacttcttgacgggtcccctcaacttcaccgggccatgcaagggcgacatcgtcatccagctcgacggaaacctgctcggctccaccgacctcgccttattcaagtcgaactggatcgagatcatgcgcctcgaaagcctcgaaatcagcggcaagggcaagctcgacggccagggcgccgccgtctggagcaagaactcctgcgccaagaaatacgactgcaagatcctccccaacgtatgcatgcatgctttcctgtgatcgatccatcgagacatacacattaattatttatttgatcgaccatttggtatgatccatggatataaatatatgtgcagactttggtgctggacttcgtgaacaacggtctcatcagcggcatctctctggtgaaccccaagttcttccacatgaacgtgttcaagagtaagaacatcaccatcaaggacgtgaccatcaccgcgccgggggacagcccgaacacggacggcatccacatgggcgactcctccaagatcagcatcattgacacggtcatcggcaccggcgatgattgcatctccatcggccccggcaccgagggcgtcaacatctccggcgtcacctgcggtcctggccacggcatcagcgtcggtagcctgggcaggtacaaggacgagaaggatgtgacggatgttaccgtcaagaactgcgtgctcaagaagtccaccaatggcgtccggatcaagtcctatgaggacgccgcctcggtgctcaccgcctccaagtttacctacgagaacatcaagatggaggacgttgctaaccccatcatcatcgacatgaagtactgccccaacaagatctgcactgccaacggcaactccaaggtcaccatcaaggacatcaccttcaagaacatcaccggcacctcctccacgcccgaggccgttagcctcctctgctccgacaagctgccgtgcaccggcgtcaccttgaatgacatcaaggtcgagtactctggcacaaacaacaagaccatggccgtctgcaagaatgccaagggcactgccaccggctgcctcaaggagctttcgtgcttctaaacgatcaacccacgctacatcctgccaccaccaccattattttttcatttctatttctattttccaggtcacttatagtttttctctggcgatgctctgattggattgttctgatgcagtcggactatccgactgctctatagtcagattgtctgcagtggtaccggactatccagttagttctaagctgtttgtaagtttaagaaatttttggaaatacctattcatccctctaggtgacatatacaatcctcaagactctttcaatcacattatctcaaactagatggagcatacatcacataatagcaactattagcaatgtataccggtggttgcgatggtggatttggttgcttcgccggtgcattcagtcatgctcttacgggaggagactcaggagaaatggccgaacggggcagcgacactttgaggtggctgaagggggcggcggggcagggaggttcatttacaaggcgaaggaagatggagctagggctaggtaccaatctccggtgcagcttgctctaccaaatcaacctcctagcaaccaactcatatccattcaccaggtattccatttccttttaaatgtggagtaacttactcacaaacttttgtgggctatgcaaaagagaaatagcttgagggtgacgcctagtcagtgaggaggagaaccttgaagagtaacaagctgacagatgaaggtcaaatggcgatccagaagtgctcaagatgcaatacctagctctgagtagctcaaatccccaaatcccactccaaactcacaagagatgctcaagatagaaggtggatttcgtgttaatcctaatggaggctaaggaagtaggtctgataggtcaaacaacaagccatccaaagaggggtggtaactattaaatacttgacctacactaaaattagtcgttactgacaataaatttgaatgtcaaagggtctaatcaggcatattagaacttctaatccgtggcatccattgaatcgttcgatcaaccctctctgtcttgatgaggagcaccaatccagactttgtatgatgtccatcgaggaacttctgatcgcccttcctcaacatatagagagctttgattggaggtcctgattgcaattgatggaactttggatctggaagctatactaagcctattttcccatgcgggcgttgcgcaatgtcaccttctctctaaagactgaaggaatattgagcgtatggagacacaaatgttgatattgacttgaaaccctcataatatgcagcttttcctatgactcaatttgaaataaaaaataaatttaaacttctttagtcatttagccttgtttgcatttgtaggggtcgtcatacattcatgttaggcccttatttggtcgggttatgaatcatccaaaatagactaacacactaggggcctagatgcactttcagaagtaactatagtgttagaggagggggggagggggtgttggtatttcttaacaacattgctagaaatattcattccagcaatgtcgttagaaatgggcctgatatatttatggttacagaattaatccgcaagcgcacggatataccattgtagcatttcactcggaagtatttcaaggtatcgtatttttaatcccaagggaagacaataagagtgaactttactaatgcactttatacatatattacttataattgtcagagcctaagtaggggttaaatataatataaggtagagtgacatgaagcaaagctattcaatactcataacaaaataattctaactaagtggacgaagaaatagaaagcactcaattcctatacttctagtatacactcaaatcctaacttacatctgctaatgtataattgtgtggccaataaccctaacagtgtcctcctggtacttcgagagaccaccacgggttgccgagtttcttacaacaacttgtcatggccgtccaaccgaggctaaatacggaggagtacactccccaggaatttatcttaggaatatatactaacgtggaggaatacccaaactgagctgtcaccatcaacggcccacctctactatcccgcaacatatatgcccaattaatgatacttaataatctaagcatcatgcttatattgttaaatactactctatacccgcatgaccgacatagagtaactgatacagacattaaacccgcaccattacacctctctggtaggctacccacacaattatcataatgcagatataaaataagaccagtactcaaactaaataaagtaccgaagatatataaagaagagtacttcattaattcggaaatttggaaagtattacataagagattacaagagctgctagagccataccgaaaacttttccaaagactccgaggacttctgaacactattctattgtactccacttagcactatactactaatactaaagtatgaagaggaatttagcatgcttgagtgtgttgagagagtgaatgagctcctccttttatagggcccgtatgacggttttagctatgcgcaatttcggttttgcccttgtaaccgtcattgaggagtgatcctggacgtccatgtggagggccagccggagccgacgccactaggtttcagccgaaccaggggttcagtcgaacctgggccagcccagcagacaactagtttcggcaggtcgctaacaaatgggtcccttaggcggttttggcagttaaagtcggtttctgacggttgcacctgacttgtgggcccatcttatccatttgcttgtttaggagtgaggttttctccactttctctttattttatttgataaattcttgcaacatgttattctccaagtacaagtggaaatatattatttagaaataagcatgcattgtaagcatagctagttctccattattttagctatattgatggtcgaaattttgtcggtaacaaccgtcaacaaagggtaaatctaacacaccccgccctggcaccaccatcaacgtgttgatgcgaaacacagcggcctaggagatttgcttcactccagtgcaggaccaaggcttgcctcgagtgtcaagagcgtgtcagctggtttgatcctggaactaacaaggaaaatagaaaatatagttagctgcacgatagctgatcggctaataagccgatgacgtatcgctatgacctagccgttacagtcagaccagattggttgtgtgtttatgatacaatagataaagcaaaaccctaaatatgtcccattggctgtaatattacccttttggtttttgtcaatttgatttaggtaatattataaaatagctgattatccaatatttagagcagaatagatagaatacgggctattactctagtacaaacttatataggcaaatcgatctagataaatataccgaataatgaccaatcttagatacaatgatctaaccgtgattgactaagacttgatatataaagtgatctacctctataaatggcaaatatatatatataacaaactaaaagcatgcaacattatatattagataagatcagctgaaactctgatactatccctaattatgattaattccaagttagttttttagggttctagacaagactagggttgatgcaactcgaagtatgtaaagaaacctaaagtctaaacaatcaagtaattaaccaattttcaggatggtagataccttagctaatgtaatctagcaaggcaatttagccaataccagtacaaacctaaagcgagtctcagccgatactaaatcgagataatagactagattaagtaagatatatgataaacgatagctataaaaatgagaccaatacatctaaagcgatgcaatagccccgataatgcaaaccattgggacaagttacctcttgtcgagagatcacaaccgatgccccgactcgaagcaaaaacttgtctaaaacttaaagaaaaaggtggcgatgcgccgaaagttgtatttattggaagtttgtcctgttttataatgatcttgggtttatatttatacctagagtacaaaacttgtctattatggatatgactcaaactttcctaaagataaaaacaacaaacaagtccacatggaggactcataccatgtctttaatttaaaccgacattaaaatcctaattaataaatacaattgccataaataagcgaatgcaaaagactcggagacgaggttggccccgacagttggactgtagagaataccgacgccgttcccttccaaatgcgcgtcaaaaaagtttaattttcaagtagctttttttttcttgaactgaatttgaagctagctaggccttttagttaagtttttttatacactagctaggtagcttggctagatgtaattagatacatgtagatgtaagtatataaatctagttgggtatatgcctatctatttatagatgtaggtatataagcctcgtgtgctatgtatattctaccgatgtagattaagttggtgctgatatttatgaaatagtaggatggtaggtatatacatagtaccaaaatattctgtattaatttgcatgattacaacgtgcaaattt

SEQ ID NO: 19726 - DNA, 9390 bp, Oryza sativa
ccacccgtcgacagggtggtaactattaaatatttgacctacactaaaattagtccttactgacaataaatttaaatgtcaaagggtctaatcaggcatattagaacttctaatccatggcctccattgttcgatcaaccctctctgtcttgacgaggagcaccaatcgagactttgtatgatgtccatcgaggaacttctgatcgccctccctcaatatatacagaactttgattggaggtcctgattgcaattgatggaactttggatctggaagctatactaagcctattttcccatgcaggtgttgtgcaatgtcgccttctatctaaaaaccaaaggaatattgagcgtgtggagacacaaatgttgatattgacttcaaaccctcataatatgcagcttttcctatgactcaatttgaaataaaaaataaatttaaacttcttgagtcttttagccttgcttgcatttgtaggggtcatcatacattcacgttagtcccttatttggtcgtcttatgaatcaaacaaaatatacttacacactaggggcctagatgcactttcagaagtaactatagtattaggggaggggggagggggtgttggtatttcttaacaacattactagaaaatattcattccaccaatggcgtcatagatggtcatggtatatttatggttacagaattaatccgcaagcgcacggatataccattgtagtatttcacccggaagtattcccagatatcgtatttttaatcccaagggaagataataagagtgaactttactaatgcactttatacatatattaactataattgtcagagcctaagcaggggttaaatctaatacaagggtagagtgacacgaagcaaagctattcaatcctcataacaaaataattctaactaagtggacgaagaaatagaaagcactcaattcctatacttctagtatacactcaaatcctaacttacatctgctaatgtacaattgtgtggccaataacccctaacagtgtcctcctggtacttcgagagaccaccccggattgtcgagtttctgacaacaacttgtcatggccgtccaaccggggctaaatacggaggagtaccctccccaggaatttgtcttatatactaacgtggaggaatacccatactgagctgtcaccatcagcggcccacctctactatcctgcagcatatatgcccaattaatgatacttaataatctaagtaccatgcttacattattaaatactactatatacccgcatacccgacatagagtaactgataaatcagacattaaacccacaccattacacctctctggtaggctacccacacaattatcgtaatgcagatataaaataagacatgtactcaaactaaataaagtaccgaagatatataaagaagagtacttcattaattcggaaattcgtaaagtattacataagagattacaagagtggctagagccgtaccgaaaacacttccgaagacttcgaggacttctgaacactattctatttttactgcacttaggactatactactaatactaaagtatgaagagatatttagcttgcttgagtgtgttgagagagtgaataagctcctccttttattgggctggtatgacggttgtagttatgcgcactgtcggtttcgcccttgtaaccgtcattgaggagtgatcctagacgtccacgtggagggctcagccgaacccctggttcggcccttggttcggccgaacctgggccagcccagcaggcctccagtttcggcaggtcgctaacaagtgggtcccttaggcagttgtggcagttaaagtcggtttctgacggttgcacctgacttgtggacccatcttatccatttgcttgtttaggagtgaggttttctccactttctctttattttatttgataaattcctgcaacatgttattctccaagtacaagtggaaatatattatttggaaataagcatgcattgttagcatagctagttctccattattttagctatattgatggtcgaaattttgtcggtaacaaccgtcaacaggggataagtctgtcacaccccgccctggcaccaccatcaatgtgttgatgcgaaacacggcggcctaggagatttacttcactccagtgcaggtccaaggcttgtctcgagtgtcaagagcgtgtcagctggtttgatcctgcaactagcaaggaaaatagaaaatatagttagctgcacgatagccgatcggctaataagccgatgacgtatcgctaagacctagtcgatacagtcagactagatcggttgtgtgtttatgatacaatagataaagcaaaaccctaaatatgtcccatcggctgtaatattaccattttggtttttgtcaattagatttaggtaatattatagaaatagctgattatccaatatttagatcataatagatagaatactggctattactctattacaaacttatataggcaaatcgatctagataaatataccaaataaagaccaatctcaattacaatgatctacctgtataagtggcgaatacatacatacatacatacatacatacatacatacatacatacatacatacatacatatatatatatatatatatatatatatatatatatatatatatatacacgcatggatggggctccatggagtatgggctccaacgttaggagccgtaggatgcttactgatcgattttgatcatttgggtacatagcttaatgggtatacaccccgtttagtgtatagtatttaataatgaatggaatccatatatttgaatagacagtaacaaaaggaataaatgcatttatatgcatgcatgcaatgcggatgagagaatatccataattgcgtgtacatttcaaaaatggaaacattaaatacccatgaaattggaaataatatctttaaatatggaaacttacttgcttcacgatggggtctgaataaatggaaactaagtatatggaaaaacaaattattttttttggaaaaatggaaagtaagtatatgtgaaaatggaaactaagtatgtaacactaaatactgatcattggtttttggaaacatggaaactaattagttggaaatttattatatatatcgcagcaaattcattatattcaaatgtatttggaaacatgaataatatcgcaacaaatttatatggtaatgtatccgtaccaaattattacattcatgactccattaatttagcaatttgagtgacaaaatatgcaacaaccggtcactttccatttttaggtacggatgggtcgtatactcaaaaatttggtatgaaacggaaaaagaatcccatgcaatgaacaaatttcgattttagtctatgttaagtttatggcaaaaaaaactgggtattagaagtacatttttttttgtaattatatgatgtacagagatgatatattctcaaaaattaatcgtagtatgtgaaaaaaaaacttaggtacagttgtgcatcacgccgcctagccgtttgatttaatatatgttggatacttgaaaaatctagtatatactatctaaaatatcagtatataccggagaaaaattaagtacaatataacccataaacagaattgatttaggtatatacccattaaaaattgcatattttggacacccatttttagttaggtatatacctatctaaatgggcgtgaaaaaaatttgattttcaagtagcttacattttttttcttgaactgaatttgaaactagccaggccttttagttaagttttttttatactctcgctaggtagctgaccagatgtaattcggtacatgtagatgtatgtatataagtctcgtgtgttgtgttttctaactttttgggtatgtgacgtgcatacgtttcaaacgtactacaagctaggtatttacatgaatgcatttgagatgtacatttaattgggtataatactatttaggatacacatttttaggtatttaaacacgtatattgggtatgtgtgacataccatattctatttgggtatatactggtctaaacacacattctaggtatatacccattaaaaattgcatattttggacacccatttttagattgtagtttggtatatacctatccaaatgcgcgtcaaaaaagtttaattttcaagtagcttattttttcttgaactaaatttgaagctagctaggccttttagttaagtttttttatactctagctaggtagcttggccagatgtaattagatacatgtagatgtaagtagatgtaagtatataaatctagttgggtatatgcctatctatttatagatgtaggtatataagcctcgtgtgctatgtatattctaccgatgtagattaagttggtgctgatatttatgaaatagtaggatggtaggtatatacatagtaccaaaatattctgtattaatttgcatgattacaacgtgcaaatttcatgttaatacactgaaaagaacatcagtttaaaaaaacttgtgttaatacactagctcttagcgcgtgcatccaactggtgtttcttctgcccacgaccatcttctccgcatgatcccagggcaacatacgtatgtacagtctttggctcactaggaagacaaaccaaaaacttattagtaggatgcattcccatcttaaggtcttgacaacgaaatgaaattgttacagtactcaatctgcgaaaacggtagaacagggacttgtcaaaatacaagaataaattgaaatgaattacacacgaaccacgcgtggcgaccgtcggtgatagtagcgatgaacctcctcacgggcgacctgcggcggcgacaacgaaccttgcgaacgaccggcgcgcggcgcgtaacggcgtggttacgaagctaacggatgactgacaacggcaacgaaaccttgcagacaaccggcagtgatgaaaagctcgccgacgtccggccggcagggtaatagcgtggactggacagtggagtgtgtaaaaaatgaaatgtcgtaccattttatatgtacacaaaaagtagaaaatattaatcggtatttatggaaataaatcaattacaacctaattagtggaattactcaaaatttgtggatttgattcagtgtcatctcagatatggaaataaattcacacaatcatagggaaacgatgtgagcatgtgcaaaaaaaaaaaggaaagtatgcatcatatatggaaataaattatcatgcaatcggaaggaaattattacgtacatgtttgcttatatggaaacgatgtgagtacgtttatatggaaaggcaatcacgtcctgcaatacatgcacgcatgcaaatcatgcgggtactctaaaaatggaaagatctaatcgggtttacccgttaatatgtctaatactccggtttgagcagcacaaatctcaaagcacatatacggtggatattgttggagcccatactccatgtagcaccagttaatttactctagcatgcaatattatatattagataagatcagctgaaactctgatactatccctaattatgattaattacaggttagtttttagggttctagacaagactagggttgatgcatctcaaagtatgtaaagaaacctaaagtctaaacaatcaagtaattaactaattttcaggatggtagataccttagctaatctaatctagcgaggtaatttagccaataccagtataaacctaaagcgagtctcagccgatactaaatcgagatactagactagattaagtaagatatatgataaacgatagctagaaaaatgagaccattacatctaaagcgacgcaatagccccattaatgcaaaccatcgagacaagttacctcttgtcgagagatcacaaccgatgccccgactcgaagcaaaaacttgtctaaaacttaaagaaaaaggtggcgatgcgccgaaagttgtatttattggaagttcgtcctgttttataatgatcttgggtttatatttatacctagagtacaaaacttgtctattatggacatgactcaaactttcctaaagataaaaacaacaaacaagaccacatggaggactcataccatgtctttaatttaaaccaacattaaaatcctaattaataaatacaattgccataaataagctaatgcaaaagactcggagacgagattggccccgatagttggactgtagagaatactgacgtcgttcccttccagatggcatatccgaattacttcggataaaagctctgcctcccttagccattcgtcactcattatggatgttaactctgaacagtttcccttaggaagcccaattccataggatcgggaggtggcaaaggaacaagtgatttcttcttgctaaaatagttcagggtattgccatagtcttcgttaaaatcgtccctgaacagaattgcggcacgatccggagtctgaatttcttcattctcgacggacggctgcttagcaaccttctcatcaatcgagctagcagaagtggatggttcagtgagcggctcgatcgttagaggttcctctattttggacacgtatgcctccggttggggttcatcagattgcgtcatgaaggaagtattttctagaatatgatccaaaattgttcttccttccgacggcgttttgtgcatcaacgatcctccgacggttatgtccagatagaatgcagactccttatccaaacctatatggaaatgttgcagtagcacatattcgggtaaggatagggttggtccggactgcactaaattagtgaatctggacaggctgcaccgattgaaactgagaatttctactcgaagggcagtaatacgagtaactgggaagaaggaaagacagaatctgtctcgcaacttctcccaactacagcttacacatccaacagtagaggtgtaccattgctttgctctctcttgaaggaggtggctcatagaattcgccccgaggagcagacagctcaaaaagaagtttcaacaattactgtataacaattacctaaacactacgtctaagcaattaatatctactttagtgtttataactcactaaagcaatcactatattttagttgattatagtgaacaataatcccgtatgctatttaggaactaaccaagagataattctcacaagataaatctaaattacttaggaataatattatattgaattcagagtaataaacagaataaaagaaataggagaagattactgacaactccggaattcttccgacttcttctactctactctcttcctattctagtatacaatatagtacaatagagcctcttataattcagctcaagcttggaagtgtgtaagtgaagtgagggagtgatgtctttatatagcggtaggtatgacggttggcgaaggggaaatgtccaaagtgccctccaaccgccatcagggagtgatctggagcatccatgccaaaacctgggatcaacggtgatcaccagggttcggccgaaccagggctaagcccatctggcctagcctttggcccatgtcctcccccgatcctcctatgtttatttctcaggatttttgtttgattctcgggtattttgacaaagttcacaacccatccttgcatggatacatatttctcctcactttagtctagatttcctcccaacatcgggttttatccctgcatacaaatatacaccaacacttgtagaaaacgtgagattaagcacctattactatgttggatgttttattatctgaaatttatgcagatgttggcggtataaaatcgacatttaacagccgccaacaaaaccccccacacttagccctttgcttgtccctgagtaaaggttagtgtagaatgaattccttcaagatatgaaccaagcatataaaccattcacaaccatatccgtacttatgaactttatcagtggctatcttaccatcttgagtaattgatagatggaacaatctcgattccagtcctttttgcttctctgtcagactcatgagatttttataaattttcgcaaacaagctcttttcctcatattgactttctctcaaggatatatattttctttttggatccttaccaaggcaaagtgttccagaatttacccctattctaaggctgaaatgtggagcttggtagggataaatggtgacatacctacatcatatatattgcaaagccaaaaatattgactcaagaagatcatcagtcatactcctagatcaagggtctttatttgtggtagaaaatgggaaaggaaaaaaaatattttgtggaatggtggaataaagaaatgattctccccttttcctatactttctcctctattttgttctcttggcatgaatatggaagaggcatggctatattttctttccaactttgctcaatgttttgggcgcaagctttatttccctctctcttttttttatagccatgcctttcctcctttttttttatttctctttttgccaagaatttttttctaggagaagaaagcatagtctaatgtaggagttatttgaatggaacttttgtggaaagccaactttcagtgtagaagcttagcttaattatatatgtggaaaaaaattaaaatggaaatgaccccttgatcatgtgagtatgaaagatatctaacacgagtcatataaatttgacaaagctcaatataatgttaagcagttatatgcataataaggtttatcaaaggtacacttgcatatggccttggtgggtataaaatgaaatcaattggaggattgagcttttaaaacaattttattttgaaaacaaattcccaagagtcataacaaaagttgcgaaaattcctttcatcttgaatcatctcacatgaagctgggcggcaagggcgacggaaagacggacagcaccaaggcggtcgacgaggcgtggaaggcggcgtgcgctggcaccggcaagcagacgatcgtcttccccaagggcgacttcgtgacgggtcccttcaacttcaccgggccatgtaagggtgacatcgtcatccagctcgacggcaacctgctcggctccaccgacctcgccttgttcaaggtgaactggatggagatcaagcgcgtcgataacctcgaattcagcggcaagggcaagatcgacggccagggcgccgccgtctggagcaagaacacctgtgccaagaaatacatctgcaagatcctccccaacgtatgcatgcatctacacaacatgtattgatgatagagacatgcatcgatctcatttggtatgatccatggacataaatatatatg

SEQ ID NO: 19727 - DNA, 5707 bp, Oryza sativa
accccatcatcatcgacatgaagtactgcccgacaaagatctgcactgccagcggcaactccaaggtcaccatcaaggacatcacttcaagaatatcaccggcacctcctccacgccgaggccgttagcctcttctgctcagacaagctgccgtgcaccggcgtcactttgaatgacatcaatgtcgagtacgctggcaaaaacaacaagaccatggccgtctgcaagaatgccaaaggcactgccaccggctgcctcaaggagccgtttctgaacgatcaaccacgctacatctggccaccaccaccgttattttttccatttcaatttctatttttcaaacaaagacaagagagggaacatgtgtgcagattggtcgctgagatcatcgccggtcgatccaccacaaacactagaatttcgccctctttgcctccatgatatgcgtctagctgaaaattttgtttactaattgtacgatgcaactgtagaatcatgtgatgaataatcttggtgacgaccaaatttgaaagataagtgttcattgaaaatacggcgaatagtgttttctgtctgtgaatagtgtgttggcactgtttattcaaaatacggtgaatagtgttttctatagttgaacaatgtattggcattaggagccgggcggtgcacaccagtttgaccgcacgtgttcaggcggtctgaccaggtagcccgacggtcagaatggcagactgggaatcggtttcaggttgttttcgttaaatttctagattgctttatatttatgacttctagatggtttctattcctatgtgatactattgtgtgctgaagtgagtctagttggtgcgaacttttattcggatatggagtttttctttgttcatgtgcaggtgttgcttgagactatgagaatatagcctgtgatggatcaggactaggcttgggagaagttgaagtccagatgatcaagaatatcacgcgggatgctcagtctagagaatattacatagtggagttgaaggtttccatatagcgtacatgtggtgttgtgtgcatttggaaagaggaatcaaatttggattggtgtctaagtttgtaaagattgcagtgttgagttgtatggggatgttgatttcatggtttggtaggatcaagcttgggggtttgttgacggtcgttatagaccaatttcgaccgtcaatataattaaaataaaggagaactagttatgcttgctatgcatatttgttttagaataatctattttcacttgtacttagattctatctgtcagtagataaaagagatacaatatggaggaggaccaatagcaaaacactcaaacaatcaatcagatgctaatcagacttgtggacaaatgtgccagaaactcagaattgacacgatcaaataggcccataattcactgttttgagtctagaagcaaaagaggaggcgacctgccgagaactgggttaggccggcacagcccagggttcgaaccagtcccagcatcgttcgatccaggcctttgatcagacggtgggaattcactcccaacggcggttggagggtctttccgactttccaaccaccacaaccgtcattcttcagttataaaaggccctcacctcctccactcgttcacacactcaagcaagctcaagatatctcttctacactttagtttagtattctagtgctaagtggagtagaatagaatagctctcgttgtcctcggagtcttcggagaaatttcggtatggttttagtagttttccttctttcttttgtaaggctttcgaaattaatgaaatactattcattatatacttttgatactttagtatatctgagtatcgtctttactttatatctgtatcggtacagtcgtatagttagtctaccagagaggtgcagtggtgtgggtttaatgtctgattactcggttactctatgtcatctcgggggatgtagaatagtatttaataatgtagacgtggtgtctagattattaagtatcattatctgggcatatatgctacgggtcagtcgaggtgggccgctgtcacaccctgaaaatcactaaattataaatcattgtgaaaaaggaatttttagaaattacttaatgattaaagtaagtgtgtgaataaaatctataagaaatttgaacttaaacttgagctagataaaatttcattaaatattttgtgtgcccaagtattttcaggatttttcttggatttatttgtgcattggaagtatttttaataaataaaagatcatttcagcaattatttaaattaaaaagttaattaaaattcctcttctttgtctgggccgaattcagcccactcctctcctctctctcttccttagcccgcagcagcccactcttcctctctctcttagccgaagtccagtttttatccctctagcaatcaggcctagtaaagaaaaggaagcccgaaaaataagtctgttttgtctccctctgctacagtgtcgcccctaacctccagccgatcggtcttctctctgccgtgcccgtgtacagcgccacctccccaccaaattcgtcccctccgttgctcctctttccaaattggttgaaaaaacggattcccctcgatctcctctatcttatccccaagaaacccccttgaatcccgttgtatattgcgtgaattcgacgcggtttcgagctccatttttccggcgaaccctaactaatccgttgccgattcttcccgtatccgagccgatctcctcctcctttggctataaatagcagcccctcgacctcctcttccgtttcctcctttttcccgattttttccctagccctagagccgccgccacgctcggcttctctctcctatgccggccgccgctccagccacgtcgcgccgcctcctcggtcgtccccgacctgcgctgtcgcctccctcggctccgcaaggccgagctctaccccggccattggtccctttgtgccaaatcccgccggaagccgcttgccgacgcgaaccagagggtttcgacctttgccgcgcctccagccgccatccaccgtcgaccccgtggtcgccgaacctcgccgtttcctccggtggcatcgcagcgccaagccgaaggccatccaccccttcttcttcgccggtgttcgccgtaaagctgccgtcacagtcgtcccgatctcgccgctgctcgaagctcgtcgccggctgccgttcatcgtcgatcgtcgtcgtgtaagtgtgggtaaggacggtcttgttctactcttcgctttagtgctctcgctttccaccgttgtgtcatcgtttgtcgtcgccggccatctcccgttgccgtttttcgtcgccgtcaccattggtgagttcgtcgtcgcgtcttctctctcccggagctgtccccttatcgtcggagcgtcgccgttcagtcctcgttgttatcctgagccatctgccggtgatgatgttatcgctgacatccgcatcatctcgagccattgcaaaatcaatataaattctatcttttcaatgacatattattcctttttaatatatgtcatctatcaaatatgatctaatctattttcggagaatgttttaatcttttgtctcagctataaatcatttgtaaattgtttaatcaatttggaatagtcttttctttaataggtttaattggaattaaatcttgtaaaattcatatctaactcatacgaactcggaatgaggtcgttcaagtctcataattcatctaaattcaagctctacccatttatgaactttaattgtactattcatttggtttttattagtgtttttcctcgttttgcgttctaggtttagttttccgttatttcggagcatcgtttgttcgttggagaagttcttgaagacgaattgaagatgcttgtttgtaaggcaagtcacacagatcccaaacaaccctttgagcatgttgaacccgtttaaagctaatgttttatttcaacttatgcattattttcgaatgtcatcgggcggtgagcctttcccaattaattaatggccgaagatgactttattttcctatgggtaataaattgattagcttgaaccttatatattagtttggtttagctaaatgctatatatataattgcttagccatgcttagaaacattagctcattaatgggatgaatcatattatgttattatttatggttatatttaatggtagctcacgatggttaatcgtgttatgataattaattgataattaaaacctgattaaaggtgggttgtgagcacatggttttgatggccgtgctcatgacaattaaggaccggttcgcgagctactgttgtgaaacattaaccgtgccaaccacaagccagcgtggcaacagctttcccttttgtatagcatggttcattatggggtgccagactaagaagcgtctagaagtccatgggggtcgctggggagtccatgcctctggttttttaggaggtgattatgatccaggaatggtgcactgtggtgagttgtgttgtgcgaaggatattgtcacgatttccccctttgcagtgtcgtggtggtacttcggggcatggcaacatgtgtggaatcatgtcttgtgggtacagtggtacatctctggccagagtaaaactattcgaatagccgtgcccgcggttatgggcgggtctaacaatgtttttcgtgattagtcccacactactcattaatgataataatgtgataattaatttgactcctggtttggaatggataattcctggtttggaggtttgatctgtacgaccggggttggttgttcaggtttggttgggcctgtgcagcatgggtgtgctgttcagtgttgattaatattgaggattaattactctactgttttacaaattctcaactctttgctaaatgctgctttcgcaaatgaaccctatattatgccatcctttggtatccatgtgcacttgcatacttgctgtgtggcttgcggagtattccatgtactcaccttgcaataaccatcaaaccttagttgaagaaaaatgatccggaaggagaagacctttggcttagatcctagttgagctgcctgtgggggtggagctgaagcttcgctagattttattttccgctgcagttttcttcatggtgaggactaagtgcctcttatgtaagtatttatcgttttagttattttgatgaatctgtacattaaagtgtcagtttgtgtacctcagctgattcctggacgaggattttaatgcacaaattagtttggaaattacttgtgaatttctgggcgtgatagccactgatggtgacagctcagtacgagtattcctccacgatagtatatatattcctaagaaattttcctggggagggtactcctccgtatttagccccagttggatggccatgactggttgtcgtaaggaactatgcaacttggggtggtctctcgaagcatcatgaatggccactgttagggggtattggctatatggttgtatactagcaggtgtaaactaaagttgagtgtatactagaattatacgaattgattgttcttctatttcttcttccacttagtttaggaatgattaaatgagatatatgagtgctttgcttcgtgtcactctacttgtataaatatcttaacccacgcc

SEQ ID NO: 19728 - DNA, 690 bp, Oryza sativa
caaattccaagctcatccacctcattcctgccatcaaaaggtgcatgttttcagttgctggtgaataaaaagtccattttgtttggacttggaggcaaacaaatgaataaacagtgtttaaagagtaataatccagcaagtaaattgagtaataagtatcttgatatgcctcttttccggcaagtccaaacaaatggatcttttctactcacaactaaatccaaacaaatggctcttttgcagctaataatccagaaaaaatagagtatctagatcaattaatcaaatgactcttttccagtcacactaaacaatatctaatttcacagtaacaacaactataaacaatccagcaagtaaattgaaataggcagagtaataggcaattttgatacacaccatgaacaaaaaattcagccaccaatgaaacagtacctgaggatacaagtgcacaagagacaagttaaagctttgtacctgagcatacaactagcttagggaggactgatctgaccctgtccaaatgctatcatttgtcgaaggaggctctgagtatctgctgccatcttcctcaggctctcaatctcctcagcttgtttttccactttcgcatcagattcttgtgcctgcgccttcaatctttcaagctcctcctgaaagtactgcagactctagcttctttgcatctag

SEQ ID NO: 19729 - DNA, 745 bp, Oryza sativa
agagatcaattgcagtgggctcactgtctttgtatttttcttgcttctgcaatgttgagagatggcatgagtaatggttatgttaaagtacatagataacacaaaaacatgtcctccagaacaagcattccagttgacattgagtctttttgttaaacattgacagtggttgccatgtataaacttaattgatgtcaccccaaataagtataagcatgacaagagcaatcaaaccaaattgatacagatttatggataaaacatgagcatatttttacgtggtcaaagtgtgagataatatgctactctccctactaaagctttaaatcatatagcattatgcagagccactatcaatatgcagatatatatctccactggatctgaacacctccatcaggaaacacaaaaactacatccaactagatgacatcatcattttttttcttaccacgacataggcatgtgcaatgtaagaccgagatccggtacgctgttgaaactgaactttttcacgattcagttggttttggcacatttgtcctgcacatgacacaattacatagcattagtaatagaaccactatgcatctgtcatttccatgcaacatcattttcatttgttttcgcaagtcactattacattaaaaatgcaaatagagctgatccaaacagagctataaactggactatggaataattattttgccacctgactatcaaatttatgttgatgtatcttagg

SEQ ID NO: 19730 - DNA, 588 bp, Oryza sativa
tttcctctccacttaaaaattgctgtcagcagatatattcaaaggagtcccctcatacattacttcagaaaagaacaaatgcacaaaaacacaaacatcaaatattcaaacaacatcatacacaacaatcaaatcctcagatcacaatttaaactgacagccatgttctaacagcaggttatggtgggacttagccatacacagatattttactcaaaatcactatattcaccatcatcatggattggcccttcattttcactgtcatattgtctcacagtttcgtcagcatcatcttcaaagccattttcttcaacttccaattccctttccctctggatctgatcaactagggaagcctgaacacaaataccatcttcataattgctaggctgctcgttgattgaagctctctcaagatctgcaacctgaaaactagtattttcttgctcatcatcttggtatgacaattcatgctctgcctgggccggcaggtcatcattttcttcttcgggcacattccacaagtgcctatggaaaatttttgaacaactttccaaggctcaccatgcttgttatcttctaagt

SEQ ID NO: 19731 - DNA, 422 bp, Oryza sativa
ggtggtgagcagggttagcatcgggcacgaggggggcggcatcttacggtggacaagctggagagcacctgcgaccagtggtgggaagcaggggcaggacggaaaaggaggggcgcagaggttacctttgctgagcttgaagaacggactggtggtggcggcgaagagacagatcttgccggagggtataatttgtcggtggtgccggagttgaagatgggatggatggatggtgggggggaggggggcggcagcgacagatctcagttggtggtgactggggagctcaagtcggcatgagagatacagggggaaggagatccagatctcgccagagcttgaagaagggcgagatcgagttgtgtggaggaggaagcgtgatgggacagaagacttgaagggataagggtggttaaggctct

SEQ ID NO: 19732 - DNA, 407 bp, Oryza sativa
cccctttaccactgatgatgtgtcccaagtaagatagttgggactgaccaaaggaacacttactgagcttcactttccattggtgcttgtgtaacaggagaaacacttccttgagatgagtgagatgagactgcatgtcctgactataaaccaaaatatcatcaaaaaagaccaaggcaaatttccttaaaacaggtgcaagagtatcattcatggccccttggaatgtagctggagcaccagtcaacccaaatgacattaccatgtactcacaatggccagtatgggtttggaaggcagttttatgctcttcaccttcctgcaacctaatctggtgataccctgcccttaagtctaatttggaaaagacctgagccctagataactcatccaaaagttcatcaatg

SEQ ID NO: 19733 - DNA, 445 bp, Oryza sativa
ctctcgttgacgacaggtcggaatatcggagcaggtacgtacgtaaggtggcgtttttgttttgcccgttaattagcgtggttgacgcggcacggacagtctccggctccggccaagcgcaaacgaacagtcagtatgtacgacgatacgatcgacgagctgtacatgtttccaaaccgccagcgatggcgacagggacgacgaaatttctgcagataatatgcagctagctgctgtgcctgtgtacgtcgtcgtccgggcagtacatgtgcgagtgcgagccatagtagctccagatatgcgtgctgatgtgtgtcaaaccagtggcgcctccggacaggtggtgctcccagtctttccatgcgggcgaaaaagacttttgcccgaccgcatgcaaaaagaaaaaatcgcgaaaaaaatcaaattcaaaaaaaaaggaaaccct

SEQ ID NO: 19734 - DNA, 616 bp, Oryza sativa
taacaataagggtcgcaccaccgagatgaaataactatgaagcggttggcttgtggtccatcaactacagtaaatttttggcagggatatgacattaatagatactcgtttagcacaagagcccgagatagtaagacttgtacgcaaaacagcggtgtccgtgtggaggcaattgatgaagccgggaaaaaacaatcatacttcgggtttattgaagaaatatgggaaatcgactatgggcacacaatgcaattccctatatttaagtgccagtgggtaaaatacccgaacggggtcaatgttgataagttcggttttactgttgttgacctggcgagtgtgggtcacaaggatgacccttgggtactcgccaatcgcgtggcacaagtgttttatgtgaaagacccttcaaatttgaagaaagatatagtgctatcagggaaacaaaagatattgggagtggatgggattgaagatgtcgaagattacaaccaatacgatagtatgccactttatagtcagtttgtacagaagattaagaatgtcgacacatctactcaaaagaccgtgaagccttacatgcgcacggacggtgtgggcaaaaatgttaaagggt

SEQ ID NO: 19735 - DNA, 649 bp, Oryza sativa
tggtgcaccatgaccggccgagccatcaccaccgctgtcgcttcccaacgccacaaccagccgaagccgccgccgccgtcaccagccaccgttgaagcagaagccgcttgcccgccaccgccaccagccgttgtcgaagaagaagtcggtcgcctgccgccgccgccgccgtcaccatcggtagcctagagttaagttggatggagatttcgggtacatgttacttaggccgagggcatttatgtccttttgaaatttctatctcctctttttcactgaaaatgataaaatattgtctcagatttactatagctaattacacaaattttgtggtgcctattagtagtgtcgcgttttttgagtgtcttctagctaattacatagcttagcttttagatgtccgtggcaaattttgcctgatgcttcttttttttttttactaattagtttctttatcttcctaagttccaagctgggccttaattttcattgcacatggcatctgctttccattctcaaactgcaaagcgacgcgacgcggcacgacaccaaaaataagtagaagcgtactccatactctgcactcaaccatggcggaggcggccaccggtgcaactgacacgtcactgccgccgccgccgccgcacgt

SEQ ID NO: 19736 - DNA, 497 bp, Oryza sativa
aattaggtaacttttttcagcaatatgtgctaagacattgaaggtagatgtcttgaacaaaatgagaagtgaaatcccaataatattgtgcaagcttgagaaaatttttccaccttttttttgatgtcatggtacacttttccattcatttaatcgatgaccaatccttaggggtccggttcagtatggatggatgtacccagttgagcgtaggttgcttactttgaagcgttttgtgaggaacatggcaagacccgaggggtccattgcagaggcatatgtcgcaaacgagtgcttgaatgcttgctctaggtattttgatgatgttgacacacgacacaattgtgagggcaggaatagagagcgtgtagttttgagagaaggtggcttatctattttccagcatggagtcactcttcttggtgcatcgaggatgacgtacaatgagaaggattatgacaagatgctttggtatatcctcaacaatactccggagg

SEQ ID NO: 19737 - DNA, 536 bp, Oryza sativa
gacgtaccagctaacacaaccggcacaaagaatagcgaacggtcagcaatcacgaagaaaaggaagggcgagagaagcgtgaatagaaaggatgaagggttccatgttgttacccatgtttcgcctaaaggagagccgctcgacgctaagacggcacgtgcgaaattcagttcacagtgtggcataatattaagggaaaagatccccatcacggtcaaggactgggatcatgtatcaaatggggataaggaagtcctatggaaagagttgaagaaaatcttccagttcccggatggatcagaggcagcagtgagaaattgtgcactgtaaacaatggctaagtcttggcgtggttggaaaaccaccttgaacaagaaatttgtgaagacgggacgcacaccattttcgacgtatgccaacataacccccaatcagtgggacgactttctgaccttgaagaactctccaaaagaaattcaaaggagccaaaagtatgcagagttggccaagaagaacaaatttcgtcatcgcttagg

SEQ ID NO: 19738 - DNA, 672 bp, Oryza sativa
ggcccacatatcagtgagcagtactgtacatgcagtactgcaggggatctcaattgcatggttttgggtagagtgtgagtgacaaagttgctcgacttcaataggaggcggtggcatcctcatcacggctactcttgtaggtggaggcgtcggaagacggagcagcggtggacaatggtgcctccagtgcaggggtggaaccagacaggactaacagaaaggactgaacaaagtatataaaactatagctccttcttctaataaatatatgatagaaaattttagtgaaaacttaatggggcttccatggttataacgctgatagcaaaggctcgcgtccccgtcgtccccatggcagatccgccactgcctccatgttaattagaccgcagcagagactcctgcattgttgagatggagcaacagggtggagggaagggcaaggacatggttggccttgatgatggagcttgatctattatccgccgcttggatcatgtaacttcaaatgaggtactactgatatatatatatatatatatatatatatatatatatatatatatatatatatatatatatataagcaatctcaggttgtcttgataaaaatgttctgccgggctgaataattggctatatttgagcttacccaaaaaaaattatccttta

SEQ ID NO: 19739 - DNA, 374 bp, Oryza sativa
tgcgctcgtcctgccgatgatttcctccgccgccgccggggacgacgcgctgccgctgcccatgacgccgtcgtactaccgcaagtcgtgcccaacactcgaggccatcgtgcgcggcaccatgctcagtgccatcaaagccgagcgccggatgggcgcctccatcctccgcctcttcttccacgactgcttcgtccaggtagatgatcctagctaagcttcatttcttcctgctcattgggcggatgatctatggagatcttgaagcaatgcaagctcacattgcttgtgattgatcagggttgcgatgcatcgattcttctcgacgacgtgccgtcgaaggggttcgtcggcgagaagaccgcggggcccaa

SEQ ID NO: 19740 - DNA, 647 bp, Oryza sativa
gtcttctttcagacataaggcagttctacgaaatccctacatcctgaattaaacaaacttttatcaaatcaaataaccaattaatcagcacataaatcaacatgctaatggccaaatgcataaatactcttcaatccttgcatggcatagctatggccagtgccacagcatgccacaagagagggtccgccactggcaagagcttcaatctcttgaaaaattttccttgagtttatctttctcatccgattcatgtgttttttttggggtccaatcaaacgaccattcctgtgtttttccgcgttttgcaatcatctgatttacacctacgttcctatcagaatgctgtatttttccgtttttcattcgtgcgattcaaagggctacttgatataggcacacaaagatagtattttaaagtgtgtcaggcttttgacaggttgatccaagcacatttggcacaaaataagtgaagtacagggacgatgtaggtcggtggacccatctgtcgtaaacccatactagttccttagtttctcacatatcattcaaatagttaaattctaaaaaaaatcatagattaatatgtgatatatacttcatacacatgtaagtttaaatacgacatataaaatttgataaaaaaa

SEQ ID NO: 19741 - DNA, 1572 bp, Oryza sativa
attttaatgtataacgccattgaccttttgaccaatgtttgaccattcgtcttattcaaattttttgtgtaaatataaaaatatttatgttatgcttaaagaacatttgatgataaatcaagtcacaataaaataaatgataattacataaattttttaaataagacgaaatgtcaaacgtttatcaaaaagttaacgacgtcaaacattaaaatatggaggggataatatttaacaccatgtgataaatagttgagacaaaatatactttatacgattattactcaagtaaatcagtgcagagaccgccagactggtaaaaagtggtgacagtaatagattaatagtacttctagaagaaaccgcgatacttaaatatgagatctgagcaattagggtgtgtttggttgcccatattcccctagcctggctcatttctcgcatccaggctgagtttgacctggctaagagtatacatatgcagttgtttggttggttgcattggtctagccaggctagcatgagattttgtttggttacttgtataagagatacggtttgaaagggattttgtttggttggttgcatggatgtgagtgttctttacctcttcatttagttgggtgaggttacctctacaatatatataacaaataataagagtattttgatttatccaattgaatattcacttacatatgcgaatgatactgcaaaatcactctattatctacataaaataagtcggccaacttttcacaccgaatcagtggtacgaaaaataagaaaaaggttatctattatattattaaaggaatagaaaaatgagcctccacgttcgctctcatggcctagaaattctcacattaatcggagaaaaagaaaaagcagagtccatgtagaaatacaatttagaaaatagctgaaatttggaattaaaaaaaataagaaatattagaagaggagactagagtccatatagaaatacaatttagaaatagttgaaattcggaattaaaaaataaggaatattagaagaggagactagagtccatatagaaatacaatttagaaatagttaaaattcggaattaaaaaataaggaatattagaagagaagactagagtccatatagaaaaacaattaggaaataactgaaattcggaattaaaaaaataagaaatattagaagtagagtatagagatacaatttacaaaaaattcggaattaaaaaaaagaattattaaaagacgagtctagagtaggaatatatataatttacaaataactaaaactcgatattaaaaataattaataactaacacgtatataaaataccatatgaatattacacatttgtagtttcgtaaagttattgtaaaatttaaaattatgatgttattttaatatatttgaataatataataagaaaacatatatgctattatatgagagaaaatataatgatgctagcgcgcaatctgtgcatgccactatgctaggttttctttaagctagatgaaccggtggaactaattaatctattagtagtcattgtgcatacattgac

SEQ ID NO: 19742 - DNA, 271 bp, Oryza sativa
agtgtgtgtggtctctgaatctgaaggaaccaagagtggtcgttcagcttcaaccaccagcggaaggagacgatgaatccgtcgtcgtcgtcgtcgaccaccgcggcgatcaggcggtggccttcagccgccggcgcggtcgccgtcgtcgccggcgagcgacaaagactagcggagagattcggctactacaccgggaacggtggcgcgtcgtcgacgtctctgccgctcatcacgagggccgccatggcggcgccgccgccgatgtttg

SEQ ID NO: 19743 - DNA, 323 bp, Oryza sativa
ccgctgccgcgacctccttccgcgacaccacgccgccgtcgccgccgtgtgccaccggacgtagcgccaccccggctacctccgtcaggatgaccgtgttcatcttctgctcggcgtacagcggccacgcgatcatcggcacgccggaggacacgctctccagcgtcgagttccacccgcagtgcgacacgaacgccgccgtcgccgggtgcgccagcacgcgcacctgcggcgcccacgacgccacggcgaggccccgcccgctcgtcctctccacgaagccctcggggaggaagttcatcgggttgctgtggccggcgccc

SEQ ID NO: 19744 - DNA, 1456 bp, Oryza sativa
ggcgccggggctcgccagcagcacgacgtgcggccggttatcctccgccgtggtgctcgccaacggctccatcggtcgtctgtaagacggtgtagtgtgcgactgtgtgttgtgtgtagacgacaatacgagtcgtatatatagcccacggccacgcagctcgagaaaacatatgcgtcattagcaattccccaattataattgtggcagttgacgatatcttttcttcaacaaagctaccggtagctattagtgaacagtgtgccccagaacctagtgaatcttaaaacgaagaaagattatgtgatagtgtagcagccggcggcgatggctcctacaagacaaatctcggttttgatccttctcggacctgtttttttagtaactatataacattcgacagttatttttaaggaaaaaaaactttcacatgtaactaattataacagttattactgttttgctatacttttttgtgctgttcagctgccgatgtaatagtcaggctaaaaaccctaccccttagctctagtttcagtgctgtcttttgaggttgctcttgttgtcttctctacaaaaccagctaatgtggtagccttatgtatctttctgtctgtacccggaccttatagctctgttcatttctagttatggaaatggggcgtcagcccttgataaaaaaaatagttaattacaacgtatctagtatgaaattgttatataactattacataactaataacttatatgtaacttgatcttttctttcaaaaccacatggcattgcaagtgcctagcgtagcggtcttgcaagcaacaagtcaagggttcaattctcgcttgggcacgtgcgatttttttttatatctcggtatcacgaatctcgaagaacatccgacggtggaaaatttgaaatttttaaagaaataaatcagtcgaaagtttttttagcaaaacccttttttttgttaaaagacatttaaggacatgtttgtagcatcttgtgattgtagtagtttcttcgtcatatagggaaagtgtttatcatcctatcgagggaatactcctagttttttatatgctatctaaattgttataattttcttttaaaaaataaataagatagattaatatgaaatactatcactacacaaatatgcaaattcaaattaaacttctacatgttgtaacaaaaataacacataattataaacatactttaattatttttatttttatttttatttttttctttttttggtaatttgtagaggttgaatttaggtttgcatgttaatagagtgatatattttagagtaaatttcacaaaactacaggtaatttgatcaatctactacaaagctacatatttaataaagtgtaacccaaaactacaaatttaaaatcatatttttcagaaatttataaatttaaggtattatatcataaaactaca

SEQ ID NO: 19745 - DNA, 611 bp, Oryza sativa
ggcgaattaatgtttcttctagcgaattcgaaaaaaagaaacacggcgatatacaatagagtttctagaattatagtggattcagtttgtttgcatcgcactactaggaaaagcattatcgcaagcggccgaaaagggtcttcgcaggcggggcgatcgtccgcctgtaagccaacgactgtgaagatctccgatcttcgcaggcggggcggccgtccgcttgcgaagataattttcgcaggcggacgttggctagtccggtccgcctgcgaaaataggaatcgtccgcttgcaaaaaaaaaaacttccgcctgcgaagataggtagaaaatattgaaatttaataataatttgcccgtaaattacttttaaattatttaatagaaattcttgcaggtagatttttatgtacatatatcggaagattatcaagcatttggtactgagaaatctacatatattgcataactcaaaagtgttgccaaaatatatatatatattacaatatttttttacattgtcacttcaaataacgtcatctagttacgttatggcatagcagtgttccactcccgaagatccttgaattcgtcacttgccgctagggcacc

SEQ ID NO: 19746 - DNA, 256 bp, Oryza sativa
tatgagatcgacaatcaaccattcaatccacctataaatggccatatggcccaaggcccacgggctgtcccaaagctagcaaatttggcccggcccaagcacggcatgacccgactggggtcgtgcccatgccggcccggcccgacaaccgggccatgcctgggttgcacccttggcatggtgggccagcccagcactgctcgatcaaataaaaaaaatatagggatgcaaaatagacttaaataatcgtataagg

SEQ ID NO: 19747 - DNA, 1507 bp, Oryza sativa
gattaaataattgatagtcttggctacgcatataaatccacaatatccccaccgcgtggttataccgacacctggacaaaagaaagtcgcacggataccaacagaaatcaacattttacacttatcatatactcactccgtttcaaaatatttgacaccgttgatttgtttgaccattcgtcttattcaaaaaatttaaataattatttattcttttcatatcatttgattcattggtaaatatagttttacatatttcacaatttttttaataaaacgaacggtcaaacatatgctaaaaagttattgatgttaaacattttgaattagagggagtactgagtatgccgcaagttggtccatagattaggattagaaccacgaattataagtcttcacacaacaatagcttcaaattctttatttagtgttgggatcaatcttcttccaaaataaatgaagcatctgacatgtcttttagaaagaaaggctcagctgacatccgaattccgaaagtgagtgatcacctttcaagtttttgaccaaatttcaccgaacgaaagtgacaccggctaagactgactcaacgatcctcatgcacggcgttcttccacttgccggccacctcctcgagcgcgcggcgcgacgccccgtccggcgaccacgccctcgccgccgccgccgcctgcagctccctcgcccggcgacgcgcggcgctccccttctcccctggatccatgagctccttcaccgccgccgccacctcctcccgcgacaccacgccgccgggcgccaccggacttagcggtagcgccaccccggctacctccgtcaggatggccgcgttcatcttctgctcggcgtgcagcggccacgcgatcatcggcacgccggaggacacgctctccagcgccgagttccacccgcagtgcgacacgaacgccgccgtcgccgggtgcgccagcacgcgcacctgcggcgcccacgacgccacggcgaggccccgcccgttcgtcctctccacgaagccctcggggaggaagtccatcgggttgccgtagctggcgcccatggaggaaaggagcccgccctttcttggcatgcgcaccacccagaggaacctgtggccgctcatctccagcccggcggcgagctcgcgcgtctgctccacggacagcgcgccgccggagccgaaggagacgtacaccaccgaccccgccggctggcggtccagccactccaagcacgccgactcgtcggcgtcctcgtcggaccttggccggacgaacggcccgacgaggtacaccggcgggaacgcgccgttctccccgtctcgcctgaacgcttccgcggcgcccggctccatctccgggaaactgttcaccaagaagccgtcggcgccgccgtatcgccgcccctcctcgagcacgtaggcgtagaccggatcggcagaatcccggaacccgtcggggatgtcgccgtggcggagcggcgcgcatccggggag

SEQ ID NO: 19748 - DNA, 705 bp, Oryza sativa
agggagttattggaggctccctgttgaccggttgaggtggggatcggaaagccacaagcgcgcgcgcgcgccgagccgagccggccggcccgagggcgtggggaggccgaggcgttgcgttgtgtctgcatctctctctgtctctctctcgatccttttgcaatggaccggaatccaaccccgcgagattgcctctgtaacgggcaggcaattcaatacgcattgatcgcgtcgttactgcggcaacgggcggattcctctcctgcgctattaggaaacagagacccccgatcagatctctacgctttctctccgattgctggttcttcctccttgcaccgcttgtgctgcttctgcttccccggttctgatcgcttgcgcacatgagagatcggaacgagcaagccctccgaaaccacacctcgcctgagatctgcaccgggtaggcgggtgatcaagtttttggggagtgcttccgcacgactgctcttcttcctctgttcgtcgtcggttcatttgcatcatgtcttctggagatggcgcacctggagcgggagctggcgcaccgggagccggagctggtgcaccgatcgacaacaccaacggaggcaattctacctcacaatccagggatggaatttcatagtgtataacattctaccgctatctctgtttttgttacttctgttagtcgcaatgttattg

SEQ ID NO: 19749 - DNA, 227 bp, Oryza sativa
gaaaaagaagatgaagtttttaggctacttactctcttggccaccgagcctctcaacggcatggacaaaggccatgtggaggtccggtgtccaccggagccgaggcagcttcgaccggttgtactgccgcaccgatggcaccctctgctctccggcgttgatcccctccaacctgccgccaccgaaatccttgtcgcccttcaatttgctctctgaaacgttattgg

SEQ ID NO: 19750 - DNA, 1895 bp, Oryza sativa
tggttccaatttataagttctaactgattcaactgttgttagttgtaattgtcagattccctagtttttttgagttcccagttgaaatttgtgctggcctgcgattctattcagaagaagcaaaacagtcattaatttagacccatctgaatggagttctttagacacgagggaatgaaatgccattacttttgatacttctcttattcgtggtatacatggtatctttcacatgtaggatttgaaatttgaacttcaaatataagctggtttctccttgatgttgcacttaaaggtaataccaccattaaaagtgtccagtgctgtcatggaaaacttatggaagatataatcagtgttctattatcttagcctcatatctttggaatacatgaaggatttaacaaagtacagtcaatacagtttctaatccagtacaactgttatcttcttgagttcttgacatgattttgtatgtgttgcttgattataggtcagatggcgcatcaacatctaatatgcgtagaggacggcgaagaagtataagttttacccctgaaattggtgacgatattgtgaggttggtaaacccgacctttaaccctgagcaatgatacaatgtggttaattgaattgtttattcatagttttgcccaataatacaacttaacaacaatagtaaaatccttgcttgcatctaaatactcaatggaagaaaatttcattttcaaagaaataatagaactataaaaattggttatttggacaatccaggtataatttatccatatcatgcaacctggtttataaatctttgtgagttttgttccatttagcgaagttgtgtgtatgcgaactgttttttgttccaagtaattatgtggttttagttctctcttttttttaacttgcatcctgtatttctggctttctgcattgaaccgtttgtgtttctttgctgtcaggactgataggaacttttacttgcttgtttacagcgcagttcgagcaatgagtgaaaggatgagagagaatcgcctttcaaggggacaaatgatggtagtcctggacaattgaatgattcacaaaaaaatgtattgttttgcccctttttagttgattttgttgatatgctttgctgttcaattttcaataatctttatgtgacctgcttatggaggacagttgtatgctcattatccaatgcataaattttgttggaatggtttttgattatttagtctggtattcacatttcgtgattgattccatatgttatacaggaatcacctcatgatttcaatgacaatgaactacatgtaagaggaccagatgagcaagagggctcaagaaggcaagttagtaaccagaaggctgtgtcattaccttcatcgccccatcgattgcgcagtgatggttctggcctcagaggaccagccgagtttctgacagcagatctgatgtccacttggaataaggttttgcgatcttcaccatttctgaacaagcctttattgcctttcgaggaatggcatattgagttctcagagattactgttggcactcgagttgggataggcaagtacatggttcgctatctatattctgctacattcaggaagtccctgcattatgaaatacaccacttcgttagtttttatcttttattgaactttttagaaaatcataatgaatgatcaattatcccaatataaataaggatgttttaagttgaccttttagagtcaagaaacagcctcttggtagaatgtcattttaaaactgctaactcatctgaatgttttccagggttctttggagaagttttccgtggtatctggaatggaacagacgtagctataaaattattcctggagcaagatttaacaacggag

SEQ ID NO: 19751 - DNA, 581 bp, Oryza sativa
aatacgtatgtatcgggtttgttttattcctccttctcgattcctctttctgtttcctcacgcacgtgcccaaaaggacggagagccggtgggtcgaggcgacagtcggcgcggcgactgcggaaggtgacgggggcagaggaggtggggccagcggttggcgcggccacgacgggcggtgcggcaatggagaagggcagcgaggcagtggggcacgcgagaaagccccatccatagtgatcggccacctccgcgcatcccccacccgtccttgcatacgccgtctcctcgcatcccccactcgtcctctcatcttccgcctcctttcgcatccacatctggggtggcatggctccctcaaagaaatcgattcaagcgcgccgacagttgcgcgacgctactggcaagttcagcggtcgcgtctctctgggaggggtgcgtggtgcctcgacatcggcgaaggaaggggcgcgccaggagctcaaaaaatttaagtaattattaattcttttcctatcatttgatttattgttaaatatatttttatgtaggcatataattttacatatttcataaaagtt

SEQ ID NO: 19752 - DNA, 20591 bp, Oryza sativa
  unsure (1)..(20591): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcttagggctttgcttcttccgctgatgcttacagaggactgggcaccgatagaggagatgggattgatgtttgctaggatgtgggctggctctatttcctgctgggccgtactgatatactagttgctgggacttggagaatccattcaaatcacgactcgatcttactcaagtgaagtcattttcgtttcagcaatgattcccggggtatcaaaagcctatccaaactccaaaggcttgaaaacaaaacttagatctgacaaaagctgaagactcgatcaaactgtataccccacattcagttccgtttacactaatatatattacagtatttagtttagttggaatcagtatggtaatgtacatatgggatagtttaagagcaggtacgatgagtacaacatctacttctggagataagagcaagtatagtaagacctagtcagtaggctgaaccatttcccacgtcatcaaaatcctatatggcggagtgagaagagaagagagagaacggagcgggcggtcccgctatcgctcggctgaagcgtagtatacgagagaaaaacgcccgcttccagcccgatgagagcaggtataatagcaggctataagccagctataaatatattttaaagagataaaggaagagagggaagagcagcgggctacagatctgtagtcagctgcggcacggactccaagacgtaatgtgtgtatgacaggtaggaccaggtattaatagtatagtaagcaactattatataaattggctattacattggctatagatgatttggagctagtagttggctatactattaaacttgctctgagagcgctaagccgccgcttcgttcctctccctccgatcccgtgcatctctgccgccgcccccaacctcacttcctccgcgcgccaaatccccccacctcctactaaaatcgagtcctcccgctcaaatctgcaataaaaccctcccaaatccactcccatgccaccaaattcgtccccaaatcgcctactctcaaaccctagaccctaaatttgtcctcaaacctcatcaagatgaggcagcaatacaaaaggacgcttgcgccggcgtctctggaggtccctccgccagcgactttgcctgtcacgccggtggcgactcagcccttgacaccaccgccacctcagttcgtccttgccgccgtcctttttttccacctacatacctgatggctggttccccgcagtaacaccgcaatccattgtgacctcctcctcaccatgcttgctcgctgggttacgacaaccaggcatagtgagttcgtcggctcaaggccctgcattagtgcctctgcatatcctgccccaagtgctgagaatgccgagaatcccaatgttcaagcacgatatgatctagcccttaccgtctttatttttcttagtttgttaatcctgctcgaagtgtatgtatgattttgttgtgatatgtcctattgatctgttcaaggcttcacgtccatacatgtcaaactcaattcactgaatagctcctgttgtgtcatttatttagggggtatatggatcagattagctcccaaatccatcggatcatgctgacaatgctgcttgaaaacaatggtacctgggtataaagatgaacatgttgcttgaacatatgtggtatgcatgttactcgaaattaattaattatatgtttctatgtttgttatcaatatgatatcaatatgattgttatttcaagtgtgatatcaatatgattgttatttcataaatcttgatatattttcctgttataatcaccatgaaatgaatattttgtacccgtgttgtttcattcttttggtgactgtacgtatggctgagcatacttgtattttgtttgatgaaatagccacaaagatatagccacagcatatcatgtgcacatgcaggcacatgttaactaatagccaaacatacagccagtctattatataagtgaacttttaagtggaggttttagatgacatggtataagagcaggtacaatagcagactattagctagctgtaaatatattttaatgagataaaaggtgagagagaagaacagcaggctacagcgcggactccaagacgcaatgtgtgtattaatatctggtcccacctgtcatacacactttgtgttttggagtccgtgccgtagccggctacaaatctgtagcacactactcttctctctcctattttatccgcttaaaatatgtttatagctggtttatagtctgctattgtacctgctctcatacgccttcgtacgtcggttacagcgggatgagatccatgagagagagagcagcgtgggaggagtaggttcagtacggtatcgaggaatacccatattcatagagatcgagtgtcgtgattacatcatcagcaagttccgcgaggactttcccaccacctcaccttaaccgaggtccgcaaaggcgcttgttgatgaagtcacgctccttcagagcaagtataatagtaggctataagccggctaaatgctgatatggaggagagagaggagaagcgggctgtaaatttataaccggcttggacataagaaccaagaaactctatgagagagataagtgggtcatgtattaattataaagagctaactattattatatgggtagactaagagaagactataaagaaccttatagccaacagattggctgtattattagccttgctctcaaaaattgttcgccttcctcgactcatccggcctcagcaacttcttcgctccagcggcaaacgaaggcagaggacatcatggaggtgcatccgtgcatatagggctattgatgccgtgggtgtgggaatcatacatcatgaatgagaggaaagcttatgggcctgttcactctgatgtcattttcaatcttactaaattttgataaagttgtaaaaaaagtggctacatttagtttgctgccaaattttggtaactatataagaaatcctgtcaattttggtaactatgctgataaggtttttttttcatccaagtgaataggccctatgtattgacatgtttggtcaactggtagtgataattagtactattggcttgttaccgatgagtattagctgttaccgtactggcgtggtaccaatagtatcagatatggtactcagctgatatatcatacctccaaaacgagacaccgtgcaatatagcaacccgtaagttttatgagtataaagtttctataaaaaggaaagcagtgacactgtgtgcgtacaaaatgaaacgcgaaagggcgttcggttgatcaccgtgcgcgtgcacgtatgtgtgcatgcatctcaacacgtacacagtgcacacacgttaatatctactcctcgttcaggtgtacatgccggaaggttttccaaacctcaacatatcccatactacctgtctgacctgtcagcccagttaatgcacagagcaggcggtggaatacgtcgagcagccatgggccttgctgatcacttgaccggacccaatgcggcgggctccgtccacggggcgccggtggagcagacggcctgcgcccgcctacaaccccagctgggccaccactacagggcgccggcttctgctgatgctgaggcgggtaacgcccctgcggcgacggcggcgtgcgcgccggccggcgcaacgccgcgtccggcggcgatccttgggcagcttcgtcgtcctcaccgtcactactgcttccgtttaggtccaagtagtccaccataacctgcgtggtttcctctactgtgactgtggtaagtacagggagattttcataatcttgatcacctagagaacgggaaaccaaactgtcagtcttgtgagaaagtatagtagtgctatatgtagtgtcgaaataagacggccagagaagtgtaagtaccactagcaagtggtcgagcttcgaggagtaatggaatggccagaacgaacacgagagcaagattgaaagcaaccggtaaacacttcatggcctaagaggctaagaatatactattctctgcagcggctagaacgatctagtaaggcagctcgactcaaactctctgtgcccagctcgatcagaagcacgcttatatataactggcctctgacgcctctccccgaagggcaaaagtcccgatcgccgattcccactcaagatgccatcaacaaccctgtgaaacgaagcagagaagaagcgcattttgtgcatgcgcgttatattatgaccggtccgtaaaccaggaaacacgccagccacagaatcgtttactctctcaagtccaagttacgagtcaattctcaattcatcaggcaaaatttggccttttaatagtttttcttaaggcgttctgctcaggcgacaacagaagtgggcgactacctgccggggagtacgaagtagtacagtgtagtagagcctggccttatggccatgtgtccacatgcatgcttgctttgtaggagtattaatcaaaccaccgcgtggttgtggttgtcttcatgcactgtgtacgtcagacaaaaggaataatcgaaacacccccattgtctcgcttgggaaccttcttttcccttttctgactattgactccacacaaaaaaaaaaccatttctgcatgcatatcacgcacgattgagatgcgcgtagctaaacggcgattgctgggtagttactacattttttctaagacaatggaattgaatattccggttttttttcagcgagctacagtcaattattacaatgtaacaaacaagtgaaactcataaaaataaaaaaagacaccaatcatgaaaaaaaagcaaactaaagactaccaatccaagataaggagtatacaattattgaattttatttgtgaatctccatccaaaattggtaaacagttgtataaccgttgtctcgagattacgacatgcaacttttaaaaactcgccctcttcatcacccttttgtagctgtgcggttctaagccaatatgttgtctaaaaaatacctgcatatataaaatagatggtgatttgtcaaacatcatgtcattcatactcaaccaatagaacctaacataaacagatatttctataagaataagttttctatttttcttttccggtagttcctacatgccccctccgttccatattattaaatgttttgggtgtgtcatgtgtatttttcttaattaagcttagacaatcgtcgtagcaatatctatagcaccaacttagcttatttgaatcaaccgacgaatttatttttatagtacatttgttttatgttaaaaaccatattacatttttctataatgtaatcaaacttcttaacatacacggagatagctgtatgttgcttacgctttactttattgaagaaaaaaaagagtcatgctgtgcgttatatagattgtacaacccacgtacaatcataccgtatccaccaatcatcggttaggcttatctgcaggtgggctcgggcaagcagcaactgtgtttgtgcatgtagtactgatcggatgtaagtactccagtacatatggatcggatgtatagctatttctaaaaataaaatctacgcagttatgaatcacttagcagatgattactggaggggtcaatctttttttttcttaccaaagcactgtgggaagcccccgcagtaaaagaactttattaatgaaaggaaaaaaaatacaataagattatccaagtttataatacatcattttctacattatttcatctatgaagaagaaagagtatatccttttttaaaaagagttctcaaagaacggaggggccagtcttaaacaccccccccccccacccaaaaacaacatatgtttcaagctttgaattatttatttgtttgtttgacttaaaaatatgtgttttataaaagtatagaagtatactcctcctgcctttaagaggatggtttttaaaaattaccctactaaaggaaagggaagggctcatatttaatttttaatttggatttagttcctcaccgccggttttcattgctagaaaaacttgtaatgcttacttgaggttttcattggaggtcatttgaaatatagatatgtatgagattctattttaaaaaattgatttgagattttctaacgaatatttagcccctagataatcttaaatgaaaaggttgtcaactttaaggtacagaactcgtcgagatctacaagttttatataagtttgatttcaaatgaagtctacaaattgtaaaagtacggagatgataaacaatacgggaaaaattgcttttactaccttcccatcctcagaggaggatgggaaataagcttaaagggaaatatcacatagtaaagtgggaagacatggcatttcctaaagattttagtggcctgggtttcacagaaacaaggaaaatgaacattgctctcctggccaaatggatcataaagattgaatcagatgataagagcttgtgtattgagttgttaaggaggaaatatctagtccatggaggtttctttcaacacaagggtggaaatgtgtcccaattttggagaggtcttcttaatatcaagaggtggatgagttttggctctgaatgggttttgggtaatggtgagagtatcagcttctggcaggatgtctggtggggcacctgtcctttaaaaactcttttccctgctatctttaggatctgtaatcagcaagagctgttactcagccatctcaatcaggagggtcctgactgccttacattcaggagatcctttggcccggaagaaatcctagagtggggagacctgaaagaaattatcgaacaaattgaggtttctgattcacatgataagttggtgtgggacgaggaaggtgaggcaggagagcaacgggccgggaaagttcaagttggtcctcggcgtcgacacggatgccgacggccgccacccctaccgctgccagtcggatgcctcaaggtgcgcacgacacctgggctcgctgtcggtgccgctgctgagttggttgctgatatgtggggcccgtgtggttccaacgttgacttagcatagctgaccgagtacacgtcaaacaaaactaggaaacatattgtcttgggataaaagttgacacggttttgtgagttaagagatgagctatacctggtatcgtggtttaggaacaaatttcagactaagcaacaacttaatggacctaaagtgaacttagaaaacagcgtggaatacaatgaggccacatgcggcctattgggccactggctacaaggcaggcttaagcatactgtctgttcaggcttggaaaaagtacacccaaggtccctcaacttgtaatcgagttacaaaattgtcccccaaccacaaaaccaaatttctggcgtcccttaactaatcaattggttctttagtggttttcaccccggttttatccccacatgtcagcctgccacgtcatctctctttcccttccctcctctctctctcactcttctcttcctcctcggttcctcctcctcctctctctctctctgcctgtaggcccggtcggcggggcgatgcgggagaggaggagggcggcgccgcggcaatggggaagcacggcggcagcccggcggagctccgcggcggccgtgcgaggcccgcgacgccggtgggggaagtgacagggggcggcgcggcggacgtggcggaagtcgttgttgcaaccgcgagcctctcctggtgcgcgcgccaccaccgcaagtcgttgttgcaaccgcgagcctcgctcggatcctcctcctcctcctcgacatggtcagcgagcaaacgccggtggcgaccgccgaggcggagctggtgagcagcgccgcggtgcccgtcaaacccgaggaggccgcggcgaaggcgcagccggaggacgatgctcccatcgtcgaggacgccaaggatgatgacgacggcgatgaagacgacgatgacgatggggatgaggatgaacacggtaacactcttcctccttcgcggtttcgtcttcgttaatattgcgatctgtccatgtgaaaggcagcgtgcagtagttttactgattagaaacgtgtcagtgcatcgtggtgtttggatttcgttaacggttttaccttcggttcttgtagcaattactaatagctagatttatagcctgatttgccgtttttgatgaccttgaattgaaggtgagcacggtgcagttgtaaacaagggctccaagcagagcaggagcgagaagaagagccgcaaggccatgatgaagctcggaatgaaacccgtcacgggagtcagcaggattaccatcgagagagccaagaatgtaagaaactgtacagctgctgcaaacaatttattcattcgaatggaagacagagttaatgtttctctgaatcccgtgtgtttcagatactgttcgtggtgtccaaacctcatgacgtcttcaagagcccgacgtcggagtcgtacgtcatattcggggaggccaagatcgaggacctgagctcccagctgcaggcgcaggcagcgcagcagttcaggatgcaagatctgagcaaggtgatgtccaagccggacgcggcggcagcagcgccggccgacgaggagcaagaggtggacgagacagggatagagccccgcgacatcgacgtcgtcatgacgcaggcctcgtcgtcgtcgccgccgccgtatcgtcgccatcgccgtcaccgtgtcatccgccgtcgtgtcgttgtcgcgtgtccttccgtgtcgtcgtcgccgccgccgcgtcgtcgccgtcgtgtcgcccgccgcctcctcctctcccgtctcaccttggtggtctcctccgccgctggccggcttgcccatagaacaaaagagaagagtgtgtgagagagagagagaggagggaagtgagagaaatatgacgtggcaggctgacatatggggcccacgtgggtcccacatttgaatcagccgtcacgtaggacaaaaccggggtgaaaaccaccgaagtacctactgtgaccggttttgattagttaagggacgccggatatctggttttgtggttgggggacaatttcggagttgctagaaatatagcgctatatgctacagtcgattttttttagccacttacacagtagttacacctcatttacaccccacttacatatgtatagtatgtaattttcgaatttatatatgtaattttagtacttacatatgtaattttgagacttacattgtaaatacactaaaattacatatgtaatttaggaacttacaatgtaaatacatgccgattattttttgatgaaaaatatggcaccgtaaatatagctacacccacaattttgtaactccataacaagttgagggaccttcggtgtactttttcctccaggcttcagatgcacatagactagttgggctactagacgattacaagtctctcaagcccaagttttaatcatcccaaaaaagggtccaagctttcacagtggcgctggatccacatatccatcaggctaagggactagctatccatcacacgacagatttttgggtccaaatcacacagattttagattagttggattaggctcatttgatcacttgattagaagagtctatacatgtatcaacatatattaattatatatattgcatatattttatttgttagatctttacattgaaaaaaatatatcaccaacccatctactaaaagttacagtgtaattacactatagttacagtgtaatttcactatagttacagtgtaactatagtgtaattacagtgcacttacatgtcatatcaactaaacttacaaatataattttagttatataggattgtaattttatattttaaaggaaataacaagtacatatttacttacacaacatttttaccaaaattatagtgcacttacatgtcatatcaactgaatttacgaatgtaattttagttatataggactgtaactttatattttatttcttcaatctcttcacctagctgcaacgacgtgcaatgtatgtactcatcaattatgtgccaagctagatgttgctggcctcatgcgtgcgtgggaaggaaacgcatcacagccgctaattaaatcatgcacagactaatccacaagggaagtaaatccgagtgatttcgtgccaaaaatttgtcgccagatttttagcaaaatcgtcaggctaatagcccgtaatatgataggcttttccgctagcgtttgttttctctgagtgtccagtgtagtttgctttggactctgaccatctcttttcagggcattgggattctttgagttgcataattggaagcttgcttttacttaagcaccacccagttccccaatctttcaacagaacaagtagcattttggaggttatcagtgtcatcaagtaaactgaagtcccttttctaccacaagtttcagaaaagctataatgcctgctggaaaggaaggaacataagattacatgttgactctacacatttggtgattatctatgtgagaggcttcaactactactaatccctagctgataactccaaatctttcctcgcctcacagggaataagaacaccgtatcaggatcaggccggcactagctgcactgcttttgattttgaacgctcgaaaggagaacagtgagccactggcagaacggcgtagcctcaccgtctgtaggcagcaactagttgccgcggtctagttgtagccttgtaggccacaagcgagctcgttgcggccgacaccggacagtgacttgactcaggaggcaataactccttcagctcaaccaaaggtggctggctgatgaactgcccgattttgaagggttcagttcaagttcctcctacttcccagccaagctgccttatccaattagccggcaggtgatgactgtcaagccagttgcattaagttatagcagacgtcctggagtgtgatggagttaggtcgaggcgatatttctattgcaagtagctcacaaggacgaatgaacgaacgaaaactaatgaaccataactgatagctccaagtctccaagttgtcaattcttgttttcaagacataaaattaagtagcttgacatcggccaccgccggtcgatacatgtcaatatccattagtatttatattcaggcattgactaagttaatgttatcttttcctttgtctctttttcttctttattattacacgttgacttccgctttacattaagtaatttacagccattggcggtgtcaacgcctcgctgatgatttagggaagctcaaggccatctttgcgtcttgcaggatacgaaaatatattttttgcaaagaggagacgctgtgcgtttccttttctttcgacctgactcgaaagcaaagtgttcgagttgcctttagcaaggttcagtataagaaagcaaaagaataattcgtaatcgatcctgcggtcaaaacgaaactggggctttcccccttttttatattacttgcaaaccttgaatgtaacctggcttatgttgattatgaaaaggagaaaccctatggggatttctcaaactgattaaaacgcttgctcgcagtacaaaccgaagtcttgtatcattttgtatttaacaattagtttcttgtgagataaacattgacacagtgcatttgtcttgtatgtaagctttgttttgtctctttacagctgctgggaacgattgctagatggtgggtgcaacgtcattccacacaggccggattctttattgtgatactttgatagcgtgggaatacttgggagttatgcctctggagtcgactccagctccctcttatctcacaggttcagagcacctgtggcatctgtgtactacatcacttccgtttattttccaatttgatcagatctaagacatacaactgacctcgtgcattgtttgtcaacctcctaacattcatgttgatggatattgatagccaaaaagcaaaaactcataaattcttccttgtaaatatagataagaccaagtaagagatagtataacaatggttgacctacttcatatttgggagctggttcaaccagaaggagctgttcttacttttttggcagactccagtagaatactgtagctagctagaatcggagctctggaagaacgggttattgtaatcatgcccagttaatgtaatcatagggtggtgaggctactcaattactagtagtacctcaagtgtagtccgtaccaaacatttgacttgctcgcattgctggtatgtgttgacttgggccgtggaccattgaatcgaacgtcgagttcggcgtcgcagcaaagcgatcgagcccctctgtctctctctctctctctctcgcagatctccagacgttcggtagttcggttcatgtgcacattgcacaagccgccttgaaaaacgcagctccctgcctcccttcaacgcgtttgcaacgtgcaggcaggcaggatctacgacgttgtgccgcaccgacgggtgtggtttggggccaacccgagatcggctcatgcagtcgcgcgctcgccgaatcaaacccggcgtccggctcgaccgggttcgcgttcgtcggcgagcttttagcttctgttgttgtctctcgtctggctcctgtgcgttcgcgaccgcgcatcaatcataccgagcaggcgcgcgtgccgcccgccggtttggcggcgaggcgggatgcgtgacgagtttttgccagttcgagcggcgctgggacgcacgcgcgcgcgggcgcggcgtgctgcgctctccgacgacgaggaggcccaccaggccaccaccaccttgtatgttgggggggcacgagaccgcaagagggaatgaaccgtgaacgtacgatgcaaaagcgagcggacaaggcggcattgcggccaggcatctcgtgctcgctgtgcggaatggaagcggaatggaaggggatgatgcatccgatctgacgcataccccaactgctagtgcactgcagtgcagggcagtgcagcgcagcgcagcgcgttgctgcatgccaggtcggtctggccctctggcccatttggccgccgacctctcccaaaaaatatgcaggcatccacctgcacgaaactgcgaggtccgattcctttattggtcggagacaagagagtgttgccagttccccccaccgattaatcccaagagcaatccggatgaacaagcaagccacagcaggtaactaggtaagctgtggcgtctaagttctaactgtaacactcagatagctggctgcttgctagtaggtgaatgcaccaactcctgaacggaattggtcacattcggaggaagagggacctgaatggccgaatacctgatctataatctgaacttgacccaaatttgatcccaccaaagtcgttacaggatttttctcaggatgttgttgggccaaagtacaaccgtagaagtcatgtactaccttacctgctcgtccgggtgggtttggtggagcaaactgccgcttaccccgaactaccataattctgttgcagactcacaaagccacaatgtcaaaccatcaggcagcagccatttatgtcccttcccccacaaaaaagacccctttaggcgcatgcgttgacccccccccccccccccgggacctggcatgtttatattgcgttgagctatagtgccttccaatgtcagccgaatcaccaaacacttggcccgctagactttgctttcgctgcgctctctctctctctcaccgtgtacgaccgacgacgggggaagaggttgttcggcaaagccgttgtacgtccaatcttgactggtgccgcggcaccgctgattaattgggcacaaccgatgaactaaaaacgggatcgcacaatcttggcccgtgctgcaaaggcgattagattagcgagcaccgcacacccgaacgccaaattttgatagctaagctcgtgtttcataccgtgatacggcacggagtactgctattttggctcttaactaatgctagctctacgcacgacctatacgactctgcagaaattaacatcttgaccgttttctaatttctaatcgtcaatttggataacacactagcacagtagcaacatctcgtgtttctcgttcacaggcacctgagaaacgcataaatgcagcgttttcccactgcaaaggcaaggaggccgtccgttgatgagccggtcgttaattagccgcgcgttcccacccacacacacacgcgaacacgcgcagtccagtagccgcgcgtgcccacgacgcaccacccacacacactttctgcccccgcccatcgccaagttgagcatccacgcacaccaaacaccttgcacatttcctaatcttaacacccccacccaattaacgccaagtcgtcttctccttcgccttcccctctccaccctttgtatataaacgcacacaagcgctcggaaagccaactcagaccgaacaaaaggatcaccagctcagagctcaccaccaccaccaccaacaacaacaacaacgcattgcaaagcaaggagaaatccgaagtccaacaacacccacaagaaaagagaagaagcggggaatggcgatcgccgtgagcgggcgctggacgcggctgcggacgctgggccgtggcgcgtcgggcgccgtggtgtcgctggcggaggacggcgcgtcgggggagctgttcgcggtcaagaccgcggccgcggcggaggcggcgatgctgaggagggagcgggggatgatgtctgggctgtcctcgccacacgtcgtgccctgcatcggcggcggcgatggccccgacgggtcatacaatctcttccttgagttcgcccccgggggatcgctcgccaacgaggttgccagggatgggggacgcctcgaggagcgcgcgatcagggtgtacgcggcggatgtcctgcgcgggctgacgtacctccacgggatgtcgctcgtacacggggatgtcaaggcggacaacatagtgatcggtgtcgacgggctcgccaagctcgccgacttcgggtgtgcgaaaaccatggattcggagcggccggtcagcggcacacctgcgttcatggcgccggaggttgcccgcggggaggagcaggggccagcggcagacgtttgggctcttggctgcacggtcatcgagatggccaccgggcgcgcgccgtggagcgacatggacgacgtcctcgccgccgtccaccggattgggtacacggacgccgtgccggaggtgccggtttggctgtccgcagaggcgaaggacttcttggccatgtgttttgcgagaaacgccggcgaccggagcaccgcggcacagctcttggagcatccgttcgtggcattcgcctgccacgaagtcaaggccgcgcagccgaagcccaggtgggtctctccgaagagcacactggacgccgcattctgggagtcggagaccgacgacgaggaggaggtcgacgagataacagagagcctctgcgataggatcaagtcattggcgtgccctgtttcggccttgccggattgggactccgacgaaggctggatcgatctgctcggcgagcagtgcgaggcttgcgattcggaagcggccagggaatcgattgatgtggcgcgtagcgcgccaagcaaagtgtccagcgcggcgacggtgccagctgctgaagtggtgcttgtcggcggcggctgctgtccaagcaatgaagcggacgctttcgatcagtcaattggtggcgatatccaagccgctgatcgttcaatcgagcgtcggaataaagtctgcgctggttcagacaatgatgtacttccatttcgattagtatgtaacggaatttgtgcaatggaattctttcagtttttcacaaatcttgctgtgctgttatgtttgattccctccgttcccactatgttttcgtcaaattgtgagctacgcccatgcctagagcaaaagctcagtccatacgcaccacgaaatatttctattcaactttattacgtaagtaaccacgcaataataaacaactaaaaaaacaactcaagaagcatagcataacctgcctgtgacaccacggcattagatcatccgttcccttccacggcatagtaaagaatcgataacacctggggtttattccgttctggaatcccaaatcccaaccaacggcttctccttctcgaccacgaaacaggcggagccgcggaggattccggtccccgaatcgacacgggggacggggagcgtcagccttcacgtacccacgtacgtcgcgtagcagtacagacgcactagtccacttgattaatctcgtggccaaaccaaaacctccgcactggggaaaaaaaccagcgaccacgagcggcgacggcgcggccgtcggctcaggctaaaaagaaaagccgtacctgcccctttcgcgcgcgaccctcccgatagcgattggccctcctgggccctagccggcccagcaccgcccatatccgcaaaccgccccccaacccccgcggccgctcagcgctgacggcttcagcttctatctcctcgccgcgacggtgcgtgcagtgcgtgcgttgacgtcaagcgtggggtctgcgtggcgccgcggccgcaccggctgacgtaacccctcgatcatcctcgccatcagcccgcattaccgcgcccccgtctagccaagcgcccgcaggcatacgtgcgcccggtcaaagcgtgggcgccataatttggcccgcgcgccggcgggtgcggctggctggctggctgccggccttgccgccccggcgattatccggccgtcacgtaccgtttgctcgcgacgcgtgtcgaggcgggagggtgggcgcgcgcgggcgcggaggcgtgcgtgactgcatggccggtgagcacgcatctatcgtgccgtgtaccaggtgtagcgtgtaaaaattttgcgcgtggtgggggcacgaaggccgcgtatcggattgggccacaggggatgaggaggaagacgcgagagctctggatggagtccacgggggaaagggcatttggggcgtacggtacggttgccaactcgtgccgcggaagagtccacggctttcggttcgcctctcccgggtggccgacttcttgccactttgtgccttctgttgctttcgagtcagctcggtttgggagagcgtacacttgagagatactggttctagatacgtccagaagatttagtttggtcaccttatggattataatggcttcttgattctagagagattcagaacattgaggctattcgactcattgattgcgaaatggagagtttggtgaagtcagcgcgcggtttgggttgtgcgagggcacaactagatactgtttgatcggtcattaggtggccctgttatcacgtggacatgtaatctctgcatctagaggatgtctggaagtgtgcaagaactccaagtctcttatggtcagctcaatgtcaaagcctgcattgctggcaccaaaatgagctataccgggtagcacgaccggtgatttggacgaactggctccagacgtaagtgtgcatgcagtgctgtccaccgaattaccacttggcttggtgatcaagcccaggctgcacactactactttgtaccaatccgtatcgatcagaggtgttctcgtagggatccagatcctctgcattggagaagctaatgcagagggtggaattagctccaatcctatccgtccatcatcatccaacagctgcagcttctttttcccttcgatactggtaccagaaacaaacaagtcctcctcaccggtgaccatagcaacgcaagcgcaatggcaatgagtccgctttggcgatctaaaccgctgcgcctcttcccttgacctatattatcaccaccatgagaagctgagagtagcaccgagctcatgattatcgaaagaaaatgaagcaacagcgcatgcaatgttcggtctctcggtgcttatccgtagtgcggttcgtgccgcaggccaaccctttaatatccagcacaacgccatgattttcgttcatccatagcttctgcagcgccggcgatgcaacatacttcacgagccagcgattcgaggaaatcgatactccctccatccataaatatttgatgccgtttactttttaaaatatatttgatcattcgtcttatttaaaaaaatttatgaaatatgcaaaactatatgtatatataaaagtatatatgtatatataaaagtacatttaacaatgaatcaaacgatagaaaaaaataataattacttaattttttttaataagacgaacggtcaaacatattagaaaaagtcaacagcgtcaaatatttagggacggagggagtaaaatggaatcaataagaaaaagcaatcgcagccattccctctcagatggatggccaggatttgacagaggatttgtggtcaccggtgaggacttttgtttctggtaccagtatcgaagagaaaaagaagctgccgccgttggatgatgatggacggataggattggagctaatgccaccatctgcattagcttctccaatgcagaggatctggatccgttctcgtagcaatctctcttgtgccagccaaatggatgaactaggaggtgcaggtcgtgtgtttattcggtactcctacagatgacaaaaccactatacgggaattcgggaaataaacaagactccgtataagcacatcaaagctgccagctctctagttcaggctcggttcaggttcccatcctctgcctttgggggagaatggcagagacacacagtgaggggagctacagtgccgtaccgttgctacagtgaaaatactgtaactaaggtaaaaaaattcaattattttttgttgttactgtagcatttaatattgtgcatccaacggcatggcgatgtagctctctgccgttccagttggaactgcagaggatgcagagccgttcaggctacacagcggcagcggttcttcagcggcgcccggaaaatcctttttctttatctcgagtagtacaactgcatgcatgtctctctacgcctacagttccgtacacttgtattttttttgttttgttcattcattatgggccgtagctctctgtccactgctttcttaaaaagaaaaaaaaaacaaggacaacaaaattctaaaagttggagatatagacagtataacgccgtccactaggataaagcaacgtgttgcacgcctccaccagggacaaaacgccaggtattctcccgttctagagctagacgcgcgaaaagaaaacggaagcagaggctatcagagcagcgctgtggccctgacacttgtcgatgcaacaactgcgacaggtaatcggcgccgagcacgtaccaaaggcagccgccaacgaatagcacaggtggcagaaggcgagctaacggatactaccactactagtcggtagtaatccctctgttactaaatatttagcgtagttaagttttttaaatatatttagttattcgtcttatttaaaaaaattaaataattattaatttttttcctattatttgatttattgttaaatatatttttatgtatacatatagttttacatattttataaaatttttaaaaaggacaaatggtcaaacatgtttagaaaagtcaacgatgttaaatatttagagacgaagggagtagcagttactactattgcggatgagtttggatatgtactactcactccgtcttaaaatgtaagtatttttagctatgaatctggatacatatagctaaaaatatttatattttaggacggagagagtattctgtatttgtatcagccggaattttaagggctgggaatgattgtattgatgcgatcgagggcacaatcacttcgctggcacgatgaggccagggaggatatgcttatcatcaggactgggttcactgattggaatgacgacttttgcttttgattgctacgcggtgctgttttttggactgatttctgtcatcagaacatgcgaatcgatcacatcggccgccttaaatcaaggcccctccagcgatgtgaatcatgtggttcttaattacagttgcttgattgcttcagataatcctgaacatctaaaaagatgcacgaccatagcacgggatactgtgccacgcggagcagcagcaaattaaaacatatcgatccttcctggccaggtcaacctaatccaatcgcatcaaaccgagcaacactaatgcttgccgccgcctgccaatctgccatagaaatgtgcaacgagccggcgcacgaactaactacttcctcagtttcaaaatgaagctattttttaagattggcacggatattaagaaagtaggtgagaataattagagtaagtgtgtgattggttgaaaagagaaa

SEQ ID NO: 19753 - DNA, 19852 bp, Oryza sativa
tcctgcagcccaacgaccgaaccgcgcactgggcgtatcctctggctccccgcgtcctcgatgagtcgctaggcaggagcagggcttctgccgatccgatcaatctcgcgacggatacgtgtacttctctgttctgctctaccgcgccacgcgcatggtttgcatggatcgcgtccgcagcgtttggcctgcatgcatattactacctccgtcccataataaatatagccgtagatatccgtgtctaacatttaactatccgtcttatttaaaaaatttataaaaaaatttaaaaaatttagtcatacataaatcactattcatgttttatcatctaatatcaataaaaatactaattataaaaaaattcaaataagacaaatggtcaaacgttgaacgtaaatagtaaatagtgtaaaactatgagccggagagagtactactacatgcatgggccaggcggtagcaagcagtggcatcggcggcgcagcttggagaggccctctctgcttgacttcacatctgttcccttcctttgggcgcgcgcccggccaggtgcctacgaatcctcgtctcccgtacttctggagtacgactcgtggcacggtttcccgcgctactaacagtgccctcttgggattttatggcaggcgtacgtggaccaataagaaggttacagtgccttgggactttcagaatagggcgtggctaatggttttcacccgcccatcccctatacgcccctttcctccttcctcctccccttcttctctcctactacaccataaatttaaaaaaaataaaaaaaacaagttagaaaaatttatgtatagaaaaactatatataaaaaatatttgaattcaaatttaaatttaaaacgggtatgtaaacttttgacttataaactttgggtttataaattaatatttgaattcaaattcaaatttgaatcgagtatgtaaacttttgccttataaattttgggtctataaactttaggtgtataaattttagatgtatagaaatactatatataaaaatatttgaattcaaatttaaatttgaatcgggtatataaacttttgacttgtaaactttgggtctctaaactttaggtgtataaactttagatgtatagaaatactatataaaaaatatttgaattcaaattcaaatttgaatcagatatataaacttttgacttataaactttgggtctctaaactttaggtgtataaaatttagatgtgtaaactttaggtacaaaaatttactaaaatcggaaagtaatacagtgacaaaaaaggaaaccatgtggaggaggggggtgattgctaggggcgatcgatcgcccgttagcctattcgttcagaatatattaagggagatgctgtttatatgaggaaaaaattagaaaaagaaacggaatcgctataaaactttgcaacatatctttcttttaaaaaatatcgattatttagtcgctggattcattccatgattcatacacgagatggaagaaatcgcactagctagtggccgcacaagaaaatgtcgtcatcgcgtgcggtctcttaagtggaccgcatacgatgtgtttgcactattgtgtgcggtctattaataggaccacacgcgataatacgtctacgcatgtgacatggttacggaaagggcataacttctattctacgacttatggaatactccctctgtcccataaaaaccaacctagtatcggatgtgacacatcctagtactacgaatttggacatatatatgtccgaattcatcgtactagaatatgtcacatccggtcctagattcgtttttttatgggacggagggagtatatagatacatcatacctttgtatgtgtgatagacttccatatacgataaggaaattgacaagagattgtggaaataatcctcacgagcaagtacgtaacagagttctactcggagaggttatgattatactatatcgtgcagggtccggggtctccgagttctactaggagactaagggattcattgtataaatatatatccccctgaggggtttagggtatcgaatcacagcactagccaacccgccaccacagaagcgatccggaggacttgaagcctactcgccggtagatctcgttgagactctctcgacaaggatctcgtcggtaattttggaatcagttgttctctattgtactatgtggatttccatatcaatctcatataaactagattagggctattacctcgcgaggggcctgaaccaatataatcctttttgtttgcttgatgtcgaatcgtatagatccttgtaccaacgtaccccaatacccatactgtgcggtatacggtatcccccgtcgatagcatgcggtccgtcaaacaacccctggggaccggtttttccatgtgcagctacttatgccctgcctaaaacctatgccccccgtgtacaggaaaatcgtctttttagtagtgtgagaggcattgataccacaccctctactttgctagtcactaagccaacgctgactttggtgtaaaatataaatttacatgctactgtcgcccatgtaaaaaaaatcactcctgggtattatgcatctaagtatggagtatatttgtactctattgtaagattactgacaacgaccgtcggtgctggatgtaaggttcaacaataagaagtcttggactctcaaaactgtcgaatgtaatataaccctatagatattcccaaataaaattatgcagctttcttcagctttatgcacctatttgatttgaaaccctactaaaatattgaaaccctactaaaatattgatagtgttaattcttgagcaagttttaacactgccaaattttttggagtgcagagttatactccttccggtatcaaaatagttgatgttttatatgtggaagcaaaatatgctaattcttgatgttttatcttgcctgtacatcttggacctgcttgccctcctgattaaggcctgtttctttcagcttgagattattataatctagattattgagtcagattactataagctagattgttataatttgtagtagaataagcggttagttgtttctttcctagattattggagcctagattattaggtttgcaagtctaaagagggagtggggtggtatggtgggtaatttttcacccaataatctggaaaaagctcacctaaatgagcttatcagattataataagctgggctccagattataataagctacttcaataagttatctgtttctttcagcttactcccaatgatctagattataataatcccaagctaaaaaaaacagggcctaactgctcgttggcttctttggttctttctacgcgttgcttgttggtcgtcagccttttacatgctctttgctcgctgccaagtactgctttcatccatggataacatactagtgatgagatggccgagcatagaggaggccgtgcttttagcaacttcttcctcgccgactgtagggttggacaaaaagctcgaaactcgtaagcttgtctcggatcgattcgaactcgtagtattaatgagtcgagtcgagctagccttttagctcgcgagctgctcgttagtataaaatatcaccatatcttcatgaacttagtatttcttgattggtgcttagtcttttaattacagcaaaactattcatatttagtgactactatattagttagtgtttattattatgttaatacataataaaatcttaaatttaaaattattaatatgatattattgagatatagctcgttaacgagcctaacgagctagctcgcgagccaagccgagctggctcgttaagacaacgagctcaaacgagccaatctggctcgttatccacctctagccgacaggtgtgatagcagcgatgatgtagcagccgttgtgtgctagagcacgcgtgagcgagccaaaaatgaccaatacaacgcaatgtaattttttttaatgctttcagcgactgcttcctcgctgacaacgagtgtgatagcggcgatgatgtagcagccgttgtatgctagagcacgcgcgagcgagccaaaaatgactaatacaacgccatgtaattttttcaccgacaacgagtgtgatagcagcgatgatgtagcagttgttgtgtgcgttgtaaattttttttatgctttcagcgactgcttcctcgccgacaacgagtgtgatagcggcgatgatgtagcagccgttgtatgctagagcacgcacgagcgagccaaaaatgactaatacaacgccatgtaatttttttaccgacagcgagtgtgatagcagcgttgatgtagcagttgttgtgtgctagagcacgcgcgagcgagccaaaaatgaccaatacaatgccatgtaatttttttttaaaaaaaatgttgccttagtaggacgccatgtaattttttttaaaaaaaatgtttccttagtaggactcgaagccggcacgtacagacgctaccaataggcccaaaccacctggaatagtgcaagtttctgattcctatttgcacaagaccgtacttaatatgagtaaaacaggaattagataccctaataaattactcttggtatgtgagattatgtctaaaacgtcaagaattttgaaactagagagagtatcaactctattgattttggaaaaattgactacaatacaaatggcttgtagtatgcaatattatcaaagtttctaaataattaaatggacgaaatttaataatagctttttcgtttccttttttcttgtatctcttggtggcttatagttgttttgctctaactgataatctctcagcactaaatattccctaagtattcactaccatatatggaatttcatgattgtctagtgtcctataaattctatcttttagattctaaactatattaaacattaattagttcaaacatattcgcttatggatttgaatatttgaaagattaatcatttagtatatttaacatgatctatataatataaaaacacaattattattattatttgttgaggagggtattactgatccaattgcgtggtataggaaaatgatgttatttttttctttctttgttttggattttttttcttaataattttgggtttaccatgtattcagttctagagtactacagcgtagacatagacgtagtatatttaaagaagataaatggatgagagtttatataatttgtaaggggaaaatagttttggaagcctctagaatctatatgtgatattctgctctagatttttttcccactaatgattcttaagcatttattttatgtggtatgaattaatgatttttcttccaaggaaggggcgctacgtggaccaatcaaaagccagcaaaagagccagctttagattagtaaattaaccatgtcctcaaatcccctgtcttatgggttgagcgagcctcttgcatttgcctatctagaaattgaccagcgttgctaggtgagaatggtttacaaggaggacctttctgccatgatattagggataatacgatatttagctcgtggttagtggtcattggtcatcctttctcttctcagatctcaacaactcgtttttgatccaatagctcaaaacaacggctgagcctgcgagatcgatcccttgtctgtagctgaccgtaagctattaatagcacttaaccaagcaacctgaacgacggattcagatcacgatcgcagaactatattgcccctcgtactatcgcatgcatgctgcattgctgcctacggataatacagttttctcacaggataaaatgtccccgagatgcggggcttcaccagaacaccgcccggagtacactcgtacgacgtacagcacgtacggcagagaagctgcgacgatgctagtgagccttcttgccccggtagaggcgggagacgcgactgctcccggcctcatcctcaatttcacctcgtgttccaattccactccgctcactcgatcgcctgctccgctacgaatagccatgttgcgaccccctctggccccccaaaccgttggtcccacatgccagagtcccgttctccccctcgcatcgcagcgtcgcacgcttttcacgccatgccgtcacggtgccttctcctcgctcctctgcttataaatagtggaagcgctccacttggagcacggccgacgagagcgcagcggcaaatatcactaaatatcacacgaaaaccaaaccaaatcgaagaaagagagatactgctgtacttggagccaagcgagagagaagactgagacgcgacacgcgaacaatggaggctgcggtcgacggcaggtggacacgcgtccgcacgctcggccgcggcgcgtccggcgccgtggtgtccctcgccgcagacgaccgctcgggcgcgctcttcgcggtcaagtcggcggcggcggcggcggcggccgagcagctcgtgcgcgaggggcgcatcctttccgggctgcgctcgccgcacgtcctcccctgccttggcttccgcgccgaagccggcggcgagtgccagctattcctcgagttcgcgcccggcggctcgctcgccgacgtggtggcgaggagtggcgggcggctcgacgagtgcgccatccgcgcgtacgcggcggacgtggcgaggggcctggcgtacctccacgggatgtcgctcgtgcacggcgacgtcaaggggaggaacgtggtggtcggcgccgacggccgggccaagatcgcggatttcgggtgcgccaggacggtgggctccgacaggccaatcggcggcacgccggcgttcatggcgccagaggtggcgcgcggggaagagcaggagccggccgccgatgtctgggccctgggctgcaccgtcatcgagatggccaccggccgcgctccgtggagcgacatggaagacatcctctcggcggtgcgccggattggctacacggacgccgtgccggaggtgcccgagtggctgtccgcagaggcgaaggacttcttggcccgctgcttcgcgagaaacccacgcgagcggtggacatcgtcgcagctcctggagcacccgttcctggcatcggcaggctgcagcgtgaaaacaggggaggcggcgccccaatgggtgtcccccaagagcacgctggatgtggcgttctgggagtcggacacggacgacgaggaggacgacatgccagcgagccccgccgagaggatcaaagcattggcttgcccctgctcggccttgccggattgggactccgacgagggctggatccaagtgctcaacgagtccagcgaagcttgcgacacggcagtggccaaggtggaggccgaagggaaggggcgcgttctgatcgaagcgttgaaacgatcaacgaatcttccggtggcgatgcagagtgtgttgatcccgagggcactgtacgattgattactgttgcttccattgggcagcaggaagtgttctgcttgggtctcattaatgacccacttgtattttctgttaataaaagtgaattaacaaagtctttgtttccccaaattgtctcattttaattcttgcttctactcattttcttccactagtatatgcaatttgcaccatctgaccaagttcgcaactgctgaaccgatgtgccatgatgattccagaaacatggttctagactcaagaacagcaaatgcaagaatctgtgatcaggaatgaccggcagtatatcctccatggggccattgtaaaggcagcgactagatcataccagcaaaggctagagaaaacaccacatctgagaaatctgggtccttttttgccttggtctgaagtctgaactgctcacattcatcgcatattcctcactactatctactctactactgttgttgagataaggatgcacatgtagaataacatctcccaatccaaattgcctctgaagagtcgggagtgaaacagcgatcgggtcaactgggggtctcgtgacactggatagttagcaaagctactgcaattaggagcggcgcgattggtccggagtcggacgtgttgcgatgcgaactgatcgtctcagagtgaattccaagtggcaatgtttgatcttctctcaagcagagtagaccaagttgacgtacacgtttgatatttggcacacgtggtaggggagatggggagaggtgtccaggagcttgtctaaatccacaatattagctcaccgcgacacgtgtcctggtaggctcttccgtgaaacttcagtgcgcgtttctagatgtttactgtacacttgctgccctgccagtcatccggagttctgaaattcgctagaagtagtcgagaacatattctcagaagtagtaacttatgttccagaaaaaagaaagaagtttggaaaggtgacttacggggatacagtagtttcttaatctcttctactctgcattaagtgccggataataccgtgctgcatttctgaattatgaattccttgccgtttacggaatgaaaatagctgttaattgtgcagttagctgctgttagagtggattgaagtcatcatatacagcagtgaaagaatttggtcgccaacacgacatctgaaaaccgccagcaaccttgccgtgcgtcaaccaccttcacatttcaattccctcgcgaccgcttcatcgccgctggttcttgaggagcaagaggggaaaagtgtgggggggcgtagactagttctgttaattatcttaggagggtttgttccaaaaagaaaagaaaaataaaatcttaggagggcaggggcaccaaactgtgtaggtaggtggcgtccaggtcaacttttcaatgcagagaagccatctttgtgcttaacgaagattttgggcaataattagctagtcatcaagaaggaagttgggcaacaagaatctcgtgcatatgtaacccgtggtgatggccacatcacgttgcttgcgtcatctctggatttcagttgggggctctggatcaatagtgttttaggatatcctgtactggctgtaacaactaacaagtgtgcatactgaattgagagtgggatataccccgcaaaaaaaagagaaagaattgagagtgtatatactagtatggctgtgattatacagtggtgtctgcaagtgccaatgtgccatgctgggttggtacatgttggttttttttttttcatgaacctgggtctctttaacaatctgagacaagttggtgtgagttaataatattctcatgttgtgagttaataatattctctgtgtgcgatgagatgatatagggctgtccttgagacaagttggtgtgattctgactgctattgtagttgtgttcagtgggcatatccagcaagggggtgaatggttcaaaaaaaaaagagcaagggggtgaaaaaaaatggtgtgtttctgagtagtacaactgtagttgagttcagtgccataccctgcagcaagaggggagggaaggggaaaaaaaatctaggcacgagatcattggacgatggcgacgcgcaacagtgaaacgtgccagtagggcatatggtgcgtgcgcggcgtgaaccgtgatgcgtcggcccgtcggtgacgcgcgcacctggtccagcgccggcgccaagataagtctcgagatcaagaattccgagagaacctttccttcctgatcagcagccagccgcccggccacttccgggcgaattcatgcacagcccggagataattacagatgcgcggcgttgcacgcaatactactactccactaccaatcatgcgtgcgaaacagtataggtgcatgcaccgtgcgtgcgcgatactattcagaaggtaggggataaacttggcagccgggggtgggtgaacagagtggtagaaatctattgccagccagacaaaacaaacgccggggccactgtcgttttggcgtgccgaattgttgcatactccggtcaccctttgcaagcagcacaccacgttagtgcttacgcctctcctctgcaagctgcgaagcaaaagaaagccaaacaaagtgaaagtaatgtaaaagaagccggtgcggttaatctttctctgaaacggatcatgacgacgattcagagtttagattattccccatgggacgtttgccttgtcccggtggtgcaccaaccacaagtccgcaagcaagatagatagatagaccatagatatgccgttcgcccgttcctgtaccggataagtcttcttgtgttgtgtaatgtgtctgtgttaggtcagtactaatttctactcaggtatgaaacgtgaccacggtttggtgcaggtaaattcggtcacgaggccagtatatatttggatttttcagtgaagccatccgagaatgactttcgctgcatggagttcaacaattcaaccaacatgtgttagttgacagtattttttttacaccattggaagatttcacggtcagtgccaatgatacccattacccaagaggcttataatagtcaagcagagcatatgctactctattctgagctcgctggaccaaacggtaggtgagggccaggcacgtttgatttgttcagaaagtcaaaacatgtgccggaatcgcatttgcatcgttgcatggccgaactgttcgggctggagagagagagagagagaggagcagttcagcctaactacacatgccgcgcaaaacatggtgcgaaccgagccacacctacagggagatctagcgaagggtacccaatcgaaccaaagagatccgagcgaaacaaactcattttctaatcgtggtggcctaacaagtcgggcagatttgctgttggtgctactcagatatgtgcagtatcgatctcacatagtcacatcccgtgaacagcctggctgtctcttgttggtgtttgtacgtctgatcagtcgatcgaatcacatgccgctgataagcacatgcgactggatcatcagggagaggagggataggttgatctcatggctcgtgatgagctggtagctagcgcctaactgtgaagcgggcacgcgtgatgtaatgcattgtgagacaattgcatctccacacgacgcgagatcgcgtgctcttccctctcttttgtggctgtggctagatcacgcgagcaaattccacgtttatttcccgtgtttgcgcgatgtgctacggactgctcgttgggtttcaagagaacttttaggcgagatccatcagtagtcgtacgagtagcacgtacataacctaatcgcaatgcactgcctaacttgcaggaccgcacctacatgttgatatatgttgaaggacatcttgatagcgatcaatcagcatgtggttgccaattgaacaccaatatctagatcacttccaaaggttcgatcaatccagctcgaatgtggcaatcttgagctcagattccactggtgtttttgcaatgctgtgagccggtgggcatcaagcccctaaaagaacagaggaagatgaacagggcctgttcacagtgcctcgctatccatccaaaaaggtaaacagcagagttagctttgacctctcctctcctaaagtggatcatcgatatctttttattaaaaaagaaattccacacaaaaaggagagaggaagtacgatatgacgtcctcgtgggcctaaagtgacgtcatagtgacgcgcagtaaaacggcatgcttttctccgtacggctcaacaacgggtttagtgaaatcgccgggtgtaatcacacgtgattaagtcgcaatccagtattccgtacgcaaaactgcttgcagaacagacctgccaactttactagaaggggatggattgccgttcgctaacgactccgatcctgatcgctggaaacatgagctaattttgacatattcataattcatgtctcgctcgaactaattttggtctcgaactgtcacgtgattgatttgcaaagtagtaaaggagacgtaatgaaaagttaaatgcaccaactggttggtcacaacgagaggaaatttgagcggaatttaattttattactctgttcctgttacaaacacaatcgaatctcactgattcagtcccgtcagtatcgaacgggtgaaaaatttcatttttaccactgccaagatgtacgtgcaggtaactgccctgcctaatggaggattcgatcgcttctgcttcattgcgcgggacatggttgacgccatccgcggcgacggcgaactgctccatctctgggtcagacagttctgcccagacgaagtagtccgcgtcgctggccggcggcgtgacggcggcgaaggagacctcgtcgtgcacctcgatccatccttcgtcggagtcccagtccggcaaggccgaggcggcgcacgccaatgcaccgatcctctccgccgcgccggttggcatctcgtcgtcctcgtcgtcggtgtctgagtcccagaacgcgtcatgcagcgtgctcttgggggatgcacgttcttgcttcgccggctccggccagcggtcgagggccgcggcggaggcaacgaatgggtgttccaggagctgcgccgccgttgacctgtcggacgcgttcctctcgaagcagccatccaggaagtccttggcctccgctgacagccacccgggaacctccggcacggcgttcgtgtacccgatccggtggactgcggcaaggatgtcgtccatgtcgctccacggcgcgcggccggtggccatctcgatgatggtgcagccgagggcccagacatcggccgccggccccctggctcctccccgcgcgccacctccggcgccatgaacgccggcgtgccgccgatcggccccgccgagtccatgaccctcgcgcacccgaagtccgtgagcctcgcccggccgtcgctcccgatcacgacgttcctcgccttgacgtcgccgtgcaccagcgaattcccgtggaggtacgccagccccctcgccacgtcagcggcgtacgcccggatggccggctccgggaggcagcccccgttcctggcggcctcgtcggcgagcgacccgccgggcgcgaactcgaggaacagctggtactcgccgcccgcggcggcgcgcgatccgaggcaggggacgatgtgcggcgagcagagcccggacaggacacgcccctctcgccgcagatgcgccgcggcgccgccggcggaggccgacttgacggccatgagctcccctgagtcgtcgtcgacgcgagccacaccacggcgccggacgccccgcggcccagcgtgcgcacccgcctgagctgcttagccattgcctcgatttcttggtccttggaattcttctctctttgtttcttctttttttcttgccttgtgcgtatggagtcagtgtgtggcgtgcggtgaggagggggagaggtgtatttgtatggcccagcggagcgtgtgcaacacgtgcggaaacggctttgtgctgcgagaggagagagaaaaatagcttaggcagcgtgcgtttttggtagcctcccgcaccgcaccaccatatgccccacgcacccacactctccctcccctgcatctgcatgtctgcaaaggaaggtggaacgaagttgtagctccggttgtggtcgtgcgttttttggccttttttcgccggcgttttgtcctgcgattctccgtttgacggatcggcgtcactgccgccggccaggtgcatcggcacctgtggcccgggggcctgtgtgggtatccagccgatacgcgcagccgcacatgccctttatcgcgtgacacttgtccccgcacgtggtctgcgatctgctcgggcaaccggtaagagcaaatttaagccatcaaccagctacaattcatttataaccaatttaataactaatttataaatagttacatataaatatatagcaatggttagagacgggatgccgtccccaacaggatgctcctcctccacaacgcgattctcacccacgcgacgcggccgaaaccctaaacacgcaccaagcctcctttgcagcgccgcgtccaccccccgccgctgccgtcgcgcctgcgctgcccatccttcaccctcaacgtgcaccaggcctcctctgcggcgccgtcggctcgggcttggcctaccgtgagggcagaggtcccggcatttgtggagttactcgcaggtggagctccgagccgccacaggcaggttcgctgcggcgaacatcatgtcagagtgcggcgagaaggcgcccaaccttgtctacaggggacggtgcaggaggccagccgcgccgtcgggatgctcctcccctaataggatatctagtagaaatcacctgatacctggtaggtatcattcgatacctcgcaaatatcatgcgattcatggtagaaatcgtttgatacctgataggtatcacatgatacctcgcgagtatcaagcgatacgtggtagaaattgtctgatacctaacaggtatcacatgatacctcgcgagtatcacacgatacgtggtagaaatcgcatgatacctgataagtatcacctgaaacatgtgtagaatcgtctgatacctgataggtatcacacctgatacctactcggtatcatcccaatcgaaaacaagatctcgttatatagcagctaaatagttacacatagatatatactacactattaatatgtggtctcatatcttatactcacacaacgttttacaatccgtgttactgctgactataaatctgtagtctgtttgacttctctcttctcttatcatctccatatatacttataattgatttgcagcctgctattggacttgctctaatctcgacgtctccttttgcctcgccaacggataaggcctgcaaaaaatgattgaatcatcgtgttaccatctctctctttgctactgtttgttcgttctttcctctcatcgctcctgctagcctttatgggtgatgtccagtctaaggtactcccttcggtctgataatattagttgttttggacaatgataaagtcaaattttaaaatctttgactacaaataatttctaaaatatttatcttaaaaatatgaaaaccatatgtttagattagtcttaaaaagtactccaataaaatcatatatttattaatatttttatatatattataatagaaaatagttgttaaagttattttttgaagactgtgtctttgttcaaaatgacaagtattatcaacccggagagagtagtacatttcaacacctgaaaccgaacatataaaataaaatgaccgttttggggggataagtctggctgatctctcaacgtccttgtgcttggggtttggccggatgatcagtttagacctcttgcatctggcgtaacacttttggctggcacatgtgctgtatgatagctgtctgtcatctttgatgtgtgctctggtcgatttaagcctgaaagctcttccatcgaacccctaaacttggttttgcgaattttgtgtccctttcgccctaatgagagtacgagcaacaaggagcaatgctattccatatttccagggcgtcatccacattagatgattcaggtgatcgacacgtgtgatactctatctgtacagtttgtgctgtaccaagagccagtgtatttactgttgggttacccagactcccagagctgtaccgctgcccactttttcatgctggttattgtcttctttttcgcatgcaccccctctgtattaaaaaaaatatcttagttatctaaaaatattattttggcttaaaattttgtcaaaaaaaactgtctttttaaagttgagggtctactgacgtctttaatatgctcctctgtagtacttgatttctttttcttatcttacctatttttttagaacattatcttacatattgaaccaatagtaccacttcttcctctgtcatatccatgttataagttatatgccaaatccgttatattttagaaccgttggattatttgtttattaccctctctttgcaggctacactaaattaattacacatgcatatgcgtattttacagttgagaaagatagtggcacatgtcaccttcaattcactagtgctctcagcctctcctcaccttgccaatcattcatgcttttggggaaggcttccatctcgattttaatatcagtaaccgactgtttgcgcttgcggttattagctcaaacaaaaacttgactactccaggtttccaataccaaccatttcttgcaacgaagattcctttggatcttctttctcaacttgagatctttttatgcgtgtgcttataaactttgcctctgctcaacaactacaatagccgacggcgcccaaagacttcctccggaagatgaacctcgccctgtatacggtcgacttgaacgtggaaattctatgttgtggtattactagatttatgcatattcgacatctatgtgcaattttaaaatctgactcgatcacatctttaattttaaaactacaaactactatgtttgaacaatgtttttccattcacttgttgaaactactaacttttgttccttaaaaaaaactaaaacatgtctttcagtatgtgcttgacatttttgtgcgtataataaaattctttttttctttttatttttttggttgcaaaacaatctatttggttgttttttgtcattacaaggtaaattgtagattgggggggggggggggggttattaaaccattttcattattaagaaaatctagatgtgattattaggagattatttacggagttgggagttgagacaatttagaacatgaccaacataatccctaaatgaaacccaattcgaggtttaaaacatgctccaacaattaccctagatatatatccaaaaattggaatcccattatcctccagtcctcctttctcgctctccacaagtcaggagatactctcactcccaattttcccacggcaaaaggagagggcgacacgtggagagatcgcgcgcgtgggaggggatgggcagagcaattttttgtttatgtatatgttggtagttaggggtgggtggtggatctagtttttattattgggagttaatttaagatatctgttggaaataaaaatatatttacaccttaaaatcaaattaggaattccaaaaatagaattttagagagagtttttttgggtgtctgttaaatgatccccaaatgtaataactagctagatttcatagcacaacataaaacaccagctgcaaatggccggttctaagcttggccatcaatagcccgaaacgaaccccaatcctattttttttacttctgtagaaagaaaattcatccaacatatattatatactaaaagtccattaaacaccttagagacgcccttacatcgtcatgtggcactggtacaaatacttctaagacgtcacgggtgctctaataaattggagaagattttagaaattctatactaacaaataataagtacactcatatttaaagaaaaaaatgtacctatactaacaaaatttgatagtttgagtggtactatttacgtagtacaaatttgtgtctctactaaatcacatatagactcaaaacttccacgtagtgataccactgcatattctcaattcttgatcttccatatcttccctatgtctctcagactcttctctttgtccgtccccaatggtccccattgacgcatgtacaacacaacttggatagcttacgtaggtatcgcaggtgtgtgaatagtcgggctgaggtgagcccaatgggaggcctgcggtagcggcaaagccaattggacattttacaatgcagtcctctagggtgggactacaagaaactatgcgctagatgtgaagaattatgtcaaaatctcacttaggcaagccaatacaacgaatcagattgatgtgtctttttggagattgaattggtgtataaataaaaatctcgggaagtctgttgatagcgaagctagcatgtgtaggtttcaagggcaactgccatatcgatggtggatcagcttggacttcatatcatcggagaagattgaagcgagccaatgtgaagggcctgatgggtgtgtttacgaggaacttgagtgagcacatgagtatatctcaaggagtgtgtcaatgctcaaactagggcttcaccgcacgagagaagaaagatttggcaattgcagtctacttcactgggtgcaggatcatgtcggcattatccggttaagtggtagaaccatagaagtggtatttttacaatacatttacaataatattcaactataatgttaaagaccgtgaaaaaaagttaatatgtgctatattttgaggagggagcagtactggcagtgatttatgtttgaatccatgtgcatttttgttgtttggaagattgaaatccttcctcttttttctatgcttgtagaaaggcaatttctaaactttgtcattcagaagattcaactcctttctctttttttcccgatgcttatagcaaggtaatttgtaataaaagttcatgagctattttagttttacagtgttgttcttatagaaaaataaataagtgtcgtgtgcatttgcacgggtttgcttactagttgcccttatactggacttcttgttatctattttttgtgggaatgtgcttgctaccaattcttaatagcacggaaggaggggtgcgagatcacgagagaggagtcgcgaaaacacaggaggaggggagagatttgaggtggccctattttttagggtgttaagtttaggatatcttttgcaaagaagtagtatatattttatagtccataaattctgattaaagattccaaaagaaatttagtggatattattttaggccgaatgaccatgctctaaacttctaaagttttggtggaaagatgtcaactcggttaaaaattgctcattctagtcaaaacagtgagaatcagccttaaaccaattctttgaacggtttttgccggggcctttttttttaaaacggaagtttttaccgggagctcaacgctatgcaatctatgagcccttgattgcaagatgaatggtaacaacaggcaaatttgtgcagactcgaaatttattactctgttcccgttacaatgacaaccgaattttacagtgtcgctccggtggcaatcaaccgggcacaacggcatatcaccgcgaactctcacactcagttgtctgtcgtactcaatgaaaccacgcgcgcgtacagttcgcgtaacatagccatcgccgtccacgtcaacgaaatggagatcaatctccgcgtccaatgcttcctcccaccaaagaccgaaatctgcagtagtcaccaccatgggcgccggtgtttccgaaacttcagatgggtcgctttgcaagtcgatccagccatcctcggagtcccagtccggcaacgccgagcaggtgatcgccaatgcgctgatcctcttggttgcgctctgtgacatgccttcttctacttcgtcgtcttcatcagattcccagcattcggcgttcagcgtgctcttgggggacacccagccgtgcttcggcgccgtttcgtcgatgtcgctggaggcggatgcgagaaatgggtgctccagtagctgcgcggcagtggggcggtcgcttgggttccttgtgaagcatctggataggaaattcttcgcctccggggagagccattcgggaatctctggcacagcgtccgtgtacccgatccggtggacggcggagaagacgtcgtccatgtcgctccacgggacgcggcctgtggccatctcgatgatcgtg

SEQ ID NO: 19754 - DNA, 16314 bp, Oryza sativa
cgcgaactcgaggaacagctggtactccccgcccgccgcggcgcgtgacccgaggcaggggacgatgtgcggggagcagagccccgacatgacgcgcccctcgcgccgcagctgctccgccccgccctcgccggccgccgacttgaccgccagcagctcccccgacgcgtcgtccgacgcgagccacaccacggcgcccgacgcgccgcggccgagcgtgcggagccgcctgagctgcttctgcatcaccgcagccgcatccatcgatctcacttgctgtgttcgagctttcgaaggtcttggaggttatcaggtatttgtattggtggctgctgcctctgcctccacccgcgtctcgtgcaacacgtgcgggaagagagcgagcgagcgcgtcgcgtggtaatcgcgcgcgcagtaggaaggccgctcgctcgcgcccgtcaacgcctaggcgacggcttgacgagatcgcagccgctgctgcgcctgcgcccggaggattggtcaaatcctggcgccacggcgggcgcggtagatgggcaggatcaccctccgtttcggacgcgcggactgaccgaccgaccgatcgatgcgtcacggatcgtccaattggcttactcctatgcgcatattcgttcagcggttcaggtgagcacggaatctgcttcgaagattaactgcacgctaatcttgtgtccgtggtggataagcttaggctatgcgtgccgtaagtgactcctctttttcccttcacttttccctttgggatggacttcctttccccattcgtcgacttcgtttcatcgggagaaatatattcactgcaccggaaagccacgagcccacgagccatgttgtgaatataaaatcaacgtgaaaaaaaagtcgaatcatacggatgcagtgaggtaatcagctgatcaatggacgtctaatagtatagcccaccactaactccaatttatctataaccaatctaatagctcattcatacaatagttacatactacactattaatacctggtcccacctgtcatacacacactacgtcttggagttcgtgctacagcaggctacaaatctgtagcccgttgcttttctctctcctcatttatcttcttaaaatatgtttacagctggcttatagtctgctattttacctgctctacgagcaagtttaatagtatagcccactactagccgagaaggctattgggcgatcagtcgcgcgcgctcctctccgcgcgacgcgtgactggacacgtgtcgcgtgtggagagagggcggcggacgcaccgcgcgggagactgacttttccctttttttttctttttccatgttttccgtttctgttcggttggctgtttttttcccttgttttggtttctgttcagattggttttccttttttttttcggtttctcttctgtttttttttttcggttttttagatgtatgaatacaaagtttgtattcgtaagtatgcaaagtttgtatacacgtatgcaaagtttgtataagtgtatgcaaactttgtatacgtgatgcaatttcttgtttttttatttttttaatacgtatgtatataaagtttatatatatcgtatacaaagttcgtatacatcgtatacaaagtttgtatatgtcctatataaactttgtatacatcatatataaactttgtatatgtatatatatttttatgcaataaaaaatattcatatatatatatatacacgtatatacgtgtgtgtatatatagtatatacataagtataatatatacagagaagagaagagactagaggggggcgactaaccgtgcgcgcgcggatgatcgcgtatcagcgccctccactactagctctaaatcatctatagccaatgtaatagccaattcatacaatagttccttactatactattaatactggtcccacctgtcatacacacattacattttgtagttcgttctgcagctggctacagaattgtagcccgctgctcttctctctcttcttttatctctttaaaatatatttataactggcttatagcctgctattgtatctgctctaacaacagcagccagcagccggaggcaggagcccggcagttgaccaagcgttactgcacttggccccctgctctactgcggtctcacttggctgttggaatttccaaagggacccgttccctacgagaggtctctcaggtcaaccactacacaaaaagctatccaaaatcaaggccgtttcacccgcccttccttcttctcgctgacaaaaaaatgtacgaaagttctagtatgtcattttcgccccgtgcatatctccttgcgtctgctgaaacaggcaataaaaatatgttgacaattctattgctaccatcgtaccaaccatatcgctgtcgctctccaaggttcacacttgcgcctaaaaaagattcattggatactttggattggtacttcgtcaactcatgcacctctctcattcctccagcacgtaaacatttgcctgtctgttgaagagtcatatcgcgcttcattctctcataaaaaaacgtttttgagctgcatgtcgacgatatgagtccgttaaaatatctgcagcactggaataaaagacgcaaaaccattccaagattcaaaatcggatagggttcccgtgattaatcatttcataggcaacctgttgaatttaaaaaccagacacggttttcttatggcgaactgctcttccagttgcagctttgactgtgcacttggtacctaggcggttaagccacctaattaacaccctcgatttttttctccgggccggtgaaatgtcaaccagtctgaaacatgtgggtgtactataccattcatatctctcttgtgttgaatatttgtggccaattgaccgtgcatccctctcttttccaccccaaaaaaaaatcattgttgctcatcctcccaaaaagttgggtaatatcccagatcgatctacagcttagaacgcacaaggaatttgtggacacatgctagtgtggaaatcctaaaaaggaacgtgcgttcccatttcaattttgtgcagttgtgccatccggaaatgactataggtggactggactataaatctggaacatgcttaactgtgagcgtgctctaaacatacaatacgaaatgggacggaaggaaccgacgctgtaatcctcttgacgatgctctgaaaaaatcggcctggatatggtgtattggtatcggatttgttttccacagcacatcagcacgctgtgcttgacctgggagaagggaaaaaaaaacgcatttccatcttctaaaaaaagaagaaaaaagagtgcatttgcgtactgcttgcggcgccttggattgcctacctggggtcacagttttccgttgttatgcctgccatgaacatttttaagccatccacatgacattattggcatagacatctagaaatctagaatggatatatgagtgttatcttttgggagagaatggatgtatgattgcatatgtatgcccctttgaatgataggaatggaaaaacaaaggaaaaaacatatgattttgatagaaatacaaatgtaaaacagagaattacaaaacatagaaaaaaacataggaataactgtttaattgaactaaaaaatgtaggaatcagatgagagagatagtatcggaggaaattttccaagaagttgaaactcttactaagttttcttcaaaatctctatgggattatcagttccatagaaatttttgaaggataaaatattatttaatcttttattttaaaggttttcataggaaaattttcgataagattgaaatcctctaaaatttctatatttttcttataaattaaagtggtgctcaatcatttggttgctttccctaatgacgtactgatacttcatctaggggtgtacgacagatgtagtggaagatggatgacgaaacccaaaaccacgaacgcagtggtaaccagccgttgggcattctgtttccatttaccactaccaaagtatcatcaagtgccagtttaatactcctaacatcgacgccggagcgtcatacatgcatgagatcatgtcatattgtcattcttaagcgtgtcggtgtgtgcatgcaccgtgccgtaatgtaactccagagttgacattctactcacacggtcacaccgtggacgccctccggaacaagagcttgcaaacaaccggtggtcaatcaacgggcgacacgctgttactctgctagtaccggagccatcacggtgatgccgccgccatcaccagaaaattggcgggtcacaactcacgaccacgaaggcaggcgaaaagcgccagcatatccgcatttgtgccgccgaggtaagatcgcatcatgccatgcggatgtaaagcaagatggatgatggtgatactcactcaaaaccgcggacatgtgcgatgacgcagtggtaagtggtaaccagcggcagtttctgcgaatgcctgaattctgttactgtctgttcgttgccacttgccagttcattatcttccatcagaatattatatatactgacatactgtacattgtagagtgatatgtgacaatgtgcggggcacgcgccgatttggataatgaggagcttcggagatttgtcgattctccacgctgtggacacgccctaagaaaagattctggaaacaaacagagaacagccaatgggcaatttaccatcaacagagtagaactctgcatctggagccatcatcagcccatcagacttgcgtgcgcggtgacgccggtgccagtcacgtcacgtagacgacaaggcggcggcaggtgaggtgagcgccacgagggctgagggcagttgctccgcagtccatgctgcatccggcggccgtcccacgcctccaaattcgctttcgtttttaggccgcggccgcgccgacgagcgagcgagcgagtggcagcatgcgatgctgcctactcatgggacccccacggcggcggcggcgcgcgtggccgccgtccgtgccgggatttctcgaagattcgccgggaccggtcggtggaacgtggtggaatccctcatcccgcggtcgcggcccttcgttttccgctcgtcgcgagtcgagaagcgcatgggtgcgcagggttaggagggggcccgcttggtttgttttccccttcggacgctgcagcctatgggccgcgctaaacggcgctaatttgtcagccgctttctgtgaggaataagtttactttgggtccctcaagctgtcgaccagtctgattttcgtctttagtccagaaaaccggatgcgacacgtccccgaacttacaaaaccatgcaaatgagatccctaggcagtattgaccccggttttcgctgacatgacgcctacatggatcctttgactaggtctttgtcccacatggcatcgacgtgatgcttaagtagcaattctattccgaaaaataatgaaaaccatatgatccgcgtgtcagttaaacaacaaaataataaaaaatggtgggcccatgcgaccccacatgtcatccttactcccatcttctctctatcctctctcgctcccacctgggcggagcaaggcgaagcaggcgatgggtgggcgtggagtggggttggtggcatccggagtaggtcggccaagggagacggtggatgtactacacccgagctcaaggaggagcagggcgaggccggcgtccatccccatgcagtttgccaggtcagagccagagatggagacgaagatgaaggggggaagattgagagggaggtggcagcgagggggttcctggcgacgaggatggtgtgggaggtgcgcgtggtggaggcggaggcggagaaggtggcgaggaaggtggaggccgaggcgaaggcgctgaggcggaacgtgaggaggaggatcatgtcgtcagcgaggttctcatgcggctgctgctctggctcaacgcggtctacggcgcaatggagtcctcgcgctgcaggacaccatcgatgcccttgagcacatgttggtggcacccgtggttgccaacgacgccggcaagccgtcgacatggagtagcggcgactggagcatgccggcataggcaaggggttcagcttcataacctccgccggtgacgtcgaaccccctggtggcatcgaaccacttcaccatccccttcaccctctttggcggtcggcgggggagaggagaggaacatgcgtagcgatcagcgggagagagagaggagaggagcgtgcgtggtgtggtggtcagcagcagagaggacaggagcgtacgcggtgcatcgatcgacgagagagaggagaggaatgtgggcagcaacgggagagagagcgtcgcgtgacgtccagtgggagagaggagaagagcgtgggcaatgcagcagcgggggagagagcgccgtgaagctcaccgatctccccgcctctccctctttgagaagtagataaggtagatgtggggtcaagtactttaaatttattttgtttgactgacatgtgggttcctcatattttgtttatttctttaacttttcaattttgctcttttttttttcgatcaaactgccacgtaagtgttatgtcaatgccacgtgggacaaagaccaagtcaaatgagccacataggcgccacgtcatccaaaaccggtgacaatactgccgagggatcttatttgcaccggttttataagttggaggatgggttgtatctggtttttgggggttcaaggacgaatgtcagactaggcgacaacttgagggagctagaatgaacttattcctttctgtgaaggcgacggatccaacacggcctggtagtatctgtatatgggccgcagcgtgcaaagattgggtagcctggaatcctatgggcctcctccctctgggcttcaattaacaggacattttagtgtcgcggtgcgatcggatcgagatcatctcggtgtcatccaccagaatttcgggttcccaacaccgattgaattgcagttttgtttcgggacataataatcgttaaatggagcatccgcgaggtgagtggaatacgccttcccaattttcaggggtcaatcgaacactctgcagagctgaaaagatggctcagccgaaaaaggaaaattaaaggtccggcagtgtagacacaaagactcacacctgctgccgttcgagctttgagaaaaagaactgaattggggccaaaaaaagcatctgctgggctttgcgagatagctaaacaaagttaattaccatgtggacctactaaccaaatttcattagcaagcagctgttctgtcgcttccgtttcaacaaggaattattggcagaagaaacgatcgatacgatgcctttcaccctgggttatgcgtatccttatctgaatatttgtttacgtttcggcatctaccagacgtgtcctcgacgcagcatccagcaatcctaacacctcgcagacattcgccgcggttcgttgggcaaagcagcggtctccggctgttaaggaataaagcgctcgttagaactgtgctgaagtgaactgaactgaaaggatacacatgtctctgcatgaaagaaaaggctgtacttttccagctagccgtcatcttaacctccagacgaacagaatctctgaaaactctagatggtctgaaaccaaacccccggaccccagccgggtacgtatgttttcttctttctttcatgccttaagcatcacgtttgtcacaaaaacttaacgtaattcggctgtccatatgcatcccatggaagcaaggaacaaaaccagctatgtcccgtcagtaaaatagttcatattatttcgcgttctctatcgatcgcgtgtatatatataaggcccggatgctaacgccgaatcggtgcgcctcctgaatcaagtagaaatagtactactacgcaagtaacgtagatcagcacgtagatagcttgcgaagacgttctgaaagagtgcagagagtttttgctagctctcggtggtgatatccatggctaacgcggggctgaagccggtggccggccttctcctggttctcaacttctgcatgtacgtcatcgtggcggcggtcggcggctgggccatcaaccacgccatccacaccggctacttcatcggtaaaactagctcacattttgatttaccgtgtcgatctcgatggtgtcttgttatcgggcacaacgaaccaaaacttgctctaaattgagattggtgcctaattatgtttgtcaatagaaagtgcatatattttgaagctagatttgtgactgtttgagcgtatgtactgcatgtacgtgtaggttccgggatggcgctgccggcgaacttctccccgatctacttcccgatggggaacgcggcgaccgggttcttcgtcatcttcgcggtgatcgccggagtcgtcggcgccgcggcggcgctcgctgggttccaccacgtccgcgcgtggagccacgagagcttgccggcggcggcctcctccgggttcatcgcatggacgctcaccctgctcgccatggggtaaattaacgcaactaaatctgaccctgtcccatgcatgcatacgggtatactaaatcaatttccttgattcatttgttacgttttcagattggccgtcaaggagattgacctgcacggcaggaacgccagattggtaagatcgaacaacatcaaacacagtttttttttttagttcgtcgtgacaaccgaagacacgctattaactgtgtgcatgctgctctggtcttgatttttgcagaaaaccatggagtccttcaccatcatactctcggcaacacagctgttttatctgctcgccattcacggcgggaggtagaagaaggtcaggtttttctgattaaagttgtgaaggtgaagacacctttgtgagcattattgggcatagatcatggactttacgagcctaatttgatttcaccggtttgtgagattaagttcgacatggatcaaccagatcgaggcgctgtttgtgcttgtctacgaatacgtgtgtgtgtgtgtgtgtgtgttttatgcagtgtgtgactagcacttcttagtaattcgtgtgccgaatactcgaactcctgtgtgatttgttgattatttggatgcgttgatttatactgtattgatttcgccgtgtctggttaatcgatttgattatgtggacgtgatggtttacctgtttgaaattcagtccgaatggctatctccgcacgacaatcgtttatcccgtgaataataggggactgctatatgacgggataccgtttggacggtatacccctgtaattcatcccgtggaaagacgtgcgtgctgcttcgtacgatggtgagcacaccacgttcatgtactcctcccaaggtatattttacttgcctagtgatctgtattatttttgtattatttttttggattattattgtattatttttttattgggccatgctctgttacgtatttatgggcactattggttgggttttttatatatgcatgtaccaatgatgatacttataggtaccgagaatggtatctgtgagatatcaatatattgatgataggtatccaaatgatacctgtcatgtatcgtgatgatacctaggaggtatcaatgagtgataacacttataggtgccgagtatgatacttgtgaggtatctgtatgttgacgataggaaccaaatgataccttccatatatcgtgatgatacctatgaggtatcagagagtgatgatacttataggtaccaagaacattacacatgaggtatcatagatatccaaatgatacctaccatgtatcatgatgatacctacgaggtatcaatgagtgatgatacttataggtgtcgaggatgatacatgtgaggtatctgtatattgacgataggaacccaaatgatacatggtatgtatcgtgatgatacctaagatgtatcagtgagtaatgatacttgtaaataccagggatgatacctttcagatagcaatgtatcgaagatttgtttttatgtacccaaatggtacctgacaggtatcgtgatgatacctatgaggtatcaatgattgatgatgattgtaggtatcagtgattaaaaatacttggaagtaaaatttcaaagttacactaaacgaaacaattgagatattaagcaaatttaactaaaaaggattaaaagaaaaaatgacgaaaaaatgcataggtggggccaacattgagtaggcagtgccatctgacagtcgtggacctcgtggtaaagcgaataaaagtcatgcatgcgcgtgtgcgtcgtacttgttgagagggatggtgcgaggaggatgatcccgttccgatcgctaccaacggaataccggtacctagcatttccgataatgtattcctaaacttttaaaattaaacacaaatgagatcctaaaacagtttggatgatggttttaactaacgtgacatccacatggttggtttaacttgatcctcgtctcgcgttatgtatcgtggtcatggccattagccgatggcaatgttgtcttcttgccttgctttcttctgcttggttagttggtcttaaacaatttagcatcattgctttgtgagatcaaagcttaagtcaaaccaatcatgtagacgttacatcagtagaaatcattatccaaaatgtcttgggaccttgtataaactgattttaaaagttaagagatcagttatatctggcattacggtttaaggtttaaggatgtgatttaaactcaactcaacctaaaataaatgtattcctttatccagcccaagacttaaaagtagtatccacatatatatatgggccctattaggggtaagtctaaatgggcttggctcaactacataagcgagttcaaccaaaagaatttttaggacgaccttatgccctgtgaacaaacaagtatactactctctatctatttttaaattataaacagctacaaatcctgtaatttggattaatattcgttcttctctggattgaactgcttccatcatgtttattattcatgttactaagatatcaaaaacatgtgatggatctaaatcatacacattattttagataaagatctaatctaattgtacggttagtacttaccaaattcatatagatgcggtcaagttacatgttcggtttattataatgtttgactccatataataaaaatgtatttcaggttctacgaattcttttttaccttatcactgttattgatagttcaagctttcaatgtctatatataacatgcaatttaactacaaccctccgttttcctcatttttaaatatatggtgaggttgatttttttatacgtccatgctaaaatattatttgcttaaattatatttattgacaaaagaaatcataaataaaaaaatatttatttatatagtttttctaataagacaaataaccgaacgttgtgttcaaaagttaagcaacacatatattcttaagcatcacaaaaatagaggtagtattatttctacaacttcatatatgtccataataattttataatagtattagacattttttttaaaaaatattgtaataacatgtgtgtacacgatatgatatcaaataatggttcaggcccctcgcatgataatagcactaatccagtttatatttgattgatatgaaaaacctcagattaaatagagaacaatcaatcccgagattaccggcgagacccttgtcaagatggtttcgacgagatctcctggcgagtaggcttcacgtcctccaaattgtaggctatgttggcggtgttgacgctatgatttgataccttggacccctcagggggtgtgtatttatactgtttattaccttaatctccaagaagaaatcggaaacaccaaatccagcacgatatagtacaatcccgattctctccgagtagtactctattattcgcttccccgtgagaattatttccataatctctgtcgattttcttatcatatatagagacgtgtcatacatatgaaggtatgccttattcataatcatgacaacatcttttatatagccaatccgcatgtatatattcttaaacgagatacattcagagaatactaaagtgttagtcaaacaataaaaagaaaaacgaatatgctactagcaccctttcagtcggcaatactccatttgtagagagaagaccaatgcacattaattaattatttaatttgtgaaactggtagtatcgtgccacgttctgagcaattaaggatcccataacgccagacattaagtcggccaacccttctcatgcaatgaaggttttgaagcatggagtagttatcatacttgtcatatcatatagatgttatatataaaaattatatatctaacagatgatgtttttaaattaaattctcatctattcatgaatcatcttttttctctctcttttttatccacatatccccttgtttcattctcgattattgtgtagagatggtttatggcatgagaaatgatttatccatctttttacttcttttctcgttagctttcttgtcgtatcaggtttttactcgtgtgacaatgtatttaatgctatgaacactatatacgagttggaaatgacctaaacctatctcacatctcaactctcagcctttaccaactttttcttagaaaaagtgttcctagtacgtaattttaaacacaacccaaccaataaacagacacttaagtccgtgtggagacattggggatgtttactttgaggcctaaatcaaccttattaaattttaaatttgctacaggacatctaaaatttgtgtaatttgccgatagacatcgtgaaaacgtgttatggctgaaagacagtaaaaaaaaaggtaatttgctggaggacacttccggctcaatcggagagaaatttttttcaaaaagacaagaatgaccctagggtcaaaagctttttgagccgagactaaagtgaaaataaaataatggtgtatgctagtgatgtactttgggctatggcaaatttagagttacataatttccaaatttttactctaacaccatgtttgaagcatgtggctagaggggcattctcgtcttttttaggaatccatctcttcaattgagccgaaagtgtcctctagcaaattaccagttttttagaatgtctttcagccatgacacgttttttcgatgtatatcagcaaattacacaaattttgggtgtcctatagcaaaatttaccattttagaaattctaaattttgacattattaatattttttgacacgacattattaatatttgattgaattgagatgtgtagattgtatttggtttgttacctttactaagtttttctttttttaaaatagattctatagttgccaaattttgatagtgtagatggtcaaaaatttggtaggttcattttggcaacagagtgaaaaaccctattttttgctactagtaatactggagaagtaatttaggcccgatttataggaaagcccataggtaatttagggcgtgttgagagaaaaggaaataaaaatattgagaagatatataaaacaagatgagacattaatatattattaattaatttttaattattaaactttaaaatggattaatatgatttttaaagtaacttttctaagatttttttgaaaaaaaaacaccgcatagcaatttgagaaggggacacgtaaaaaatgacacaaatcttctccttttcataaaaggcgaacgttgccttagagaacaattcgatagtattacaaaaatttctatgaaagcacttgaaataacttgatgggtatcttgatctttcaacatgaaaactggaggagagtcatgcaacgctgttaccatctcacttttggagaaatcatcttttgtgggttggaccaataatagtcccggtccaacaaaaaaacagggactaaaaaccatttgtagtcccggtttaaaagtgcaacgagattatatgatctttagtcctggttatatttatgtcagacgttgtcaggacgcctgggatctttagtcctggttgatatcaccaatcgggactaaatatctctctcacatcctacctcgggatgctttcccacgtccttatctctctcgagaccgagagacccacgtctttatctctcgatctctatatgttcgctagttctccctcgatcctctttctcttcactcactcactctctctctctctctagcaaaggctggccaagagaagtggtagctgggcggggtcggtggtggctgggcgggagaagcggcggcggctgagcgggagaagaagcatcggccgggcaggggaggtggcggcctcgccctccccttcgccagatccggcaggagggaggcggcggcggccgggcgggggcggcggcagtgaagtgacagcgactcgaccagaggagaatttgttttttttaggatttgtggtgaatttgtttttgagaatttgtgatgctttttttgaatttgcgatgattttttaaaaatttatgatgtatttgatctatgatttggggatgtagtgaaatcaatatgcaagcagttaaaaacaatgaaaaaaagaaaaaaaaactttagttcaggttgctaacaccaaccgagactaaaaatttgtggtcccgattatataactgggactacaggggttacgaaccgtgattgaagatactttctccagtagtgctagtgcctattgccatacgtgatcaacgtgattaattcacgattattcctcaaactaaacatgcaatgatcagaagcaccaatagtttccatcttttgtggatctccctcgatcttccatagcgcaaaattaaaaagagagtccggccgtgaaacgggacactgtttttatgatgttcattccaatgttccaaccttgataaataagacgctggagggagaacgtgtggcacttctagagcagtgcaggtgacgatcagaaggacaccgctaccccgctgactgccgacaatctatctagactcaagctagcgatgccaattgttcttctacacagacaatatgagaggtggttcaaggtgcgtctgcaacctctacttccactttgatttaggaggctacatcaacatccatggcttcgaggaaacggttagtcgtccataatttcatattagcatattcatggttttaagttaaacagttaaaagagtagattagataatctacactacttcctccgtttcacaatataagttattctactattttccacattaagttattctagtattttccacattcatattgatgttaatgaatctagatgcggaggaagtactaatttttttttttgaaattactatagaataaacattcatatagagatttttgaaggaaagttagtaatagcttcaacctcttggaaagtttttttttctatctctctcatctgatttgtgtgtttttcctgttggtgtattcaaataacaacttctacattttccttctattttaatttgcacccatgtatttttcacttacattgaaatcaaaattatgttttattatatttttatatttgtttaatcctacgtttcgaacaaaccttagttcttgccgagctaaaagcaaatcaactatagacgagtaaatgcatcttgtgcaccatcatcaaaatgtttcttaatgatgaaaatgcaacagtggatacatcatcgcttaaaagcagcgacaaatgaaaaggaacagcatcatcacaaattccatgagaacaagtttctcttctcatttctctgctgcctggtacttctcgaagtgtgtgtcaatctatgaaggctatagtatgactacttgtcttgatcatggccgtgatgcttatgctaggctgctttattagttcttgctttagagcaggtaaaatagcatgctattagccagctgtaaacatattttaatgagataaaagatgagagagaaaagcagcgggctacagatctccaagatataatgtgtgtatgataagtgggaccatatattaatagtatagtaagcaactattgtatgaattagctattagattagctatagatgaattggagctagtagtgagctatactattaaacttaaacctgctcttatgataaagtgaccttgacagaaaatatagctaattatttgtcgcgaacaaatggcctaattaacaatggtaatggaatgtttgattttgcta

SEQ ID NO: 19755 - DNA, 4424 bp, Oryza sativa
atatttttaaaagagaactatcaacggaatcttgtactcagatatttttaaaagataacatactgtaaaataatgccagattcaaatactcagatctttttgatcggcaagttggtttttgtccagtttcgctgagactatcaagttgaacatgctcaaacagttgatgacaaaagcatcgagtcatcatgctatgactacttcttggcgcttcaagggttcaaaagtggttttcagaacacattcgacagacaaagcaaattcacttcaaatttgaacgaagcaaaggagaaacaatggtggtggcatcaatacttaacggtgctcctctgatctcttcgtttgattggacacccagtcctgccaagatgacaccttcatgctactacgggctgacagctgagtctctggatccagtttaccccatggatgacacacatcactgagaagtgagaagtctcatatgcctgggccacgttgaaacagacgttcgtattatctgagccatccatctgtcggcatgtgtgcaaattggtgttttccgtagcgctctgaattgtgtggctctctttgaaacagccagcatctaaacacaataatacgagtagcacaaggcaccggatcttctgcacggaagaactgttttgcctcgtcccaagttgaaatgtcatcgtccctgtcattcgagtattaatcgactgtcaatgtaggcgttagcttacgttgcagttggttgcagcgaccatttatgttgaaataaacgtgtttatgataaagtaataagggttcagaacacatttaagcaattttctttcacttttttggccctgaacaattcaatagccaatagtagagctctgctgtggttgtgcagccgcagccagcgctgagctgagcagcacctaaatttatataaacagcagataaatccacacctactccattcaaacaaagtactaaagtacaggtagtatagtacaatgttgtgagtacaagaggcgaagtccggtgaggtgccaccgtgccacatgcaggcgtggtaacctggtgtccactctgcatccccgcaaaatggaaaattcaaacacaactcgacgaaatgctatccagaccgtagatgtccctttgtttcaatgcttgctgctttctttctttcttaggggctgtttagttcgcgaaaagtaaatttttaagtatcacattgaatgtttgaccggatattggaagaagtttttggattcgaatgaaaaactaatttcataactcgtctggaaaccgcgagataaatcttttgagcctaattaaaccatcaatagcacacggggttactgtaacacttatagctaatcatggactaattatgctcaaaagattcatctcgcgatttgcaattagtttttatttatatctatatttaatgctccatgcatatgtccaaagttttgatgtgacgtttttgggaaaaaatttcgggaactaaaccaggtcttaggccttgttagttggcaaaagtttttgccctagcgtgtcacatcggatatacgaacacacatttaaagtattaaacgtagtctaataacaaaacaaaatacaaattccgctagaaaactacgagatgaattttaagccaaattaatccatcattagcaaatatttattgtagcaccatattatcaaatcatggcgtaattaggcttaaaagattcatctcgtaatttacacgtaaactgtgtaattagtttttttatctatatttgatactacatgcatatgtccaaacattcgatgtttttcttgtgggaactaaacaaccccttagttcaagggcgatgttacgaactccatcagtcccaaaataaaaaaactcaggatctgtttggctagtgactgtagtttagcacaacaaactttagacgtggcacaatttcttaggttagtatttggttgagtgccacaagttaagttaaaccatactttattagcatattggtccacatgtcatactctcattttctaggcagagtttaccatagttgtgactaacaaactgttggtcacactttgtgtgcttgtcatagttatgacaaatggagttgtggtaaagttagtctccatctaaacatccccttaatctagaagaggatgtgatttgttctagcacaacgaatttggacgatatggttgttacatccccacctaggttttgttttattatggaggaagtatagtattgtgagagtttactctggtgtatatttctttccaatcacgtactactaacccttggtatgttgatttcgtttgtttcatagggattccgggcgtgaattgtttattaaccaagaatcgaactatggctgtgttattttcccttctttttcaactcatatctctttttttccgcatgcacactttttaaattactgagcgtgcgttttttataaaagctttctatagaaaagtttatattaatttatttttcaatgtttaatacttaattaattatgcgttaatgtgtaataccatttcccgtgaggttaggtggagttttcaactccacctcccgaactcagcctgtataacggttgaatccaactatcatgaatggttccccaaataaacatcaaatttgatcccctgcattcctttcaatggtacaatttatgcttgcggtgctatgatgcgcgttgcttattttttaagtttctgtaaaaccaaaactataactgttgttctttgttttactgatcaaattatgattatatataaaatatgttattgaacttttgattatttactcgattactttatacttctaaactccaacaatattatcatttacaatatatgttaaaataaaaccaatttgccaatgctaaaatgcgtaagggcaccaatgtatatggtaaagtgatccatatagatggaacccacataaatagtttttacccatagcaatctccataatgtatatagatacaatatatcatatgtatatatatacaatatattattaggagaagagagaggagtagagatagataatataatttattttatatgggtagaccatatgtatacgggtatcttttattattttttctatatggattagttgcacaatgataataggtggctgaatgaaatattctattgcttatgaactacttttacaccacctaaaagatgttagatgttggtggactcagtgtgattatgagaatccaccacaatgccaaacaacctatatgttgtattactctccgaaacatagatgaaggtgctaaccaattcttctcatttgacatctttacttacgtacaagagcgaaggtgggaatatctcaatcatagggctcaaccatggaatataatttttttgggaaaattttaactgaaaattagtactttgctaatgcaatttttttgcggtgtgtggggctcgatcctaagctgcccccacctggctccacccatgcacttgtagaacgctagtccatctgcactactcgttcaattccaattctaaaggattgtaacaaggggttatatggagaacatcacgtaggcactaaaaaaacatttatttgagaaaaaaaactaaaatattttagagtttaaatccctagcacttatattctgttggagctataagcattctaattttgtgatttagttggttctcaacctatagttttgtgatagttttatcactaaatttatagttttatgatactcagtcttaaatatatagttttataataaatttgatgctaaatctgtaatggattatacaacaccttaaatcttcatttttttataatctattatattattaagacaactttgaaagaagacaccacgctcgctgtggaggctagaaattcctacattaatcggagaaaaagagaaaaaaagctacaccttagattataatagatccagattaaagggcatagatttatcataaaattatattattaagacagctttaaaagaaagcactacgttcaccgtggaggctagaaattcctacattaatcggagaaagagagaaaaaagctacaccattagattgtaatagatccagattaaagggcatagatttatcaagaaaaaaaaaactatgacacaaactatatccagtacgaatagaaaatatactataaaacaaactctatcgggtacatacgtacatagagtcagagtcccagtgtttggcctaggatgtctccgattcagagtgagcaagaaaaggggaaaaagcagagtccaaagcaagttcatctacactccaagttcatgcagacatatagctgccactataagaccacatgcgccgatccatcttatgcagtatattttatcaatttgtcaactaacatatgcacaataattttaggcccacattaatctcatgtgaaa

SEQ ID NO: 19756 - DNA, 1228 bp, Oryza sativa
aatgaggatgaaaatggagtcatggtaggccaaataaaacgtggcacagaagtaagggggtggagacttatctgatttttaaaatcctaaaacaacaagatgactgttttaattttttaaaagaaaaccatgtgtaaaaaaattatataattctgtaggaaagctagccgcaaaattatgcgggccatccagatagtcttattaaaatatatgtagttttgcaataaaacaataaagaagtaaaaacttagtacacatgaagtaaaagaaatatactcctcctagttaaaaatatttcacgttggcagaacttcatttttctgatgtcaaataaatttgactagaggaagtatattataagtttttttacaacgtgtttgttaaaaatatgacgctacacttttcacttgatttcaatcacttttttcctcctataattgttttctctcctatttatatgtatgcttccatctcttccatcccctcttccacgtgaaactacttttaatcataattctcttatacattgcgtattagaaaattacatataaatattgaaacttaccatacaagttttaaaatttatataataattacaatgtaattgtaggtaagttatagagtgttttttaaaaaaatgtgaagctattaaatataactacactataatttgtatttatatttttataagaaactgtctataattgcacattacataaactaaactaaaaaaacgaaattcaaagattgtgaagatgtattatagtcttatacaatcaaaatataaagataaaaaacaaaagaacttaaaaagtaaaacaaatcgttttttaacgaaaaaaatcgatataacgggctgcctatgtgctgttagtatatatcgatattttttttatcctgaaaaaaacaaccaggttgatgcgtcatcggtgtaaaaacctaaaaaaaagagccgatccccctccctccacatcgaatcaaatccatctcttttctccccttccttccttccgcctcgcctccccttcccctcctcgccgcctcgctcccctccgccgcgccgtcccgtcgaatcccgccatgccgaagggtgccaagaagcgcgccaagctcaagaagaagcagcagggggaccaccccgccggctccgatgacggcggcaacaacaacaacaacaaaaacaacgccgccgaaaacggcagcaatgactccagccgccgccgcgacg

SEQ ID NO: 19757 - DNA, 10531 bp, Oryza sativa
tcgagtgctatgccatcggtccccatgttttgaaatcgagaggtctcatttggttcattattttttcccttatgattgcaggtggcccggggacctgcagtggctgtggctgcagcaaggcagcgggcaacatggtggaattgctgtggggtatttgatgcgttctctggttcggagagatagattaaggtctgtatcgctgtatcatggtttatcttttttttttatgatgatgatgctttgtggaaagaatatatcattaccattactgttagatgtcattggggaggcttaaaataacagatattttactaaattgtttgtttcttttaattttctgtcctttgctcatgctctaggactatttcgatgtttgttaatataagcaccgggcctgatttcttttgtaggaatgaaggtggtactatagctgcgtttatgcctttttattcatgactaatgttattagcagcaagattattctatatgttttataattgcatcactttgcgcttctgtgtgctttgctgcttgttttttcaaatggctaccatatttttaacctagtcagagcaatgatgtcaggacaccctcttttccttgtttctaaaaaactgtccagttcagtctcctgatgtgcctgtagaagggagctgaagaatgttaatgactgatgacttaaggttgtgtaaggcttatcagaccatattagagaatacagttatacaattgtcaactaatctcccaaagcttcatgctattttaacctttcaatgcctttttttttttaatttgattgtcaatacattttttcttgtaaatgcttctgtaaatcattggactgtttaaggttgcaacatctagctgatcaaatagagttttcttagtgtttgcttttccttaccaagaggacagtgaactcaaaactaaaactaccttttgaaatcagatgcccagtgtcagtaaaagctaactgaacataattttgataaaactagctgtatgattacgatcaattttgatatgccacgtggacatatttttttagttttgaatatttggatatgcttgctatatgttagtcaatttgtttgcagagaatctgttagttgcttaagaaacgagatacccggtatagttatcgagtcatttcataagcagtgtttgttccaatgctgataaactaaggaaggatgcacaatggtaacactgtaactacgagaaattgaaaacacatgatttatttgatttgtctgttgtatatatgttatgcacatggaacatgatgccccaagtttacatcttagtggagaatagtcatgctatgcatatgaacatgattggagttttacatgttctaatttgttttccctgttgatttggttaaatcaagttttaatttccaaaatagctgaatgatctctcttagacttttacacgtaattatgttctgttggcaatccaacttggcatccaaagagactaaagtttaccctaccattttgctaccagcaatattgtgatgtctaccacatgaaaatacgaggatgcaccttttgtattctgaactatttctctgctctttttcccctcatctttaaaatggttacctctgttcctaataacaactattttgtacttgtggataacatggataactatcatagctggccaattccatttgagatacagtccagctgtaatgcttggtatgcttgaggttgtggataccaaacctctcaaatttgtgtaatgtcaaagtgaaattggatgacaatcgtataggaaatgactaaatcggaatttttcttgggctcagatgatttatctgagaaagtactaagagcaagtttaataatatagccaactattagctctaaaaaataacacatcatatatagctaacttaataaaccactcatacaatagttaactatagatacgtatactgcaccattattgtgcactccatatttctctcagttcttggagcacgagctgcaatctgtagcccgcctttcatctcctcttatttcttctccacataagcacaaatatgatgttgcaacatgtagagcccgcttacatcatcttattatctttgctctaatgggacaagatgtttatttactattttggtttcgtagtatttattactgagaataacatgtacttctaatcttctatgttgtcttaaaagttctcttgtttttcccacataccaggttggaacttggaagccaagaagacagtagacgcgaagttgttcaaagctgatggtaattgtaactagtctggtttatgctcatatgaatggagttgaagaatggataacatcgagctgatgtttctctctggcccatgtttctacaccgtgctgtgcaaagttacatccccttggttgtggttaatattctcgagtcgcgtagtactctgaaatctacacccttgtctattatcatctaggttatgttcatgtagcataagagttgagttgagtcgtcagcaaagaaattttgttctttctgtttcatacttatttttttttggggggggggggggtgtcatccggtttgcccccttctatggttcggtcaccttgaaaggagtaacgttgaaactatttaggtgttccattgtgtagtcttgctccgtgatagctcgcaggcacatcagactactcactatgaaaaagaaaataatgagacgtgtgggttacattcattgattctgctcacttccctgcccggtatgtgtcatcctgtcaaaatcctggcatggcatctatcgtgccattgttttcatggctccacatggtgtttgctatacgaattttatttagtaaaaccggacaatttgttcgttgaacaaaggggacggtccggaatgatagcgtctctgcagcggctacctcctaccggtgcaagaaagctacagccttgtcggcttgaacgtcacgtgcaaaaatgtagtagcagcatgaatatattagtagcatggtgatttcttattcttatacgtgtatttttgtctgaaacatggtactccagtaacatttaatgaaattaacgacgtttccttggaaattctgagcacaaaattgcatgacacgtctgcgctgagtcagtctggtggtcctaattaactcgggggccgtaatttttcattcctccatcctactagattttagcgggtcgtttttaagaggtgacatgacacagcgtgtgaaccagaatatttcgccctaatcatcagttttccagagccgtttgtggccgtgcaagcttactggtcgctggattgtttgatttgcaagagcaagtggcaaccatccaaccatccaaagctctaacagccacgagctgtgtactatagtactccgtacagcgacatggtcgattcgtgttcatggcgacgatcctggtatccagcctttcggtcacccggacgccactgaagattctttatatcatcggaaaacgatagtcctctacgtagtaaaaggactgcagtaactacggtaatttccttgctgacagaaaccctcgcaacgtgcttttcgccagcgagtggtgtaattttgcatttggcgaaattaatcactccgtggaattcagaagaaaaatacagagatcatgagatttactggagacagggattgttcattcttgcagtattaccatatgagtgaaaggagaagagggatattctcaggagcaaactcttaatgattactcaaaaatttaactggtggctgtggcgctttgtgtctctcactgaccgactcgtgctgccctttataatagccacggaattttagcacaaagaggcagacacgagaaaagggaagatacaagtgtcatcccgcatccaacaaccatggactccttgtatgatatctcctgctttgctgctggtcttgcaggtacggaacttcatttcgatctcgcacttacaattcttcttaagttcctatcgcaaaatggtctggatcgaaaagaggcttgctaatcttctgaaaatctggccgcctccttttgttttgtcgctgcaggcaacatctttgcgcttgctctcttcctgtcgccagtgtaagcacacgttcggtttggttttttcttgatcctttgattcgtagccgaagttcataactgaattttccttgtttcaggacgacgtttaagaggatcctgaaggccaaatcgaccgagcgattcgacgggctcccttacctgttctcgctgctgaattgcctcatctgcctgtggtatggacttccctgggtcgccgatggcaggctgctcgtcgctaccgtcaacggcattggagcggtgttccagctcgcctacatttgcctcttcatcttctacgcggacagcaggaagacgagggtaattcttcccatcctgcaaccaattttgtctcagaaaaatgtacttgtagactgcagtaatagattgctaatgtagtagcctagtactgtacattttcaattttgtctgatgccaatatgccatcaagaaaggaaaagatgatggataatgttttccaattcctccacagatgaagatcatagggctcttggtgctggtagtttgcgggtttgcgctagtttcacatgcgagcgtctttttctttgatcaaccgcttcggcagcagtttgtgggagctgtgagcatggcttcgctgatctccatgttcgcttctccgttagctgtcatggtacgtatgcctctcgatcaagctgagctcttgatcaatatcatctccggcatgtttaatagaactgagggatctcactaacctttgcttgctccatccatccttgtgtctacagggagttgtgattcggtcagagtctgtggagttcatgccgttctatctgtcactctctacgttcttgatgagcgccagttttgcattgtatgggttgctgctgcgagatttcttcatttatgtgagcatcatcttgtatcgctttaaatcacttcatttcttgaatcgacatgcatgtttatgagcttgatggatcttgtactgacagcttgattcttttttttttaaccattttgatttttcagttccctaatgggcttggacttatcctgggagcaatgcagctggcgctctacgcttactacagcagaaaatggagaggccaggattcatctgcaccgttgctgctcgcatgatcaaaaccggagtgaatgattgatcgatcagctggttttgccatggtttggattcttgaaagagtgggtttatggtgaattgtacagttttggctcagtcttcacatgttggtactggaagctgtacttcaaactgcattcttcaaacatgttggaaagttttgcacaccaggggggcaaatgatggattttttttaatttgattccctccttttccttgaatacttggtgtgcaaaattatttcagctatgcacattgagcctcacttcttgttatcaattatgacatgtcacatatgtataagttgcgatgatagttttgtttcgttgctgtttgtaaactgcaatattcttctcgccaaactgtgtgaacaacaaatcaatggccacgtcatatatgtacaagttgagatgataattttgttttgctgctgttggtaaactgcaatcaatggccaatgtttatgacacctagggcaagtccgagatatttggttcgtccgtgaggaaggtgtacgacatgtttgcaccatcctggctatgaatgtacacacactcttatccttataaatacacacacatatcctatccctacgagcacttccgaaatattggactgacatatcttgatattgacgaagtcatcacatgcgcatcgttgccgataggtacgccacctactactaaaataataattagccgtaaataggagcatccatatcaaatatatgatttgaatctagggttctaacataagaaacctaactagttgagctacattttgtattatgttttattgaacttgaatttcacacaaaaaaaataaaaattcatatctcctcgcacaaataaaaaacaattaagcaccatttttggacagctcaaaattttatctcaccctagaattccgatttctacaagtggaaaatagacctaatcaaatgtaaaacagtggtaaatgtaccgggccttatagatctaattaggcccaagcccatccagcgaaacacgtttcagttggcccgtaacgtggaatccatcccgttccgttctcctcctcgtcctcgtggcgttcggaccaaacggagcgcagattaaccaaccatccctgtgttcttcctcctccgcccaataagccgctaatctcgtctccgcccttagaagagatcagcccctcgcagcggatgcctgggctagcattttggttggttcgatggagtctaaatcccccagtttttaatctgtgagccgtctccctgcactctgatgtctgtttcgtctggcttttgattccattgtgattaattaggtcatgatgttagatgcaaatttgtatgtcattgcggatgataatgctgtattgaaatgcatggggattgggggttcatgcaggtagactcggacgctagctggccggcgcaaatatgtgagttcttctgatttttttttttttacgtaagaaggtagagtcagccatttcatcgatataaatgagtgtaaggtacatgaggaaggggggtggaggaaaaaaagagagaaaagagagtaaaagagagaatgtacaaaagttcaaaaagtaataattctgattcaaccgagcacctgcatgtcttcgaatttagggggaaaaactaagtgcaaactacagacatttccatctgtgcagcctacttgttatttctctgattgctgaatgcaaatgtgatttggagggcgggtgggttgatcggttcctgtgatacacagatactgctactcaagcttggtctcttttgtttatttttatgcaggtgactgtgtaaagctgacaataggatgttgacatgttgctgtttagatgacaccagatgaaactgtacaattctagacacaattgtgatgccttctttattgatctccttttgtatttgtgcgtgcatgtgtcaaactattggctaacactaatgctccatgtttaatattctcaaggcccttattactttaaagaaaggtactaaactcatcaagtatagccggagaggaaaacccaagatccgtgcgttcagactttctagcgtaagcgataagccccaagtatgtgccgattgcttgatgtcggtgataccaaatttgattatgtccctttgacctttacgtattgcaggatgaaacatctttaatttggttttctcacaaaaaggaaaagttcctcagactgtcttctgtcactaagatcattcctggacagagaactgtaagtcctccatatccttaaacaacaacagttgcaaaagagcataaacttccatcaagctggtaccttgctatcctactaatcaacttttcaccaggctgtgtttgggaggtttttacaccctgagaaggattatttatcattttccctcatatttaaaaacgggcaacgctcacttgatctggtatggtaaagataaaattatgtaattcactcaatctaagtcccaatcattagcttatgataaatacttattttttttcgattcatagcataggttgagtctatgatagcatgcactgcagaggacattcctagtatgaacttctttctattctgcaggtttgtaaggatcaagctgaagttgaagtctggttttcagcacttgaggggttaataagttcattccgcaaaaaatctttgattaacgaacacaaggatagagtatcattttctgaagtgagttatgctcgaccttcctacaggaatttctgtgcctctgtacgcaactatattcatggttcagttttgctatacagttaccattttagaaggaaaaaatgactcaagcatcgtagatatgcatataacgcacaaataccataataccgtaagttttttcgagaaaagaaatttagttcaatttataatgaaagttataggtttatacagcaaaagtaaaagtaggggttactagcttacaataatgtacatgaaacaaaagcacctaaactttaggagtgcagaccctctagacaagatggaacataaacttttccaggatgatgagtccaggctaagactgcctcagctccctaccttttgttttgctctgaacaattaactcatccaccaaaattctatgattgttactgaaaaaaatatatgtacatactaaaagcatacatcattaaaatgttactttgatcaatctagtttttagttatgtactctactccgctctgtaacatgtgggagctaggtatccactttgaatcttttatctatctagattttggttacccactcttctcctctttctatcaactaaccctgctcctcttcgagaattataagcccctatatatttaggatgtatagtatattctgagacagcaagtctttacaaatattctaatatagtgcgccttccttcttttttccaggaagtaacttattatcaagatcgccattcctatgattcaacactagatattgcttcaaatatttcacgcagttttaactcagctggttactgtggaaccaattcatttagtttcagaaaatcagatgtgggatttgatcgtctaaatatgataagaacaagtgctgcagacagtagccgggttagtatttctagtgcccttagttcttacagtcaaggttctggaacagatgacatagaatcccttggtgatgtttatgtctggggtgaagtatggactgatgtaaccccatcagatgggcacacaagctcttcatgctcaaaagtagatgttttgatccccaaacctttagaatctgatgtcgtgttagatgttaatcagatagcatgtggtacgagacatgtagctcttactaccaggcaaggagaggtgtttacgtggggtgaggaatttggtgggcgcctaggtcacggaactgatgctgatattagtcgccccaagcttgtcgagtctttatcactaaccgtagttgatcttatttcatgtggagaattccatacttgtgctgtgactacttccggtgatctattcaattggggggatggttcttacaatgtcggactgcttgggtgtggcactgaagttagctactggcttccaaagaaagtctcagggcccttagaaggtcttcaagttctatctgttgcatgtggctcatggcattctgctttgaccacatcaagtggaaaactttacacatttggtgatggaacatttggtgttcttggacatggtgaccgtgaaactttagcatacccaaaagaggtagaagccttgagtggattcaaaacgatcaaagttgcatgtggaatttggcattctgcagcaattgtggaggttactaatcagacaggtgcaaatgtgatgtctaagaagttatatacctggggtgatggagataagaaccgccttggccatggggacaaagagcctaggttagttcctaaatgtgttcaagcgcttttagagtacaattttcatcagctggcttgtggacataatatgactgttgccctagctacatctggtcgtgtgtttaccatgggtagttccagcaatggccagcttggaaatccaaaatctgatggcaagcagccttgcttagttcaagatagattggctagtgagttggttgaagagatttcatgtggagcttctcatgttacagttttgacttcaagaagtgaagtatatacatggggaatgggtgccaatggaagacttggtcatggcgatctcaaggacaggaagaagccatgtcttgttgaagcacttaaagatcggcatgtcaagagtatatcatgtggttcaaatttcacaacatgtatttgcatacataagtgggtatcaggtgcagatcaatctgtctgcacgggttgcaggcaagcatttggtttcactagaaagagacatgattgctacaactgtgggctggttcattgtcatgcttgcagttcaagaaaagtgttgaaggctgctctagcaccaactccaggcaagccacatcgtgtgtgtgattcatgctttctaaaattgaaagccgcagagaccggcagcaacaattctaacagaagaaatgctgttactcgtcgctctattgatgggagagagaagcttgagaggccagaaataaggccttccaggacaacagcaccagcggaatcagtcaagtatacagaggtaaaagctgcaagaaatgatatgagagcatcccaaatttcttccttgctacagttcaaagatcttagcttctctgctcttcaaccccggcgatgtccccagctgtaactatgtcacctgcagtacctgcactctcaacaccatctccatacacaaagaaaacaaaatcacctgcacctgcaatcccgcaattccctaaa

SEQ ID NO: 19758 - DNA, 636 bp, Oryza sativa
tcctgcagcccgattgcttggatctctgagatccaaacataccttacagataagactctacctgaggaccgcgaagggagtgaacgcgtacaacgcatttccaaacgctatgtgctggtagaagggaccctctatcggcgcgcggctaacggaatcctcctgaagtgcattcctcagaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcaggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactact

SEQ ID NO: 19759 - DNA, 658 bp, Oryza sativa
agatcgtagaactccagaacatccataaagaaagaagaaaaaggaggacccaacccgcccattgcgaaggggaggaagaagatggaccgccccgggtaatctggtgctgggcgcgcctcgcccagcatcactatctcccggccggtggcagattccggcatgaagcggcgcggcagcccagcctgcctctcgctcacaatgcgggaaggtggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcctttcctcgatggctttatacccttgccatcgctgagtccggctcctcgtttctcgtgcccactatctcgccccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgctcgccgaccgaagcgacgttaccatgtctccagacgaaacgaatctgcacgcccagattcgagcgctgctca

SEQ ID NO: 19760 - DNA, 762 bp, Oryza sativa
ctaaatggctgtagaaacagaatatcatccatgtttggaggaatgaatctaatgactatttcatgtcaccggatacctaatcatccactcttctgcagctcaatggtatagtgcatgaactgcccagcgatgcagcagaaagcttgaaagccttacaaaatcaggtgcaggcactgctgagggagcaaagaagtcatccttctgagcttctaaatcctatggatcatgatggtattcaactgtctagtggtggaaatgcattacatgatttttccaatcataggtcaggaagtacacgctacttgttcatgtcacaagatgccagttctgcaagtggctctgccatttcacttacaagtgaacccccttcccatcgtggcatggaacaccacgcaaaggttcctaacgattttgtaccgaagcatgatactcatggagaagttcaattaattgagcagtttgaacctggtgtatatgtcacacttatccagctgaaggatggtagcaaagtattcaagcgggtccggttcaggtacatctccctatccatgctgcaatctagatgttaaactgctacatcctttccatctaaaattttccgtctccttaaatttgtcggacagcaagaagaaatttgcagagaatcaggctgaagaatggtggcgggaaaaccaagagcgggtcttcaagaagaacagccattcgactgttcctcaaacaacatcaacgaaaacaggatcttctaacgaggaagaacatcac

SEQ ID NO: 19761 - DNA, 8986 bp, Oryza sativa
cccatcatttctttcacaaatcccaggccattttgggtctgtcttccagtatcggccccctgctgtttttcgatctttaattgtaaataacttttatttctcttaatagaaaaaatgcgcctgtggcgtattcctgaaaaaagtattgactatctctggtgaggcatagagtgagcctgtgaaaaaggaatgactccctgacaagcatagagtcaaattgtacttattttgaccaaaggtttttttttttttttgtctaaaatgtgtagtctggatgtttggttatatgaaaatgcatgagtatgttttttccgccggacatactcactcctgtaatttttttaaatatataccaaaagaattaagtgaccaaactgactttaaaaagtcagaaattttgatgacggggggctcttcattcgataaggccattaaactctttcagaatgaccgaattaggtgatgttatcacgaacattaggctgtgttcggtggatgacgttggaactaaaacgaaacgattcataagtgttagctatttttttttaaaaaatagattaatatgcttttttaatcaattttcttatagaaaaattttgttaaaaaaacactatttaacagtttaggaaatatatgtgtgaaaaataaaggaggtgagttaggaacgatgaccatcatacgttgcttaggttcatacatccctttgtcccataagaaacaaaactggtttgttttgagaactttcttttgtaacactgaacggcacaagtcaacacatacacatagggctccccgagtctccaagctgacaggtcacagcctcgtgaggaccactccaatctggacgctcctgacctcctccctctccatggtcgccgtgacgagctcggtgtacttggcgaagagcgcgtcgacgatctccgtcccgaagtggtgccccagcatggactcctggatggccctcaccgccatcgacaccgtccttccgtccttcctcgcgtcgccgctgccgctcaggctcgcctcgtacgcccgcgcgacctccatcctgaacgacccctgccgccgcacctcctcctcgatctcccctatcgacggcgcgtagaacggcgcgtcgtacgcgtccaccttgccctgctccaccaccccctgcgcggcgtacggccacacgcggcgtcaatgcatattgcgcgtgtcatgcacggccgaagacgctatgtgaaaacttggctcacctgtgaccccagcgcggcgaacgactcggagaggagatcccacagcagggtcgtgttcctgtccgcgtggcgctcgccctccctgccgagcatggagaccaccatccggccgccggcgacgacctcggcggcgcgtgacctgaggaacaggctgaagtctctccggaactgcctcgagtacgccgctgccacggctggagggctcgtgctcgatatgaacatcttccccttgttcacgggcccgttcgtctcatccaaaagaccgggaggaacctgagaaatgtgcattttaaaacgacatgatctagacaactgacaaggatatcatcacaaaaatcaaccgatcgaacattgcacgttcgtacgacgcgcgcatcgtacctgagagagccagtgcaggctggagaaggagcagacgaagtgcacattcttgctggggaacagcctcccgtagaaggacccggggacgccggacaggaacaccatcgggtcgtcgccggcgtcggcgtcggcgtcggccttgagcttgccggtgaactcgggaaggcgggagaagatggtgttgaagtcgttggtggggaggtcgttgaggagcaccgagaactccggcggtggcgacgacccgcggcacacctcggcgacgctcctgacgatctcctccaccatgccgagagcgttcgtccccgacgagcagccgaggtcggccagggtgaacctttccggcttgagcgacgcgtacacgtccctcgcggactccgtcacgaggctcttcacggtgtccatgctcttcttctgcaggaacaacacgggtgcgcgcgggcgtgcatgcatgcatagcgccaattagtttttccaaggattaaccaagggcgtatgccgtatgcgtagataactatatagatatggatggtgacgagccgatgtggagtgctgacctgaagcgtagagttcttggcgtaactggtctcgccgacaccttccttcatgtggaggacggcctccacgttcatggatggcgccgggtcgtcggggcactggagtgaagaagacatcgccggcagtttgctgatcaagaattcacgcaatattatgctatataatgttgcgcactggatcgatcaatcttggactgtttcaaaatgaaaaaaaaaaggaagtcatttgtgctgcgattaattggtgctgtacatgctgcgtaaaaggcccacatatcagtaacataagttagagagaaggcaaatctgaggaaactcaatccagttaattatttgggttagtttatgtggacttgaccgtaaacattttcggaggcgaacaataatatttaccttcaaaattttctaatacatgcactgcacattacttcaggacgatcgatctgatttctgatctccactccaggttgggtcaagtcgtgcactctgtccctaaaagaaaagaaagtaagaaaatgagaagtcctgcactctgcacagtactgcgtggtgaggtgattttttaagagcaccggtacacgtactaaattattcttgctaaatttttactaacaatcatatttcaacagtttgatttaggtaaatagaaattataaaaaatctagatgcactcatagcatgacacatcgatgttagtaagaatttagtaacatctgtgctagtaagaatttagtaagaaaaaagttagtatgtacgtgcagctttttcctttttaaaaaaccaaaggtgttgaggtgatatttataggcaaggcacgcaatcggaataaggaattcagtggattgcgctaccatggcgaaatgattttttccattttaaaatatttatcagtattggctactattaccgtttcaatttttatataagccttgtttagatcccaaaaaattttgaccaaaaacgtcacatcaaatatttggacacatgcatagggtattaaatgtggggaaaacaaaccaattgcacaatttgcatgtaagttgtgagacgaatcttttgagtctaattacgccatgatttgacaatatgatgctacagtaaacatttgctaattacggattaattaggcttaatcaatttgtctcgcagtttacatgcagaatatgtaatatgttttgttattagtctacgtttaatatttcaaatgtgcgcccgtatacttaaaaactttacacctaaagaactaaatacacccatagtttttaaatagtaaggttataatgaatgaaagttatgtggttatactatactctccccgatttttaatggtgcaattgacttttatacatacgtttgaccattcatttaattttcaaaaatatataattataatttattttgttgttacttggtttatcattaattgtaccttaagcatatttgtacaagattttctaaataagatggttagtcaaacatatgtttcaagtcaaaggtgttgtctattaaaaattcgaggatcacatttttatgagaattcaactcttagcataaagatttggccaaaatataaaacaccacaaaatttggaaagtaccaattaataccacatgatatttaggagtaaaaagtgaaggtaagagagttagaaagggggcaaaagtgacacattatctagttatgtggtataaatggaagtcatggtattaattggcactctctaacaaattttgtggtattatttgaatttggtgaaatccacatgctttattaatcaatttgccaatcaagtgataaaagtttgaatatggatctggcaacaagtatccaaaacaaaggtgttaattcctttttgaacaaattcactttgcatgtgttgtactgtctccggtttttaatatttgacgtaactattggactgatcattcattttatttaaaagttttataaaaatataataaatataaatcatactggaagtacctttaatgataaaacagatcataacaaaacaaataataattacatattttttataaaacaaatggtcaaatatatttttaaaagtaaaaggtactattaaatattaaaaatcgaaaggagtatgaaagtacgacccgcaaatatcaacagcttgttctacgcgccagcaaactctagtttttatgtgcttactgtgttagagattcggcttaatttaatgtattgaaagttcagttttattgcctggggtggtcgaagtaactatgccagcggacatccagatgggaagtaattctttacttttgtacatataagtattttgaaggggaaaaaaacaattccctgataggtgcacatatctctaaattttaaacaagtatatggtctcctactctcctttggtttgtcttattgtggccttggtatctcaatggttttgatacctagcttcaactgcccctggatagaaatttagacacaagctgatggtggtatacctgacaatcattacagattttcttaactattaagcatgttattgatcgaatagttttagggagatgctctgcatgttctatacgaataatacaagataccactaagattgaacactaaaatattaaggccgtgtttagtcgttttggtaaattttttgacgtatacagacacacagttgaaatattaaacgtagactaataacaaaacaaattgcagattccgcttgtaaactacgagacaaataaattaagcctaattaatccattgttattaaatgtttactgtagcaccacattgtcaaatcataacgtaattaggctcaaaagatccgtctcgcaatttacatgcaaattgtgtaattggtttttttcatccacatttaatgcttcatatatgtgtccatacatttgatgtgatggaaaagttagaagtttaaagggaaaacacagcctaagtgggttctatatgcatggccggctggccagattccctcaaacttaaaaggaatataccagagtgatgcattctgttttttcgagcagctgcgaccatactgttgtcttatttgaggcgctacctagttgctctgttctttttttaaaaaaagaaaaaatgaatcaaatcttgtcttagagcatgtacaaatagaactatctataactgctagctatagataagtcatatcacctaagtccaccattatctatttttttcatccgatgagacctgcaaaaataaaatattgtatcacctctttccacgtggcacgtgctatagctttgactaaaaatttgagagaaaattcgatctgaaaaaagggtaaaaaaattagcacacaaaaatttcctcttaagttaaaagcacaggtcaccgattttcctttgataagtagcatttccgtctcattttgagtaaatgacgttagattttatccgagtagagaaatttatcctcaggctaattaaatttgctctttgctttcatcgtcactgagccaagtgccaaagaggcggttcggcacgggagcaggcatggtggtgtgggtggtgcaggcgcattgcggactcatggcggtgacgcgtgatagtggctacggctcgggagaccgacaagtaggcttggcaaggcggcggtcggcgtgggccgcgcagcggcgcaggcacaggagcgagcatcaagcagctgtgcagttcagcacgagatcgagcaggcacgggcgcgtcgtggattcaggcgccgccgcgcggcagtggctaaacgggtacaggaggctggcagcgagtaggctcaccgaggaaaacgaagggcaaaatattctaaggatagattactctacttcagtctaacgtcgtttgttcaaaatgtaacagaagtgttatatatagaagataaatatgtacgacctgtgttttttgatggaagggaaaacttcttgtgctatctttttttaccgggttgtttttttttctatgaattgaattttctctaaatttatagctgggtacactctctcatccagaacacttgatccaaaattaatcagacactcacacaacaaattgttcatcacaaaacactaaattgacgaaatgatttcacatctatattcctacaaaaagtacaccttaaactactaaattgtataccctaaattttagtttataaatccgaagccattaaaaatgtccccttaacccaaaaccacatcaaatgtttttttcacttaggcataattacttatttgtgctaaatctcttccttgcgtactttacatgagtatttataattgagataaaccctttttgctccttaattatggtcttgtccacacatgcaagtctaaattcgagctacaaatgaagaaattaaaataataaattttatctgcattgcacaaatactattcattgtctgattttattatgtttgttttagtggttgttaatcaaatttagtctttgcatgtttgtctatatagatttatgtcatcccaattggtgttactattttttttaacatttctataactatttaaatcacatgtaaataacggctgctatagcacctagttgtagaaaattcttgtctctaccatcttcctctcccttaagcatcgtctacttctatcctggccctcctactttgcccaacactagccgcacccccctcccccaaaaaaaagaaagagaatcattggatctcaatccgatcatcaatattgattgagaatatttcacgactgatttgagcaaatagtaatagattgggaaagtgattttatccctcgagggatatcctcttgttcggtgcatgccacctaaatagtcataaaaaatatgaaataattggcaacatagattaatatgaaatatatcactccacaaacatgcaaatttaaattcaacttctacaagttgtaacaaaaataacaaatatagttgtgaatgtacgataactatttttagtttaatgtactatttttattgcaacttgtagaagttaaatttggtcatacatatttatggagtgatatatttcttattaatctatattgttaattttttttaatttttttaataactattcagatgacatgtaaacaatgaggggaggttccctgtagggataaaaatccacatctataatagattgaggaatggaagggtgagaatgattggatagtacgttgtcgacaaaacaagaatctcaattgttctcatcgactgatacctttcaaattcggcctgaagctagctgacagtggcatttatagatcgcttgggtagagcgtggtatttgataagatactgctactacttctcacagtgatgcatctccatagtcatgcagcccatggcaacagcaaatcttctctacgctgcattgcttgtgccaacggtgctgtacctcgccgtcacccggcggcgcagccgccgcttgccaccaggaccggtggggcttcctctcgttggcagcctcccattcatcgacccaaacttgcacacctacttcgctagcctcgccgcgaagcacgggcccatcctctccatccgcctcggttccaaggtggacatcgtcgtcaattccgcccagctggcccgcgaggtgctccgcgaccaggactccgtcttcgccaaccgggtcatgctggatgccggcgacgccgtctccttcggcggcgcacagaatatcgtgggcaacccgctcgggcctatgtggcgcctgctccgccgcgtctgcgtccaggagatgatgagccccgcggggctcgccagcgtgcacggcctccgtcggcgcgagttcaggtccaccctccggtacctccactccaagcccggcgagccggtggacgtcggcgcgcagatgttcctgaacaccatgaatgtgatcacgggcaccatgtgggggggaacgatcggaagcgagagcgagaggtcggcggtggggagcgagttcaggggtctcgtcgcagaggtcaccgagctcctcggaacgcccaacgtctcggacttgtttccggtgctgaagccgttcgacctgcagggtatccggaggaagatggagcggctcaggtcgcggttcgacctgttgttcaccaagatcatacagcagcggatgagatcccagcaagacgggggcgagatgacaacggacttcttggagtgcttgctcaagatggaaaaggaaggtagcgacggcaaaacaacctttaccatggacaacgtaaagggcttcctcttggtaattaattaattaattgcaactcgatttcatttctccacattagcatttcatcccgcaggttccgaaatggtctcaaaatttcaataatcagaaatcggttaatctctatatgttatatatatgcgtgaacaggagatggtggtcggcgggacggacaccacgtcgaacagtgtggaatggattatggcggagttgctgcagaaccctcaggttctgaacaaggtgcagcaagaactcgacagcatcgtgggccgggacgccgtcgtggaggagtcccacctcccgcagctccactacctccgcatggtgatcaaggagacgctccggctgcacccgccggtgcccctcttggtgccgcacagcccgagcgccgccgcgacggtcggcggataccacgtccccgagggctgccgcgtgctcatcaacgtctgggcgatccagcggaacccactggtctggaacaagccactcgatttcaacccggataggttcgccagggacggcggccacaagggggacttcaccggtagccagctggactacctcccgttcgggtccggccggaggatgtgcgccgggatggccatgggg

SEQ ID NO: 19762 - DNA, 2824 bp, Oryza sativa
aagttgctgcagggcgtgaagtttgacatgtctgagaagtttgggattgtgatgaagaaggccacaccgctggtggcaatactgacacttaggttgtttaagcctgaactttattattcgtgaggtcaccttaccttaaataattcagcttaagtagatccaggccagtgcaacaaattttataaggtgatggtgtactagcacgcagggggggatccagaaataactaataggagagataaaacaaactatacaaagctatagccccttcttttaatggatgtatgacagaaaattttagtgggggctttacgagggctctcatggtttcaacgtcagtagtgaaggctcgagatcccatagcccctatggtagatccgccaccgctagcacgtgatgtttgttgtgaaaccgctaaggcttcatatgcgggtgggcccatatgtcattttttttttgtgtatattactcttagagagataggtttgtactggctcatactaaatctttattatgtataagtaacccaaaagtcccagcgaaagtgaaaatatttattgctgtcaatcaaaacctattataatttgataccatcacgatctaatggcttaaattttattttattttaactagtatggtggcccgcgcagattgcgcggctagtatcgttatatttttttcttaaaatagcatatatagttttacattttattattaaccaatgtgtgatatttatattgtattgtatatatgtgatagttatttgtagattgtatttatgggtctattgggtgtagctaaactgcagctgcacaacagcagccgctacagtgtatggtaaagaaaatatataaataggctgtacagcacagccggttacaacagtagagtagtgttgccgaacagagcctatatactatatatatatggactctaagttcctctcataatattcctcagttttttatttcgaatttctattatttttgaactttattcctgtatgggctctagacacctctttcaacactccttttttaatttttaattttagttattttataaattgtactttatgtggactctaactctctttcaatattccctatttaaatttcagttgtttctaaattgcattttcatatgaactatagactctttttctaatatttattcattttaatttcgaattttagttatttataatttccattatttatgaattttatttctatatggactctagacatctcttctaacattttttttaatttttaattttagttatttgtaaatgtatttatatatggaatctaaacttttctttcaatattctttttttctaattcctaattctagttagttgtaaattatatttctatatcgactctagaattttttttaatattcattcattttaattccgaatttcaattatttataaatcgtattcctatatagactgtaaactcttctcccactcttccttttttttctaatttctagttttagttatttctaaattgtatttctatatgggctctaaactctacttttgatgtttcttatttttttaattctgaattttcattagttctaaattatatgcttgtagtatggactttagtctcttctttcaatattgcttatttttaattctgaattacaactatttttaggttttatttttatgtggattctatttttttctttcttctaattaatatgaaaatatctaggccatgagaatttcatctgatttttcttatttttaatttttaatttttatcatttgtaaattgtattcctatatgggcttcagacttttttcccctaatattcctttttttaattctaaatttcggttatttataaattttatttctatatggactctagaatttttttggacgcgactcccggtcgggcgtccgatcgagagggagtcaaatcggaatttattatgcaaccaaattagaattgattggaaatttcaatataattaccacgcctcgaccgaccgatctatattagctactgcatgttcagaatttcacactttcagactttcaaaccaaagttcatttagtgatgtgctcaatagtgggtaattgggctgggtcttcataggacattggtttcctaacacggtcaagtcacgattttgttgttgttttccgtttgtaacaaactcttggagtttggaatataaataatgaaagagaaccgagaaaagttgctgaaatattacgcagcaccaaaactctgtttttgcgttcgatactctgttttttttcgatttccgtcagttaattgtagcagtctgaaaaactttagaaaccaacattcagagttcagtgagagcgagtgttttaggattaggtacagaaatttccaacatatttgatgatcatgttggttactgctctatgttttagtacgcatgcacccatcttgctaaatgctaactagcgattttcttacttaaacaatcacgaatatgctaatatattccaaggttgcttccagagaagaaagtggagatggtggcgcaaggattttgagaaaggaaaaagtacgaattaccctcctaaactatcgtggtcgaccaaattacccctctgaatccgaaaaccagacattactcacccagaactttcaataccggacgaattaccccacctcggctcaatccagagcagttttgtcctacgtggcgtatacgtgacgatccagtcaacattttatatactaaaaaaatgtgggtctcacctgtcatactcctcttaccctcttcctccctctcctctctattctctctctc

SEQ ID NO: 19763 - DNA, 88031 bp, Oryza sativa
  unsure (1)..(88031): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtacttttatggagaggtgatccatttccaccattccttgcccagcttgccatcgaatccttcccaattccaacaatttccacatgattggaactcccgttcaccatcatggtgatactgttctgtctgtcaatgagagggatctcatcctctggatcctctgcaatctccaaatgccgccttttgccagagtctccatcaacaaaaccttcagccttcctttttcttggacaatcaacaccatcaagttgcttcatctttgcagcattagcaacagcagccgcacacgccgacgaatacggctcccaccattgcgcatactcaaccgtcacaccgggttcatggcgaggaagagtgaacttaacatcctgaggctccatcttgtatgttgcccaagcaacacttgaatttgagctggcacgggggacgttcccgggaacgtcctgatcgaagcccagctgccttgcgacacggtgcgggaggtagtgctcgacgcagcgcaggccgacaagctcgcaggggcgcaggcaatgcgcgaacgacaacaattccctactccgggcaatgtcccggccatgaatccagatgccaaccttgtcgagctgcaatgcgaagccactgcttccgtatggcctccactcaaactccattggtgacatgagcaccgcgtggatgtgcgctggctggagctccgttcgcgcgttgtgccaccgggcagcccatggcggtggcgcgccatggccgtcggcggtggcgtgagcagaggtcgccgccttgtcggggcgtagctccgggaagcgctcccaggcccagagctggacgacgtgcagcggcgcccaggccacgaacgggtggcgccacttggtgctggaggcgaggtggcacttgagcgcggtgaggtcgttgtagatgctggcgagcgcggcgggcgcgagcgccacgctctggccgcgcggcgagggggaagacctgcggccggaccgccttgaacggcggcgccgggagcacgtacagcgagagccacgtggccaggaacgcgccgtgctcgagcagcgattgcgcctccgcctccgtgtcttctccgtcgccgtcgccgccgtcgcgcccgaggaagtggtggagccacgtggaatacgtggagttcttacacttgctccggtgcagcgccgcccggacggcctcgagcgcggcgtcgtcgccggcgagcgtgcccggcagccgcgcggtgacgggcgcgccgagcagcggcagcccgccgagcacggccgcgtcctccagcgtcaccgtcgcctccccccacgggaaggcgaacgagctcgtcgccccacaccagaacgcggcgagctggagcaccaaccagccgtcccggcgcaccgggcacgcggcggcggtggcgagcacggcgtccaggatcccaacctcccgccacagcggctcgtgccgcggccggagcctctccacccaccgccgccacagggcggacgagcacggccacccacagaactcgacgcggtggccgtcgccaagaaccgggcccgcgcagggggcacagccggggagagcagcggcggtggcgcccgcgcgggggaggaggaagcacgccgatcgggcgacggcggcggccccggcgcgggagatgattgcggcggtggattcctcgaccagcggcgtttcctcgtcggcgggcattgcggtggtcggcggaggtgggttttggtgtggtttggggttttgagtgaagaagagtgaagaggagtgattggactggcaggagcttccttcctgcactcaagtgcgctgcagcctgcagacctgcagtagtagtcggtaagaacgtgcgaggtagtctagccgtgtttacttacaagataatttttcaaacttccaattttttcttcacatcaaggctatgtttagttcatactaaacttccccccaactcctaactttccactcctaactttccatcacatcacatcacatccaaaactttcctacacacataaactcctaacttttttctctaaactaccaacttttcccaaacttctccctaatttcaggaactaaacacatcccaaaacttttctacacacaaacttccaacttttccgtcacatcgtttcaatttcaactaaactttcaattttggtatgaactaaacacagcctttggcttaggctaagtttagtttcaaaatttttcttcaaactttcaacttttccatcacatcaaaacttttctacatacataaactttcaacttttccgtcacatcgctccaattttaaccaaactttcaattttggcgtgaactaaacacacccttatctagtattgccaaaaatttcagggtaactttgaaaccctgaattgagaaagcacgtaaatagaaaaaacataaaaatagaatgtcgtattttttggatttctataggattttgaaacatacgaaaagtctccaaactatcttatttttttaacttaaagtagtaccaggactttacctcacagtgtgattttcattaaaagcaaaaaaattacaattacaaggaaaaagaacagaaaaacaccagaaattacaaaagttgtaactaagcctgctagtggggtggcttgatttttccttgagtgaaatgggttggatgctaatttggatggtggtagttgaattcaagtgggttgatattaattttggattggagtgggttggcctatgaagaattgaggtttggactggagtggatacaggttggcctgtgaagacaatccatggactcagcccatgggttagcccccaaaagacacccaaaccctagactccactcccgaactcccgaattccgatagaaaacccttgcccgtgcagagtgcgccgcaaccgccgcgcgccgccagctccgctagccgcggcctcgagccgccaccgccacgagccgccaccactatgagccgccaccgccatgcgccgccaccgccgagcgctgctaccgtcaccggactcactcccggtctgcaaggaggagctgccgagagggaggtcgcttctactacgccgtgacccgctcgccgtcaccgccgcgcgccgccaccatctccagacttgctcccgttctgcaaggaggaggccgccgagagcccgagagggaggtcgcttcaggcttctacaaggaggaggtcgcttcaagaaaaggggaggtggcggcgggattgggtaggcgcagtcgctcggcatcctgctctccaccctcgataacctcgccatcgaccacccacgcatcgacctcgccatcgacggcgccaacgaggttttgacctttttttcacttcttttggattaattcagttccatgctgattgctgttcaggcttccattgctgctttcgacgtgggaaggtttgacttaatattaatcctattttggttgtcctgcaatcacttttacctttgctaacttccctcgcgagaaaaaaagttgtatcttcatgaagaaagtaggaaaaaaaaggaaactttccagattataaaaacttattactccctccgtttccctccgtttcacaatgtaagtcattctaatatttctcacattcatattgatgttaatgattctagacatatatatttatctagattcattaacatcaatatgaatgtgggaaatgctagaatgacttatattgtgaaatgtaggaagtagttgtcagttcttgattatgctgttagtggcatgaacttcaatgatagtcaaccatggaaaaaatttgcccccattgtactcctggatggttgggaggacaatctgccctctttttttttgtcatgcagattagcttgtagcattcgggagagtctatctttgtcattttctttttctgctgtgtagatttgcatctgaaaagtggataatttagcaagattataccatgatttgcagatattaatccctcccatatgtaatatatgtcattagtaaaaggaaacttaggcgtatgttggttcaaagcattatatatttataactagaggtttatgttggatctgaatgactatctcctaactctgttgattatcactattcttattacttttcgcacttatctctgtttatactgatattgtcatggactcatggtggcatggtgcttatcatttcactagtttttagcacaagcagtaaatgtaaatattaattctgcacaagtatattaattttctagtcttgtcaaacacaggtttattaaacatgtctatgcaaaattctgaaagttcatctgccaatagctctagccatgaattgccttcacaaacacgtaaaagagcaaaagtgtgggaacattttgagcaggagcttgtcatgatagatggccttccaaaagcacaatgcaaatattgttgattaatgttttcagcgactagaaaataaggaactagccatctcataaaccatattatttaatcttatccactagttgatggtgaagttagaaataggtttatatcaacaattaggaaaaaacctgtggaaaatttcgtgtttgatctaaaaaaactaaagagcttatgataaaatatttcatccatgctgagataccattccataaaattgaggatccctacttggatgattggatggcgtccatgcagccaacctttaaacttgtgggccgtcaatcaatccgtgacaagatttacaactattacaataggctgaaacaagaattgcatgctgaattagaaaatcttgattcgcgtgtatgcctaacatcggacatgtggacctcaaatcaaaacttaggatacatggttgtcacggcccattatgttgatgcagtattcaaaataaaaagaaaattataagtttgaagcctctgaagtattcacacactagttttgcaattgaagaagccatgatgaggtgtttgactgagtggggcttaagtagcaagctgttcaccttgactttagacaatgctagtaacaacaccgttgcttgtcaagaattagtgaaaactcttaaggatgagttggttttggaaggtaaacagtttcatgtgaggtgttgtgcacacatcttcaatttgttggttcaagatggaatgagggtgattcatgtggcaatagataagatccgtgagatcctaaagtacattgagcattcaccctcacgcattcaagcgtttaattcaattgcttctagtaaaagtcttcctccaaaatctggtttcgctcttgatgtaccaacccattggaactcgaccttcaagatgattagagaaatattgtcttacaaagctgtcttcaatagctatacctctgaaaattgtgaagttctaccaactgaccaagaatggttgcaggctgaatcaagagtgaagtgcatcagcggtccctaaacttgtgcggatgtgtcatctaggtccctaaactctcaaaatgtatttttatgtccctaaacttgtcttaggtgtcatataggtccaaacgggcaccgacccgctccatccgctgacgtggcatgccacggtagcgcctacgtatcagtggggactcacatgtcagtcatatttataatatgatatgataacaatatttacagaaagaaccttacatgttttaaacttactctaatcaaatcctgtacgtgctaatggagcggagcccacctgtcataggcacagggagaaagcagcagcagccgcagagttcgccggccggcgttccttcaagacgatgccgttgacgaacggcgattcttcggccgacacaaccacaagaagaaatgctgaggacttccttgtgatcctgttgaaggtggtctcgtcgctagaggtggccggaatcgatgccagtggtgtcgcgagcggcggtggtcttcaatacgcctgtgcatgtagagtcccagcccgatttagtgcaaaaaaatgcatgcatgcgagtctagcaggtccctgagtgctcactggaacttgattgcggcatggcgaggtctgggtaacagcggtaatggaaaagacagcccggcggtggtggataacgtcggcttcacggcgacggctcgcttgagcggtggaatgcttagagaaggtgcatgggtggttagtgaggtccctaaagagttgcatgcacgattaattagtccgtggctcaccggggagagaggaattggcgatggcactcggcgaccggagttggagaagatgacggcgatctccctcgtctgtgcacgattcttaaaatttcttgagggcttttggccatgatggtgaggcgatgactttggcgcgatggcttggcttgagatggaccatgtcgaccggaacagcgacgacgtcatggcggcggcgcctggtgcgagttccggagctctcatgggcaaggtcgcgtttccgttgctgcagtggataaaacgagatggggtcaaaaggagatttgctcggcatgatgtgggaagtttggaatgggaaagatttggcgatagagacgacttgtcggcaacagcgagcgtcatcttcttcacgattgacgacgagaatgtgggcgacggagaggcatagggctctctctcgtccgagtagttcggctccagaagaatgtagaagagaaggcgacacgtctgaggaagaaaagggaggagctcagcgttgccacgtcctggccacgcgtgatgcgtcgagcaccgccggcgtctctctttcctgctctctctctctctctcttggctcccagggcggtggagatgatgcacagagctgacatgtgggtcccaactgacccgtagcgttaccgtggacaccacgtcagcggatggagcagatcggagcccgtttggacctatatgataccaaagacaagttcggggacccaaaaatgcattttgagagtttaaggatccagatgacacacccacacaagtttaggtaccgctggtgcacttcactcctgaatcaatatgtgaatttcttaaggcttttgaagaggttactagaggtgtgtcagtgttggcagctgttaagtaccaaattaacgccgtcaatacctgcataagaccataaatataaaacatccaacatagtggtagggtttattcctaacaatttccatgagtgttggtgtatattcatatgcaggtgacaaacaacctaagttgagaagaaatatatatgaaggaggaggagaatcaaactcgtatccgaacttatggagttttggacacaaaaacccaattaaacacctccaaatgggccaaacatccataccaataaaatgaggggcccaaaatgagtgtccaggccgaaaaccggggccaacggagccagccagggttcggccgaaccctgacagaggccactggcctaggcccagtttgcgtttagtagcaaaccgctccccaatgatggttatgggcgttttcaccggtggaaaccgtcataaaatggacacttggctcatggaggatgaagatgcccattggatgccatggaggatctctacactcccaagcaaactcacactataaatacccctctcatccttcattccaacacacaccaaagcatgagctgaattacaagagactctattgtacttttttgtatactagattagggagagagtagagtagaggaagtcggagaaattccggagttgtcggtaatcctcttcttatttcttttattttgttaattacttctgttttaattgaatatcattctgagtaattaagatttattccgtgagagttacctcttagttagttttaatcaacgtacgaaacattgttcactatagtccattaaaatatagtgattgcttgagagagttataaacactaaagtagttattaactgcgcagacgtggtggctgggtagttaatttcttatgtttgcttcgtatcccaaagtaggtttgaggtaggtgtagaggtggtgacagaactcaagtacactaaagtcctctctatccaggtacgttgtagagccatatctgggagcagtgggctgaccagcgcctgaagcaccgcgttaggattaaatagaggtttttgtagatactgtctctcactagtaaatcctctctacctttagcctatcttaacttcatgtccttaatgaatctggagaagagctgacacacacgttctctgtggaaatcgataccttggaatactcctgggtgaagtgctacatcggtatcttctgtgcgcttgcggattctatctgtgactttaagaaataccaacagtcagctcataggacaccagctgcacacacattcttgccccatattctttgtatatgtcatgctttaagtgatcctgattggcaaaccagcgatgttttgacacgattggctggtcctatgcacactaagtttgcaaaatattgagatgaaaaattggcaaacaactccaatttggcacttgttattaccactgtgttagatccaagaaggaaaagagactatttagatttttttttttatgagaaagtgtctccccatgggtttaatgttgaaagtaaggtggactctattatagaggagatgaaatcatactttcgtgtatacgaaggaattgcaagaaaaaggagtgtatcctacatgtcacagtctaatgagggagtgttgtaggctcactagttttgggcaaaagaaagcttagagcatgaattcaccctcttcaagtcaaactggaaggttgcacgtactcacaagacaaagattgatacatatttagaagtgtgtgaggatgatagtgaggattttgatgttttggcatggtggaagaaaaatgccaagaagtttcctgtgttggcaattatggctcgagactttcttgcaattccacttagcactgtgccctcagagtctgctttcagcagtggaggaaggattcttggaaacacaagaagttcattgacaccagagatgctcgaggcacttgtttgtgcgaaagattagctgtataggtgctcgaggcacttgtttgtgctagactttcttacaattccacttagcaccgtgccctcagagtctgatttcagcagtggaggaaggattcttggagacacaagaagttcattcagagatgctcgaggcacttgtttgtgcgaaagattagctatataggtgctcgaggcacttgtttatgcgaaagattagctgtatagagccaaaaaacagggggattaaaggtataatatctgtcacatttgcttatttattggaccattgctgctgccttgatttaggaatattagcagttactcctagaacttttacattttagcagttatttaaaaaatgcataagtccctatgttatatgtatatgtgtgtgcttagacttgtgattgacttggtttgtctaaaggtagtacagcacctctagcttgctgcatgttgatgtttacgacaacactgtattgtaatgtgcagtgcattaattagttaacaattctataactatttgtcaagtgatggtcctctaccaggccaaatccttgcatgttttgtggtgtatatactttcagctctccttttgacaactccggttcttttgtggtgagccaactaaccattgtgaagaatatgtaatttgggtaggaggatttcttttggctaggggaagtatgtaattggcattatcaatagttcttttaaatagcatgaaaaatctatgtaattcacatttggcttttaaatagtgctggaaatctgtagtgctggaaacctcatgtatcgataaattagattagacattttttatgcttctctcgtgtggcaatatattgccaaatttttacggtgaggaactgattgttcttgttgtgataaatcataaatgagaataacttactacatttctttgatggtgttatgttctttcaggtatttgcttcctgtaatcaaagaactgtaacagtttccgtgatttgtggctcatgtgaggttcttcatgttgacaagtttagagaagaaactaagggaagtcaggttgtcagtagtaaactacatccaattttcctctgcaagtttgtctttttgatgctttgtcttgaattagttggtgaataatgagttaaaatttgaaatcaaatcctttaaaaaatttaatattaactaatatacatttgttggaacctggctgtgcaaccaacccattgggcagccatagccctaccttacttggagaaaatagttgacttggcttgcaagaatcgcactcttggaatagaaatattttatcatgatcttttttttatgtaacaaacatttgaaacttgcattatctaatacattatcctacttggccttgattcatgtcaatgcatatattgaatatagtaccaaactaccgaacataaaggccacttcctccagggtcattcaattgtcaaaatattttttctcaaaatgtgacaaagggcaaaggagatttgtaatagttgtccaaatttttcccttcacacaacctagtcatatgagactattgtaaggttagaaggcaagttagaaggagtgttactagcttatctttttataaatgaattaccacaaattatagtgagaaatagttgcagctaacaaattatttgggatccaagtcaaagaattaatcggagcatatagtgatcttgtctactctgctttgatatttgtaatttgctgatcttttttcagtataatatctgattgatctccatattagtctaagtcactattatatgttggcatctcacccatgcttaacatatttgtaattatattctccagctgattgactgatcagaagatggatactacttaacaagtgactccccaatacctcagggagagattgtcattggtggtcctaatgtaatttcaagaatgaagctaaaacgaatgaagtattctagctcctccgaactgcaaaagtagcaagtatttgcttgcccaatcatatgagttgtgtattcatgtaatattaagaaagttcagtaaagtctgattaatttaggctgtgctcagcgaagtgagcatagctcaactggttaggttccttgtggtggaaccagcccacccgggttcaaatcctagatttgacacgggtgctcgcatttacggctaattattctttcagtggtaggcgacgtacccgtcgacagcgaggcgcctgtggtgacttcgtcaatctcaagatatgccggcccagtcttccggaggtgctcataggagtagggtgtgcgtgtgtgcgttcataggggtgagtgtgcgcatgttgtgagcgcctgcgtttgtactgtgtttctcaaaaaaaaaaattaggctgtgctcagttaattttcatctggatttatttgcaaatttaatgagaagcatgacgtatatattattgtttgaccatttgtcttcttgctgcttttttcatacatcgttgttttgaattgttgtgctgcactgctgctgtgttggcgcagaccaaagaaaacaaggctacatgcatacttggcgggttggtcatgggtaggatccatgggttggcatacgggttcaacttatggattggactgttgttgaaattataagcatataatgatttaatttattccataaataaatcaagacattgcagatgtaaactagcatgaacgtatcattagatctacacatgtaaactaagcagtaaaatatgaacagatcaaatatgcgtaacatatcgaacacgtaccgaggtggcgaaaagatcgattgctcggcaagaactactcgcggctgtgggcgtcgacgaaggcgcgcagcacgcgagcggagagaaaggcgagccgtcacggacgaacagggagcagtcgcgcgaagcgcttccgaaaaaccttattgccgccttctcccggtgcaggacgtcgaatccagaggttctggagacctgctctcccgatcgccggtgcacgccgacgagcgggatggagtagtctacgagcgacggcgcagcacagagtaggaggcaaaccctagattgatttcgcgtatgttgtgtgaaggcggcggctcggtttatatagagataggtcgcttgatcagggcgcccgcagcaccagatttttcggaatgtttccaaaacaaaacaaatccgaatttccgcagcaaaacaaaactgcaaaaggaggctgcatctgcgcaagggtgaggagccaattttgcggaccattcaacgcgtacgtcgtgcacgcgcgccgcctgccaggcaaggcaagcgagcgcgcgcgtgtgatccccctcttctctccaccacacatgcttcaaggggctaggagggcatcctctcttttaaggaggtccccctctcctagaataaacaaggtggtactaaactccatatgcatgtcaacttatgaggtgggcttttgtgattttccaacgaattaatcttcgaatgggccttagcccgcctattaattccaacactggtttgggtgaaagcaacatgtgggctgggttgggtggggtttaaaaaatgattatgtggaatggtttggattgggtaaactaggtcgattgctttgggttggggtgaatgagggctagatttcaatccattggcagccttagttgtaaccaatcaaaacctatcgtttgattagcacatagaaaaatcgtagaaattttagacactaaaagagaaaaacatgaggtgatgagacctcatgcttattttctttcaaaattgtcctagcaaggttcattcctcgggaatttcaaaagaattgataggaaacaataaacaaaggattatataataaaatcctctagattttctatggtttttactttgtttcaaataggggtctaagggctcattctaaattactgttaccttctcgtcgcttccaagggctcaccgacagttgctgcctcactttcctcgggcaagctagcgagctttgccctcgtccaaggaaggaggggcttgtggtggaggtgggagggaaggagggccttgtggtggaggtgggagggtatttttggatgttgcatctctaaaacaaatcacaaagtagttagaatttttgagcgataaaatattctttctagtagtgaatatttttacatatatttttatcaggaactactccatggactatggtacctttatggaacagaaaatacgcgtgatattcacaatatctccataaacttgcatatccacaaaacgcccttgatatccgtgccagttgctaccacaaaacaggttatactgccatgtaaacaccgattatgttgccgtaaaacttcaacgctgccaccatgataaaccaatgatttttctgtaatacttcctcaaagatactaatgatacacaaaaatgctggtgatgcccataataacaccacgaaaacagcagtataccaacagatgagcaaggctcaccacataggggcagaaacactacaacttgcacatacattactgttgatcgcttcctgcttagctcagtactgttgcaaaactacagaccgtaagaagataatttctcaagatacaaaacttgcactgcctaaagcatatgaaaggaaaattagaattccagtttcctgtgaggattgctggcgatttggcttgtctcacatggtttgaaggtaggaaccaatactagctcgcttaatatcttacaccatcacagattcacagctattggggttcagattatgattgggtcctcaattcaacaagcaccaacagctatatctgattttgcacatggatacaaatacaggaggatccaacagaacagccaaatctgacgatgctgatctaacaacagttgcatcccagaagcaacagtgcaattaattttcttcattctcttacctcttccgcctcttgcttctcttcttgtcactctcatcagagctcgattctgactctgagctggagctgtctgaagcagatcctgaatcacttgatcccgactcagaagaggcgggtttctgttgttgcattatcagtcgaggcatattcttcaagtactctctcagggtctctgtgatacccccaagaccaatggaggtgaaaaaatttatggagaaccttgtattctttggatgatcctttgggaatattgaatcaaatgaatcttgcatgttgggatcattcagtttctcgttgagtagacgaataccaagatgttcagacaactcctgcataacaataaacatatacttcaattgtctactttgataaaagatgagttgacatagtaaataaaagcagaacattaacaacatacctggaagagtattttaatgaaaattcgagatgaagacgttgtgtcctcctcagtcaatctgatgtaggccaaaacgtgccaaggaagtgcatcagtacccaacagatgtgcaaaaaatttagcaacattccttagcttatttgtttcaagacgatgtatcatggaatactgctgcacaaaacacttctcaaagttctcctggtaaactttgttaatcatgcaaaatcgttggcccaataatccataatatcgaagataagttctctcctgactgcaacactcgagaagcatgatgcacaattccatctgtcaatgaaacagacagttggcttaggggaaaataatatgtctggcaaattcagcactgaagaactaaaagaaccaatctgattatgcaaattgaagagggattgtttgacatcaagtactgtattgtgaaaaaacaaaccatctggaagctttttgaccatcgatttttcatcctagcatatgttattatttagtagttaggtctgatcaatgcaataagtgtaaactagcagatgatttgaataagcttatcaactggacctgaaagtgtcatgggcaaggattatgaggagaagaatcgggatgaatagggatagattggattatagtagatgaaataacaaggaacggtcctgaacctaaacggcgcgacgctctctgtcgcactgagaaggcaggccgatgggcaataagataaatcttgatctaatgcctaactaacctaggataggatcccttcttatatagatggaggagtccttaatctaatcctaacaaaccctaatcctatccaatgggcctaggacgaccaacccaaagcccatgacattactcccctctttttgagcagctcgtcctcgagctgcagcggaccctgctagactcaacaaaacatcataacctaaactaagactcttaagccttttacatcttggcttattataaatatatatataactaatactattgcaaacaaccctactcttatattgtcatcaagaacatagacaggaggaccccatcctgaagccctgtatggaaatttaggcccacgccacaatccaaatctaaaagcccaacttgactgacccgtgtgataagcatatctaagccaacatgggctagctgctgatcgaagcccagtccaccagtctggcccatttaattggcgtagctgagggaaaacagaatccctatctccctctatcgtattcagtgccatccccaaaagaacgtgatgaccctgcttcacaccgtgactccaaggtaacagaagtcgccgttttctccaccgccgctgttgaaagtagcgatggaaacagctctgctgttcctgccgcttccaaaaaccgcgccgccatccctgctcctgccggaaaccgtgccatctcggttggaggtgacaacgccatcgacaggcccaacaactaggtcgaagaccccttggaggcggcttgggcagaggtggtgctgttgatgccacctttggctgctgcatgtgacgcatcctgctccgcaaacggcgcttgaagtcctgctgccgtgggcgcaggaacgtcatggcccgccggtcggatcgctcggcggctccgagaggcatggcctgctcggctgattgagccgccaaaacctggagttgcgccgccaagtccatcatcttctttgagatcttggcaaggccttcgctgatgttgggaaccgcagcgatctcggtacccatgggcacggaaccgaagctctaataccaagttgtcatgggcaaggattatgtggagaagaatcgggatgaatagggatagattggattatagtagatgaaataacaaggaacggtcctgaacctaaacagcgcgacgctctctgttgcactgagaaggcaggccgatgggcactaagataaatcttgatctaatgcctaactgacctaggataggatccctccttatatagatggaggagtccttaatctaatcctaacaaaccctaatcctatccaatgggcctaggacgaccaacccaaagcccatgacagaaagttacatgtacaattgaatccttattattgttccttaagaacccccaccatgtaaataacctaaattacaagaaaggagccaaatgaagcaaatggtacttataaaccatatgtaaatggaggcattaactacaaattgctgcattgtactaatgctaagaatttgacacaattttctagaaagacaattagcataataactacacagatggcaaataaaaccattgttgagacaataaagttcatgcattaccacaacaatttgttccaagttctaatataaagaaataagtcaacctacaatacttacctcttggccaggctcgagtttaatttttagaagcttgtgaccagcttcttcaaaatcaacactcgacataattgtcaaatatatggttcttcgaaggttaatgagattagtctcagtttgatccctaatctccatctgctcttcatcctcttcatcgtcagattcttcttcagcgtcctcatcagaagcatcatcagacccttcttcatcatcagaagattctgctcccaggatgcttctttttaggttctcatacgccttctcatcttcagcaaaattaggatttgccctgaaaacatctgcaggttggaaaaggtaagtgcaatagcacacagaagtcttaagacacatgaaatgcaggaaagtttcgagattcctatgggaattgaactggtgtctgaaactccaataaaagcgtcgtattccaaacaaaactaacacaagcttttatctcataaatgtagcaaagtgaatatgttcacagaagaaataaaagctcacttagattagtctctgggtctagctcatcttcaagggatatctcatgagtaaattggtcttcctgctccacaagatccaactctggacggatagcagggaatcccttcacatataagatacaggtcagaatttgttacaagcattcacgaagaatacctgaaaatattagtaacaatatgagcatacctgaaatttagcctttctaattgcaaacagtccttcaattaaaaattgcacacgcttgtctatttcaccttcatgaagaatacctcgaaatctttcgaaaatagctgcaaagattgagaaggcaaatccattgaaaacaataatggaagaagatgaaaaaaattgagcaatggtttgctttagttaatttttgggacaaataaaactacatttagcaacagcacaagtgttcaaattacacaattgtcacaggtaaacctgaattggactgtgttaggtagcatgacttcacctaacctattccttgtacatttttaaggttaacagcaattaaactcactgtttggtactgtacagttcacatgtccaatatcacacagatgaaatgaataccattcctaagtccaaaaaatatcgtgaaacactgttgtgctagccaacaggttcaacaagtcatgcagtcaaaataagcacttgtaataacaggtgatataaagaacctaccatgaagcccttgtggagacaagtcctgtagcattgccccacactctttaacaaaccccactgctacctgtcagacaagaaatatatccatacttcagatattgcacaaaatgaagttctgattaatacaaaggtactcaaaaacaagagtgcacctcaacactatcatcagttgggttctcaagcagcacggtaagaagctccagcgccacgagctcatgagcaacaacctggttaaccaagtgtgctatgaatttggttgctgcaagcaattgtggctgcaacaaccaagagctgttgtttaaaacattgcatatgcaaaaacataaaattaagcaatagataatcttatgaagtgttcgttttcaaacagtgctagaaaccttgactagaattcaggccagacatcactccaacatggcataaaactaaccaaggtcttccatactagttatgtttgagccagtagcagtatcttacattacatgtcaagctgaaaaggagaattgaggaaagttaccttgtcatttcgcttatatgccctcttgagctgaagcacaacacgaacaagaagcaggcggccaatctcagggaacttggtatttacaaccgcgacaagtgcagcaaacacatctgtgaagccaggcgaagccatctgcgacttgatgcacgattggcagaagagcccccttccacgaaccaggttctcggcgaacagctcgggcactatattctttatgttggtggcattcaccttgttcaccagaccattgatactcttcttgagagcatcccagctgagacgctggtactcgggactcgacttgtcctctacctccctcatcatctgcgccatgcggaaaggcgggatgtagattcctcctgtgcggccgggtatcaactccggcaagagcggcggtggcgggggcagcggcggagtcggctccttcctatcagggctcctgcgtcgctcctcgcgaccgcccctgtcccggcgcctctcatctctctgccgcctggagctctcgtcacgacggtggcgacggctacggccaccatcagaggactccgagctggggctccggcggcggtggcgcctccggtggcggtcgcctctctcgtcgtcggagtcggtggagcgcctcctccggcggcggccgccctccttgtcgtcgtcggaaacccgggacggcctcctcctgcggtcaccaccctcctcctccgcatcgggcaccctagcgcggcggggggagcggtcgccgccgttgtccccgccaggcttgggtgctcctcctccgttgctctcggcggggtcggaatcgcgggggcggcggggcggggaagccctagatttgccgcggtggcggtcggcgtcgcggtcggagggggagggggacggggacggggacggggaggcgcggcgcttgcggtcgtcgcggtggcgcggggagtcgtcgtcgtggcggcggcggcggcggggaggggagtcgtcgtggcggtggcggtggcggcggggaggggaggcggcgggcgagacggaggcggccatggagagggttgtgagattggtcgagggtttccgacgactgacgagagtccaaagggtgggggaaaaaagatgatttgattttgctcaagaccgaccactgaaccgggccgaaccgagatgtgggttttggctgtgttcggctggttttttattcagattggctaaaactatggagtcgtattttttttttcacttcggccgtgtttagtttctccttaaaaaaaattttaacgtatacggatacacatttaaaatatattaaactttcatttctagaaatggagatgagggcgtaatgcccttggtctaaaaaaaatttcaagtattaaacgtagactaataacaaaataaattacagattccgcctgtaaactgcgagacaaatttattaagcctaattaatctgtcattagcatttttttcgtccacatttaatgctccatacatgtgtcgaaacatttgatgtaacggaatttttgaaagtttgaagggaactaaacacagccttaactagaaaaaatgaccgtgccaaaaaccctatattgagacagccaaaacctaatttggcctaaaaacacccccttctccgagagatgcctaaaattttagttcccaaaattttagttctcattcttctccgcttagtctatattgtcatttagagagagttagcttgattgatccatatatgtgtcaacatacccttattcataattgactaacccttgcatgagatttcgatcacttaagtgtgatgtacattaataacatagtacactcttaccatatcttcacttgagattaaaaataagacaccttggaaatattttaaggtgaaatgcaacaacggtatatctttgcacttgcggattatatccttgatcgtaagaaaataccgactaatatgtctggtgccattgcctctacttaatgtcgtcaagaaatatcaacgggtagtataattttattattatttatcatcatctacagtgttgcatgagttgatgtgttttcatcatctctgccttcccatgacactatcctccatttctcttatttttggttatatcattttttaagatatttatatacaacatatggttctttataaagctgtaataaacgtctaaaatttaaagttctatctatagcgtgtttgtaagtcatatatagaaaataacataaaaccggcgggcagtggcgttgggggcgggctgcaccgcggcggtagggccctcgtcctcatgctcctctcccggcggtagcggccggcggcggcagcaacaccttcctttgctccccactgctgcctgcctcgccccgcgtcggcctcctcttcatgccgctcttgcccgccgccccggcctcgggacgccatcccgcctgcgccatcacgtgccggccgccgcgtccatccgccggcgcgccatctcctcctgtgctggctcaccccaacactgccgccacgccagatcgagcttgccccaacgccgccgccacaccggatcgagcaccgactacgagaccgcctcctcacgactgccgactagcaactccgtcgccgcgaccccctttccctccctctatcgctgccactctcaactcaccgcgcctcgcgtcgttcggcccgtggagaaggagcgaagagagaaggcagaaaggggaagaaaacgggagaaggaaggagaagatggaaaaggcaggggagagatgggaaaagtgacggcagaggcacagttataattttgtaaaattacaatgtcgctgttacaaacacacgaattgtaatgatattttttctgaatagccaaatttatagtggcatggatcaaattaacccttgatctaatgactttggttgcatatccctatttttgtctccatctgaatccaatggtgaatagtttctaaatgatggcttattccggctacatttttagttttacctttcaatagttaagataagttgtataaaacctttattgtagtttgtgacatacattttgtgatttaggagtataaaaacacattcttattcaaatccgagataaattgtactatatttaaaataagagtgaagtatataggtggtcctaaacttttgcaggtgcgtcatttagatcatatttttgggctcctaaagttgacttcatgccatacaggttcaaacgagctccaatccactccagagtgttgacatggcatatcatggtggtacctacgtgcctatgaattaaaaaaaattaattgacaataagttgatttcatgaaattctactttcttaggcatctataacacaaaatcacgcaaaaccctagttactagatgggtactccgcgcgttgctacgggagaattatgtgataatatagtacatattacttctaaaattttctttcttacctactatacgatttttttatgtgtttatatattttttacatttatcaattatccataggttataaatgattgggttgtatggtgtgtcttttggagggaagagatgtaatttataccctttatgaatcatccaaaagcttaaaaacaattgaggtgatgtgaagagatgcaatttacacccttgatgaatcatccaaagggtaaaaacaattgaggtgatgtggcttcatgagagaatagagaattagcattaactacagttactggggatgaactttatagatatataggatcatcaaagttccaagggcaagcgtcccagcctagggcatctctgcaggtgcaccaaacaaaaatagtcacagggcactcaaaaaggatatgatttgtggtttcagaaacatcacaaagaaaacactcttcagaaccaacccatcctttcaacttaagttcatatttttaaaaaaatagacttagacgaagttcatacttaataacattcaaacgatcagcaaagttctatacttaatccacccctagaatggacggcggcagagacacagacgaacacccgaaccttatgctggcatccagccctcattccgggccaggacgcggtggcgctgccacttcttgttctcctccctcaggctcgaggagttcgccttccccacggtgtggttcttgatatcctccatgctattccaccgggacgccatcttgccggggcagaccaggcacctgaagtagaagccgttgtagatgacgcgcagagcaccgccctgggggaccggccgacggtagccgcggcgccggtcatcttccgaatcggtctcgcagtcggacccggagtcgtcctcatcgtcatccaactccaactctggcaccatcttgtcgtcgtcgcctgccagggagccccgagtggctctgcggccctttctacctactatacgattttttttcatatgtttatatatattttacctttatcaattatccataggttataaatgattgggttgtatggtgtgtcttttggagggaggagatataatttataccctttatgaatcatccaaaagcttaaaaataattgaggtgatgcgaagagatgcaatttacacccttgatgaattatccaataggtaaaaacaattgaggtgatatagcttcatgggagaagagagaattagcattaactacacttagtggggatgaattttatagatatataggattcgtataatttgttttcaaataaccctattttaaggcaaaaggcttgtacaaatttctagatttgtataaatatctatattccatcattggatctgttcgacaggcgggtatctgccgctgctgctgctgtgtgtgtgcagcactattagtgctagctaaggcgcaggcgcggactgagcagctgaacaagcccattatattgtttgttacttaaattaaaaattgtatactctcaatgttaggtgccatcagtcatgtggggtttatataaactttgactataaaaagtttaattggtttcatttccattgatggaatttgaaattgacatgatgtagttaatatattgttctgtaaaaacatcattgaatgtcctcatcgcttttttataggtcctcatcacttatttacgagcagaaaaccagcgtggcgttcttatattttacctaaaaaaagtggtttcttatatttaccttggcttaattttgtcttctcttctttattaccaccctatcaatatattatatattgacccaccagtaaggttgtgttcctttgctacctttcccagctcatattaatccattttataaaaatagctaatactttattaatcatacgctaatgagtcagtacatgttacgtgacggagggattagttcccaacttactccaacgaactcagcctaagaatgacccaacctgtcattcttagcaagattccactcacaaacatgtagctcatttgtcgattgccgtctttttcttcacaataatcgaataaataaataaataaataaataaatatacatacatacatacatacagacacagacacacacacacacacacacacacacacccaccgtttgatcactcctcccatttataagatgcgttttgcatatcaactcattaccagggggtaaaaacagaaacagaataaaccgctttgatcaggccaagcagatctatggacagggaagcgaatacatgaaaacttgagatgccattagaacgtggaaatatacaacaaccgtcctgtactagattacactcagatccttgaccccaggcaacctaaattgccataaaagaaccaacttacatcacagagcatctctctctctccccctcctttcttcagcacccatgttaccactcggccagtgtacctctccctgcttcatcaaatggtttcagtgcagcatgggaggtaaatgaagtagtggagtgaccattgcgaagccttgaagggcgcagctcaggtgaaaatctcgttgaaagcgcaccgcgacacagtcaatatgataattcatggccacgcagtgatatgtacttcttaacccagatggctatatcttcggcgcaagcctgagccagtggtgttttcagcaagacgtccagcgtggcgaactcatggaccgcatccttgtactcgagaacaggggcatccacatttaccttgcggagctcctccgagtaagcgatcgcgcggtccttcatccagtccagctccgcaacactgtcaatgttggaggaatgagcttcaaagggggacctttaccgggaacaagagggtttgcagctggatgatccaagctgaattcaccctcaggcaagaagagtttccaggccagtaagcacgttgacttgtcatagaaataggagtttgccagcttcagttccgattgcgtgggactagtccccatgaaaaatggatacatcaaaacctgagcgacgaccttgatggggtcgaggagtttcccagcctcaacagcttttcgagccacatagtcagcaatgttcgctccgcagctgacaccaaggagaacacacctattaccatcaaagaggaaatgcatgtcagtaactggtatcagtagcacatttaccattaaacaaaatacagaacactgacacttagaagtcacatgtgcaccacaccactacaactaggatgcataagaaatgaaatgtctagaacaggagggatgtataatgtgaggcacacacaacacacagatcaacacgcaaacgaattacactgttacacaaaacaaaaaaggttaaacacacaaggtatcagagaccaggtggggatggggctattctgttgaattaaatagctagagaagaacagatgtagggaaatattagttcaagctacattttgtcgatttatcagaacaatgatcttacaattgttgtggtcatatgttttgccaatttatcagatcaatgaacttacagttgctgtggtcgactggtgggtacctttactgcaattattgtaattgtaaggactactcaccagcattcaacaccaatatcagcaggggatgggagaaagtagacgggttaggaatacaaaggttgacttatttcttgcatgccgaaactgatattatcaactccattgtaaaacactagcacacttcaattcctaaggcatataatgcatatattttcctgattacttttcccagctgagtacgaatctgaattggctccatcctgctttgtcttaccacaagttttcactgatatctggactgctttctaatttctaatcccaagattttagccaaacaaattataccctttagtttggctttcgtcggttaacatacatgatttcaaaggatgttcacaatggtggtactgatccgatcaaattgagcttgcattcgcagcccattgatcaccccagaaacataaaaaatgaaaattatccttcagagagcatgcggcaaaaaaatgtaacataaattattgtcatacttccatcatgaatactagaagcaacaactgaagatataagaaatcataaaatgtatcatggaaaagtataaacaatgcatctttgttgctaacatatttgggctagcagtcactatgctttgtacaatagtttgagtcttttgtaagggcaggttacataaaaagaaatctaaactaacctaatctccatcttgaagatcgtatgttgtttcttctcgccaattatctaacaacgtaatcatgatcaactcagactttaatccttcaacataattcactgaagcacttaatcatgatcaactcagactttaatccttcaacataattcactgaagcactgaatatgccaatgcctaaaaactatcctatataaagggaagcataacagctacacatttttctgtcatccccattaaacttcatgctacaacagaaagctgaatagttgatcaagatttaatctgacacagacatggtcaccatcaaacaaaatgtttttgagaagcgtgactgcatgagtactttaggttctcatatttcaaaatatagtacttttggcctcacatgcaatttatgcccacagatcaaaatgccaacaaaaaaaatatatatataacaaatattcatgcatacgaaacaatctggaacattactgaagatataatagataaacaatgcaatagtggagccacaaggcacttatgaaactctagaaatcatctcaccatgtcccaacaaaagaacaccatgtgccacacatctttcccaatgatgattcaccctttccaatactcatttttttatcccattattttgttcagcacttaagctcctattttttcctcatctctcatttcataaaaccccttccccttcaagtcatatagaacgcaatgggttagtttgattttctgtctccacctgctccttacacccagcaatccagtgccgctaaccatctcctcttattcttcctcaacctcctgatctccaagagcatgcagatgcaaactgatatttctcctccaaggttccaacccttttctccctcccctcgtctcctgactactactattaaccacttgatattgttacacacacattaattctgtcatggtcgacttcaaatttcttgaacacatgagaacccataatccattaagatgcaggcacaggacaaattttgaacatgtataccagaatgaccactgtgcagctcatgctaccaccatctacagagaaggcatctattaaatggttacgatctacagcgaagtacaggctacgatcgagaatagatctaaagccatccatttaaatggtttaacttaaaccactatatttacagtgtaggcttgagaagggaccaactgaattcgaccaacataaagaatcataggactggttgaaagaacaattctaaattcagtctccttattcctaagttgatattgtttactcctacattcaactgcccatcattgaacttatttgaaaaccaatcatgcctgagttggccatgtgtcagtggcagttgaatacagtctgcaaactatcatgtatgccacattatgcagcggcttgagcgttagttctatctcaggtttctcaaccaagaaaataagtatatgactaaatccaaagctccagcacagaattgatcagatctacaaacacaatcctcactagatctgtcaaaacaaaacctacattcccgaaagtttatcagttatcacacacattgcaaagttggacgacgcaaatccgcaagaaatgagattagctcactatagtaaagaccattcatccatcaaacgcaatcacttcatcataacctaacaagtcaccacaccaaatcttgcaatgctcaatgctgactctagaatctagattctagcaaccaggaacgaacaatactcatccacacggcaaccaaaaaacgaatcccaagaaatcaggccaagaaaccgcacctggatggatcggcgtgcgcagctagccacggctcgaccaacgccgcgccgaacgaatcggcccctccagagcccgcccccctcgccatcgtccgcccgcacgcggcgaggttggcctgcttggcgatccatttgagcaccgtgaccccgtcctcgaacgcggcggggtacctgctctccggcgcgagccggtacccgacggccaccacgatggcgtcgcagagccgcgcgacgcggcggcagaaggcgtcgttggcggcgctgtcggccgcgcccgtggcgaacgcgcccccgtggaactgcacgatcaccggcagcctcctcccggagcgcgccgtcggcaggtacccgccgtagcacggcgcggcggagggcgacaccccgctgaagctcgcgctggcgcggcgggagagctcctgccccaccgccgccgcggggctgcccccgtcgtgcgctggctgcgggaacgagttccgccgcagcggaggcggagcgttcgcggcggcggcgggggcggcgctgtggtgcgggttggggaggaagaggcggaggtggagggaggagagcgggtcggggtggaggtccttggtggcaacagcgtcagcgccggcggcggaggagaaggagggattggaaggcggcgaggggtggtggtggtcggcggcggcgcgggaggagacgccgaatgaggaggaggaggaggcggcggaggcggagagggaggagaggcggcggcggaggatgagcttgaagaggaggctgtagagctggattgcgacggggggcatggccgtctccggcggtgggcggcgtgggctcgccggcgggtgagtcagtcggcgtcggcgtcggcgtcagggtggtggtggtgccatgggagaggtggccttccgctttttctctcttttttggtgtttttattttggaatttggtgagcttaggtgtgttgatagggatgattaggctagggatgaagagagtggttagataattttggggggctttggcttggggaaccaaagagatgtgcaccaaagtcggcgcgtcctttgtgattgggtcaggttgttaaaattgagaagttttattactcattggatgaattgatggaatggtatcctagcctttctcccatttcacggtatctcattaccatgagaatcttctattataaacgcgatacgatactgtaataaactcatgtttaatactataatgaaggtgtatatattactggtttatgtgtccgtttgagaatataacttcgtgtagtaaaatgcaatgcatattatatgactgtgattagcacaattgtccttgatgtttgtgaagaaagaaggtgcaacacaatcaagaccatgtgttattatctattgatatctgttcatatagctttaatagaacaacgattatatacatggatatgataaatagcaaatgttggtactgaccgtttgtttgagaagatattatctgatcgatatctacttgattctctatcacattgactcgattatattatcattagcagttcaatattttatattatggatatacgaagagcgcatagaattatgggttataattgatcatatggtcttaaaattttgtataacattttaaaattattaggatagtaacctgaattaagcacaactatgaacccaattaattgtctcatatttaatgttagaatgatactcatatgctttacatgtgacaagtactccaaacataactaatataccagcagaaaacaccaaacatcattaaaacctatgacatcacccccttaccaatatcttgaggagataagcatgaaaacaaaaatatcctagacgtcggggcacaactgctgcctacgagaaagtgacatggaaagaaaaccaacgcttggtgactgtgactcatgtgggtagctttcggctgtgcactttgcaggtctcgaatctccaaccccctcccctgttggctccatccgtccaggtgtaatgtgaccatgcgacagcgtgtgagcgggacagcgcaaagccacgcgaagtgggcgttggtaagggtaattactccctacaatcctattttaaatgcatttatatgtccaatgttaaatttttcgtcttatttaaaaactataaaaaaatttaaaataaatcacgtatacattactatttatatttgatcatctaataatagtaaaatactatttaaaaaaattaaataaaacgacgatcaagcattaattaacaatatatggcatcatccgcggcatgagcaagttgctagtaaattaattagcagcataatctccgtggttaatcacgcttaccctccgtggggttaatggctggtaactaatgctgacttgttacctcacctgcctgcgtgcgcttttgctttgctttgttttgccaccgacgaggtggcgcatgtcggggtcggcgctcgctggcgggtggggcccaccaccaccaacggcaggacgttagggagccgcgctcatctgtgattatgttggccttgggattactccacggttgacgctcggctcatcggaatccgcattgcttttgtgggcgttttgccgtgtcatatcggaggtacgaacacacgtttaaagtattaaatataaattaataataaagcaaattacgtattccgcctgtaaactgcgagacgaaattattaaacctaattaatctatcattattaaaccttattaaacctaattattaaacctaattactatagcaccacattatcaaatcataaagcaattagacttaaaagattcatctcgtactatagcaccacattatcaaatcataaagcaattaggcttaaaagattcatctcgtaatttacacgcaatctatgtaattagttttttttctatttaatactccatgtatatattcaaacattcgatgtaatagggtgaaaagtttttgcgtgcgaactgccttagaaagaaaaatccatggaagttagaaatagttgttgttttacgtaagacttgtattagactttcaaaaactttgagtataaattttaaaaactatgaataatttctaaaatatttgccgtataaaatgaatactctattgtaacatacccaaattctagaccttaaaaatttcctatcaaaatagttggaagctaacttttctatttttgagagccaaaaatttccattttaaacaaaggtgaagttgatcaaactcttgcatgataaaattttagaacaaattaaaacctttgcatctctaacctaggacaaaaaaaaataaatttatgtgtaagcatgcatactctcatagccatgtttgacttgagtccttcatatgcatttggattgcatttggattttcgatttgcatatcataataggtctcatgaatattaattaagatctagataaacaactgaaccattagggcctagtgctagctagaggaagttaaaataggaaccatacaccttaaaatatatcaacaaggccaatgtcaagccccacaaaactatttggtcatccatctgaagactagtcatgaacctggtagtgaacaaataaattaactcatatagggtatattccaccttagttacctttataagcattctcttaattaaatactagagtaaacttatgcataaatagttaaggagcttatgacatgtgtaaggtaaactgtaattctaacatatcaatatcacctcaggttaatgagagtccaaatataacttttataaacatttacatgcatttaggaaaggaaaacacatatataaagataagtcttgcgaattatctaaaataattcgtgcaagataaaatcatgggaaaattcatgtaggctctacttaacatatacaactcactgtaattttggtataatttaataactaaatttggtacctcaaataaattagtcaaactaataaaaactagattaactgtagttcttaatcggctaaaaccatactttgtctaaaagtgcatttaactgcataaaagtgtataagtaaaataatttattcaaatactaggttatttatcatgaataaaaataatttttccagaatttatcttctctgtttaagtctcctaaaaattcgaactagtttccaaagaacccatattcctctaatttctgtgagtaatctatccataatttttgagtgcaactaaagaaaatggaaactaggtacatacacctacctccagtaaaatcaacactagttaatctgatcaacacattgagtattgaagctacaaaattagaggagaaaataattccggaaattcgtccaaaaaccaagctcacccatgtttctgcctacacatatcttttccacttagtttacttcgacctgggcccccttgtcagtccctccgacttgcccttcctctgtgcaacttccctagccgaccgagaaacactgagagggagagatcgaacgccgactggctctggacgccgcgcgacgcgtggccacgacgtgtcgacgccctaaaaacgccgagctccatctctgcctctcccagacgcgtcgccactcttcacccaccattccagtgccaatccatccgagggagagcatcctcgctgctcttctccactggttctccatcgccggccgtgaagaagacgatggccgcaatcgttgatgagccgcggtcgtttccccttctcttgcgttccatactctcctcaccatgccgaatatttctccttttgatttcatcctctctggtgcagccaatcgacgggaacgctgccgtgcacaccggagctctggagcgcgctcagcgcaccgccgcagcgacatcgtcgccgttgccatcaatctagatcaagccggagcgagccaccacgccaccagcttcacctcaacctcctctccatttaccctcaagaaacccatccaatggcgcagcgatcttggaggtcgacatcgtcttttccaactccgttcaaccgcttccatcatcgattccattctctctggtgagcgtcagtcaaattccatgcatgcatggcctctctagatagcctttgacctcttgcatgcaccgtattggtgactccccttacagatcgagcagcggacgtcatccctggagttgtgccatgccgccatggagcttcgccgtcgctgtgactctacagacatccccagccttgtctagcatctcggtgagcacccagaagcctatagaacatacatgcatgcacccaattaaccaatacatgattgtagaagcacatgcatcaccacccgaaaacatcctcttttcagactcgccgctggcgttactccgatgtccactgaccaagaaaagtagaggaatggaatcgcaatagcatgatcttcattttgtcttttgtcgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgggcctaggtctgcgtgttgattcttagaaacctcagagatctttttgtatattgatctctcactgacagtggaccccttggaaacaaaatctgaaattataaaagaacagtaactaaaacatgtaaaatccatataaaattaaatatagctcattttaagatgattcaaatttctgtgaaatcaccaaattgagaactttgatgttatggaataaaaacttgcactcacagtacaaatttagcctctaaaatttatccaagttaaatcacacataaagcatgcacaaacttataaaatgcatacaaaattcatttcaactcattttggagcaatctcagtttctacagatccaccaacttatgttctcctataaagcaaaatgaaatagtatacatactatacatcaaatgcctctaaaactgttacctttaaatgactagttttagataagctgaattttagaagttcatataaaattcatcttagatcctttttgagtaaacccaagttctgtagaatcaccaaaacatacacttccaagttataaaataaaattatatacttactgtatgataaaagcctctaaatacttatgtaagtaataaccatcatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaactttaaatttataggataggtgctaatcacaaagtatcgattgagcaatatgtatatatataaatgtatatagaaatacactctagctataatgaaacccaaataaaacttgttagaccagtgaatgcatatttctatccccatccaccaaaacttaaggcacttagctcatataataatttctaggttgatataataaattgctaacatggactagagctcccctagtttataaaatatgaaccatgataataaagaccataagcctatgaactaaggttagattggttaactaaaatactcattttatacatcactagctagatgaggaaagttttggacctaaacctctaaagccatgaacctatagaacactatacacctataacacgttataacttgtaaaatacataaagaattcatattaactctaaaaattatgaaaccaaatgtgttagtcttagaaaatacatatattcaccccccacaaacatgaacttaataagaatcaccttacgacagcggttcataatagtacctaagtaaatcctacactataccgacgaaacttctaaaattcataattctcaaatgaaacgagataaaatagaaattctttcacctaaattcattttagaccagtacctattcactgtgctcaaatcatgcattttagagtattttggatttttcgcatatttcggtgtttaattgcataacgtgtactttgtatagatgattgcttaaacggtgaagaagtgatttaggtgctgacattttcctgattcaaggcaagtcccacctccctctctttgatcactttgaacctatgttttggaggttattgaaaatgtttgcaaatcttgcatgtcgattgtacactaataaattaaaattttgttaaacttgttagataaactcctattatttgcattatcaccttaactccacatatatccatattcctcattcctaaccttaggaacaatatgactataccactttatatatgagttttggtgacactaggttactataaagcttagccatgcttagaatggtcttccttgtcattatgggctcattacaaacatgaaaattgatttttaattaatctggacggaactttaatacttgtgattttgataaataaaatgatggaaaacatggattttaggtttgggcctcaagtggtgcacatatggtgattagttgtgtaccgatagggggagagtgtgcccaaaccgacctaaggacttcactcaatgttagttcatttcgtatacagtgcaaccacatgtgctagtatgggatagcccaagcttagtaaattatttatggtttagccttacattctggtaggccggtgtgtatgagttcgtataattcagaggagcttcctatttaccccgaagtggtagtttaggcgactaagcgtgtccaatacaacggtattgtgccacgtggtgggttcctgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctgttgcatgattattatttcgcatcatgtgggtaaagtgtacagactctgcagagttaaaactaatcgattagccatgctcgcggtcaagagcgatgtgtggatatgtattgagtatagacttgtgtttattcttcaaaatgctgaaatttaccttcaaattgtgatgagatttgagaatgatctccttgctaccatggaaggcaatgaggtgcatatttatacatgattaatgcctaccttgatgcccaatatgtcaaatactagcttgctgaaatttatttgaaagtaaacctgatttagaaatgttttatgcaaataaaacttgctttatgctaaaaagaaccatattataccttccttgattatatgccttgcaagtagggtcttaggcttgtgttggtgcttgccagtacattattaaataataatgtactgactcttgctgtggaattaaccttttgcttgcaggatttagacttagcctttgagtgatgcgggtgatcgactgcttcttctaggacttgaacttaatgggggtaaacccctagtcggtatgcttgtgattgggtagacaagcttccactgttctatatatttatttggccggtcggccaatgtaactaaagtagatgtagtttataatcgctttcatcttatttgtgtttgctatgtataatcatgcttgagatgaaagtgtgaatctagtgcacatcctgggaactagattcacatgagtatgagttaagaatatttgagatgttgtagatctttagctatttttgtcaagtctcctgaatgtgtaacacatctggtcgtcgccttcgagtggtttgacgggcacatctcaggctgaagttgactggcaggctaaagacctagcaatgtctccaatattcttctctcgaggcgtcggatgtttcattatgtttgtttgatgacttgaattattcacttcatccctcaaatataatggaaggtccgtaaagcctacgacatctatgaatagaatgtacttcaccaaaatcatatacatttgttaatcgggatcgctaaaagctgtcacaagtttttttttttgcaaaatactttcaaatgtaattataatgtagttatattataactacattataatctatagataagttagatataaaatggcatatattgttttagtacatattatagttataatatagttatagtggaattatattataattatattatagttagatttgaaactttttccttaaaaaacttatggcagtttttagatagtccctctcttaatatattgtaatagaaaatattggtcaaagtttctatatagtataatgtaaatatttttggagaccgtgttatgattcaaaatgatagcggagagtaccactgtgtctttatcgttaaataattaggcttctttataaataaaatagtcgttgttgtcatgatttattctcaaacttccaacgctcatatttgtaaatttacatatatacatacatgatcaaatattatcgaaatatattttgcatcataaatataatgttcccatgcaattctcattcatgatatctaatcattttcttactgatcagagtaaaattatattgattaaccctgacaattatttgaaaacacagagattatcaaccttaagtccttaattccttggtctcctaaaataacattaaccttgacccacttcggttccataattcttgatattttagacatgaatgaagttaaacttttattatttggattattagtaacttaaaaacaaatatttagtttaaagacactaaaacatagatttttcatacaagaataatgtaatataaataaaaggttatttatttattatgtattataataaaaatataatcaaagatatatttaattttagagaccgtatcattgtctaaaacgtctacaactatggaatagtttctactgtaatactcctgtatctacaactatcaacaaatatataattttgttgaaataacttttaggattaactaagaaggtggcccgcacgatgcgtgggcatttattttgttgaaagataagattatagtttatttagaaattgtctcataggtaacaaacttaggatcgaacaatatccttttaaaatgattcgggtgttctattttcttaacatatctcaaaaaacattcatcaactcttgaatagaagatggattaagttagtacaactcttgcatcaaataaatattaaactaccgctagcttaattatcaagcatatcacttgtatacataccatggaaatatggctacaagcgaaaattgtgagatcaaggaactcaaaatgatcaatgatcttatgaaggcatatgacaaacaaattaagggtaaattaaaagttggattatccccctctatataagttcaacaatttcatattttctccatagttctgaataactttaaaaggttttggtgcatacaaattacctacaccatcgctttgcttggtattgcaaaatatcaacattgtttgaagctaatttctttagttttggcaagtttgattattttcttgaaacaatatttgtttaaaataagaccataattatataaatttaattagtatggggtagtttacttataaattttgaagtgttttgtagcaaaatttcatgtagtctagttatatcaataatatagttttgttcaataaattgaatattatttacagcaccagaattaataaaaatttatcaaaccatccatgactacttaaaaatttttggtttgtctaatttgtttatttcaaattcaaataatcacatattctccttctaaccggtgtgtttgtcattattcataataaaaaacacatcgatgttgtcactcaatcacatataaatgtaaaatatttgtcattattctcggaccgctcattcctcggtggtattcttcactcatccatcatcttaagatagttgtatacaacatattttgtctaattatttagtttacataaggggtgacaccacgctcctcctccctcatgcatgggacacagtgtccaaaatgttttttttccaaagcaagttcttaattaacccatgtaatttattagaatattacatgtgtaatatatgtgtatgtgacacatggtaatttttgtcctagcttcgccctgcttatatactataaaaagagataaattatattcaacccgcagtgcttgattcttcttctttctacattgcatcttcacgatttattttcatgttattaaaaaaaccaatcgttgtccattgataatttcatacgtcttcactttagcaaagcagtagcgctacaacatcatgatcaccttagctaccttaggtatacgatgctttgtcatacgtgtagaaggtaaagatgtcacatgtgttgtatagagagacaaagaggacttccgaggctgttttttttaacaaaagatagatctcatggtctaaataatatgtccaccggtttaactaaaaatcaacaaacaaatatttttattaggaaatagtctaaaataattgttacataatatcatataatggtgtaaactctatttttaaatattgtagatccaatttattaacatctgattgtaacgagttatatgctgatattcaattttttattaggaaatagtctaaaataattggtacataatatcatataatggtgtaaactctatttttaaatattgtagatccaatttattaacatctgattgtaacgagttatatgctgatattcaatgtttgtaaagcaactattatttatagtttattatcatgaataataataattattagtgtctcaactaaatacatggaaaatggaaagggaaaaagaggaaggttacatacctcctgggtggaaggaaaggtgtatacatagggggtggagaggtggaactgttgtttaatctaacggcttataatattggacccaccaatttaagtggaaataaacggatatatgttttgttttttttctcaaattttataggatttgttggcaacttgcgagagttttgaggaagtttaatcgaaatacatcgtatgatttatttgaggcacttatataaggataatattaactggagaacatctaccacattttctccctaaattttttcgtcggctttgcttttataattttgtaacctagtagttagctttatactatatcgtagttaagtaatacatagaagcaattatttatactgttattcatcaactgtaaagaatggtaggcttattttctttaataaaacatgtctactaaattaagtgttaaagtaaaattaggacttttttaattggatataggttattgttttctattaatggatgaattgcgtggacatgaaaatccactaaatgcattggtttatatagtctaatatgattggtgcagttcgagatgtggcacaggaatacaagaattgagaattttttatggtggattaattgttttttggattttaatatttgtacgttaaaattcagcaggtatcagtgagatggagtaacctgtcagttttgtatttttcttcagaactgatgaattaaacattggtgctaattacatctaaatagtaaaaagtacgtttagttctaataacaatgattaaaagaagcaatattaaacacatacgtgataattgctgatcttcgttctttctatcccataatgttttctaatctgtaaactcaaagtagcagtccgagaaacactttttttttgctttgacctatttcattattgtatcgtgtgataaaaaaaaattgagactatttttcagtacacagtacttattatcatgttccataactttgaaatttttaaaaatgtatcttactttttggcctaaagtggtttgccaattgctttgggattaaggcatgtattgtgttgccctgaagaaaatagtatttacataatagaacaatatattaaatgatatgtttgcaacaatcatacctctgcatctagtagaatcatccgcgtataccatagaactcatcagccattataggattaaccgcttcccatatcctaatcactcttactttaattatccacctatcatttttcttgttaacgcagtaatcaaattgcaaggtgccatgttatctgcaaatgcgtatatgcaatataatgtatacatttatgttatttaatagatgcaatatagtgtagccctaattaattaatacatgatagcactattgtgttcttctgtaggtacacgattaccttcttttgtcaaagatgaccagcctgaattgactaatgtcacaaaggtgtcgcacacgtcttatgctaagatgagtcgccagagccgtgtattgtagagattaaaatgccatctggtcgtggtgttcctaaaggaggtaaataatatgagattctacttaggagtaactaatcttgccggcctcatcgatttaaaatttgctaatctgctgaccggtgtgcatatgtatatgtagagataatctgagattacgttgacgtaagtagggtaactaatcttgcctactttattgattcaaagtaggaaactaaccttgagataaatgcgctccatgttatgatcacggtaaatacatgaactgcacgtgtgggtcctcaactcctatgcgtgggttcttattgtgccatgtcatgttgagagcgttttgagaaagccatgtggcagttcaagagtgtttgtaggaagtttaatggacttttagtatataataatagatagaagataatagatagatagacagatagatttaatacatgttatccccatatttctaaagtagtaaatattttaaaagttatttgtagttagagttttaaaagtttgacatcggtcttgtttaaagcaataattatttttaactggagtgagtacataacaaattcttcctgaattatctaaaagaaacaaattcttcctgaagttagtagtgtcattaggcttttatttgcattgaccggctggaagctgcttccattatattaaaaattattagaatttcttttactgatatttcgtattggacgtgacaacttcatcaatattttaccaaagctaactcagagcatccccagcagatagtctgtcatgtccttcatccacgaaatagcgtatggtgggagaaaatctagctccagcggatacactatccgggcatgcagggatagcgcatcccagagagttctcatgacacgaacacgcaactgccgctcccagccggattgagccatgaagagtgaaggagtgaaggtagagaggagagaggatgcgctggtggccaccttcgatggccactccaaccgtcggctacttgcacccatgctgctcccgtcatcggccacttgcgcccgccccttgcaccgcccgcacatcctcctccgtcccggctacttgtgccacccctccgttcaacagctcgtgccgcttctccgcctgcgccgccttgccatccactccgcccctttggcccacattggcccactaaccccacacccccccggccactcgcgccactgtttggcccatgccaacccgccgccctgacggtcggtcctcgtcctatcgacagtggacatacaagagagattgaaagagaaaggcgaggaaatatttttagagcggggaaaggtgaggaagttaatataaatgtatggtagttgaaagatattagtaaaatataggatattggtatatggaagatgtaatataaatgatacgttggaatgaaaagtaacatagagtaggaatcgttttggatgatcatctaaatgataatatggaggatgaaatttggatgagctgctgagatgttctaaaaccttgatattctgttggtgccaaaccaactgatgtcaatacagtactaaaacagacatatattggtaacacagatagacacccatgatttccttcgacctagctttttgcatgatgggagtttctagaaaaagtggctggttgatggtgtagtttatctgttcatgggcgatattgcactgattctgttgtcttgcaacaagcaaagaatatgttcagagtaagcctttcttcgtaccacaccataaatatatgcaataagggttgtgttttttctaacacttagctctatttaagttgaaatcgagagttaattacagaatagttataatgtattgtgttatgtcgtatttggattttatactatttgttgctctatttaagttggaatcgagagttaattacagaataattataatgtactgtgttatgtcatatttggattttgtactgtttgtttgtataggtaaaagaaatcattatgttataaatgtgagcacaatattaacgaatatcaatagaactcttacagagacaagggtgctataagggagtttaagaccctctttttttccctgattctatagttggatttttgtttgcacgctttccaagtttctaaatggtgtcatttttaaacaaccttttaactttctagaagtcaattcattcatttataccctcgaatagctatcacataaataagataattcatcaattttagcagttctaaaccctgagtagtatatattttttcatgctagtcatggtgatcattaaattagggatcaacggttaatcagagtcgtaagatgaatatgtacgaactactatcaacaactgtagattggtgtcaaaattaattgctactaattaaacatctaatggcttgctagccacataattaatttctctctacatgtatataaacatgcacgaagctagaacaaatattaccatatgccccatacatatatattaagcggttaatattctaattacatgtgttaagtcctttaaaatttcttaaaatgctctcaagctatcacgtggtgctctaataaattagaggaaatattagaaattctaaggaaaaaaaagcaaagtatccattacttgattttcggttaaatcggtacgcccaatattataaaccgctatattaaattaatcttagagcaaactaaatactacaaggtccgacctctcatccgctggcataggtaagcacctacgtacgtgggtacgtacgctttccgtcccttttttcatttttccctttctttttttccatgcatacacttccctccctttcctactatatcatgcgtcttcacgagacaatttatcacaataattttgagtatcttgctctcgcatttttcatttgtggccatataacacggtatgtatatgaatggcctgtatgatatctaactagcaatagtttattatttacttgagaaaaaatgattcaaaagtcgtaagtatttaatccatctcctactcaaagtttgtgaatggtttttaaagatatattaagaaaaatagaacccttaaattatcataaaatgacattatccgaactttagtttgcccttaatctatgagacaaaatttttgaacaacaataatcttacctttcaataatataagtacccgcgcatacgcgcgggccaccttcctagttataaaaaaattaaaaagataagtcacgcataaaatattaatcatgctttatcatctaacaacaatgaaaatactaattataaaaaaaattcatataagacagacagtcaaacgttggcacgaaaacccatttttttgggacggagggagtagagctgaagtcaacgaagtatctgtcatcggaaaatctgcagatgtgatgttttttgatgaatattagagcaccattgcttcttggtcttacgaacaagcttcgttgtcgatatattgttcttgacgagagccgtaggaagatcgatgatgttacactgaagaccggaaacatgatggatctgaatcggagaagagtgaacactggctacatcgtatctggagaatcgacctcttgagcctatctttgtcgaaactttgaagcaccaagtcctctatcctgcgtaccactgtcaatgggctatacccgagtatggtatttggagagtaatatatatatatatatgcaaaactgtagtaaaaggagacaggagacatatatttttatacaggttcggacccgtaccgacggataataatcatatttctattggccagagctgatgttatctttatatatcaatctcacatagacaatagataagaaaacctaatctaggctctgtcagtgcagcggcgtaaagctcgattaggtggtcgacagctccctagaacaggaacgcggcaaaatttgtaaaattatttcccattatcggttcaacgtttattgccagatcagttcctcttagaagatgagatactgtagttcagctctgttttgaccatcctatatatgagaccattcttgagaaaattatggaccgcagtgttgcttaggctgagttcttttcccgactcacctttcttttattccgcgcgtgtgcttttcaaactgctaaacggtgtatttttttgcaaaaagtttctatacaaaagtttcttaaaaaatcatattgatcattttttgaaaaaaaagctaatacttaattaatcacgtattaatgaactgctctgttttccaaattagctaatacttaattaatcacgtgttaatggactgctctgttttccgtgagcaggagatgggttccaacccatagcaacgatcgcagtattgtttagtaattaatctatgtcgattatctgtgttgtcaaatggacaactgcgtcacgtcgaaaggcgtgcttctctcgacagtggttggaagtaaaaacaattgtattgcttagtaaaattttttggatccccccattacatagcattaggtggctatttatagccctattacagattccccctttagtgtttaggtcttacagggaatttacatggttacccttgtgatagggacattattgagggcacactgtatcctttacatctatggcctcctattgggccatatggcttggcccatctgcttagcgaaaccttccgggagtacaacggcccgctgggccactttacggtgaggttcggcacttggcgaagtccgcgcccttatgctgaggctttcgccttatcgcctttgcccgtacagccttctgacgaagtccttgtctggcgaagcccgagtgtccgagccatggccttcgccatgagactttcgcctgtacggttcccttctcgattttcgccgcttgcctctggtctaagcttgtcgctcaagtcctcggtttcggcaggtcgggccgaaggcccttcgtggtatacctccaacaagcctctcacgggcaagggtgagtagggagcttcggccgagaccgtgtaagtcgtatggtataccacgaggcgccccctttcggctgatgctcctaccgaaacctatgttgtgttcctgcaaagtaaaaaacttgctctcgtgttaacgaaaagtttttgaggaaaatttccttcctgtgttcgccgatgaggggcgaagaggttaggctgctctttatattattatgaatagtaatggccccatgggccttaccattcttggtttcggccttttactgtttggcctcggtccgacgggaatttaccgtttcgtttacccctagacacgtgtcaggttctgattggtcggtagccgaactgtcacgcgacggggttatataataccccccgggttaccacttccccccctcttttcatttttaccgctgtcacgctccacgctctctgcctttgcttgcgctctagcgtttcgccacctccgtgctctcgcgcttgctcctttggactttcttgttctctttttcacctttcgattcctttttcgctacggattcgatggctcctcgcaaacccaccaaggctgggtcaaccggcaaagaccccggtagcctcggcgaagggtggtcttgctaccttggcaagtcccttgtcaaggagtctaacctagccgagttcgtcctctccggtgctcttgcagagggctaggcgacttgcgggggtgaagccgttgtcccttcgcctggcgacaggcgaatggttgtctttgccgccttcctcatcgttggacttcgcctttcgtgcaatgattttcttccgtccgtactggagatatacgaggtcaagcttccccagctcaatccatcggcgttcccgaagttggccgtcttcgcatggatgtgccgaacgtgcgggtttacccctaccgccgagttattcgtcatcttgttcacggcgtgcgcgacaaccaaggacgtgaacacgctggctgggccaaggaagacgattttcggttgtgtgaacttcaagcttcgaccggagcgttcggacgcctggccggtgcctgcgtcgatggcgaagtgggatcgcaactggatgtagaagtggttctacatcgacaacccataccccgccgaggacgacaaggcgaactggctctgtttttagcgccttgctgtctccatcgtcgctaaaccgaatatggaggtcgacggtacactcgagtcccagcttatccttcttcgcaaggttgcgcggcggccaagtacccgcgacctctgcgaggagttttgcctacttcagatctccccccttgcccgcgactggggggggggtctccgttaacgaggacgaagaggtgctcgggcttccccgccttgttcttcccgtcggcaccgaacatgagtttctatttcgcttcttcgacatcgttctgtcatgaagacatgtttcgactcgcttcgatttatccagttcgcacattggaggatgctgaggcggaggcgtcgaaaatggttgaaggtttaaccaccgccgaattcggttgcctgcttcaacgtcaagccgacgggagggcaaatcgcgttcacgccggcgaactggcctgttggtcgattccttccagggttgctgacgacgatgtatggacgtcaaggaagcacaagcgagccgttgcgaaaggccgccaggtgcgaacccagcatgtcaccaaggacgcggccgacaccgatgccgatgaggaggacaatgacgaaagggaggccgggtctgacgaagatggcggatcgcgcggttatacccccagtccaacctggctgaatgctgggacgggttctcatgcttcgcccacgggtcctcaggacgtcgccggcgcgaacgtgctcctggagatctccagctccgtggtgaaaccgggagtgattgacaggaagaagaataagggttggtgaaagtcgccgacggcttttctgacagcgaggtgtctttcgattggacgcttacttcgccggcgccacgacgtgttgccacccggaggagacaactgtcgccacctcccattggtgacgccgaagcgccgatgggtggcagtgcttcggccccagccgtggctctggttggggcgattgagtcagtggaagtgaacacttctggggccaggagagtcgaaacggtcccttcgacgagccatcagcgggaggggaaggcaccggcggttgagatgacagtgtctgacatgacactcaccgccccacacttcgtttccacggatttcgcctcccggccggagatcgcccccttcgttggcttgtgaggtagtgattgttgtcgacgtcgtggccagttgggtgaaggcggcggtcgaaggcgcccccagggtttgggacgacaaggtcgcgtctctgacttgaagggccttcgccgctactgccgctttcgccgcttccgcatcagtcgaagatataggtgccgaaggcaggagagagggtggcaccaccggatgcggcgccgctccggcttcgccctccgaggccgaaggctctgctccctcttcggctaccatctccccttcgctcccgccttccttccgcttgacaactctctccttgacgatcttcttcggtggtattagtggtttcgcttggaggtccccacggacggcgccagctgcgtcacgtcgaaaggcgtggttctctcaacagtggttagaagtaaaaacaattgtattgcttagtaaaaatttttggatcccccattacatggccttagggggctatttatagccctattacaggttccccctttagggtttaggtcttacaggggaatttacatggttacccttttgatagggacattattgggggcacactgtgtcctttacatgtatgggctcctattgggctatatggcttggcccatctgcttagggaaaccttctgggagtacaacggcccactgggccactttacggtgaggttcggcacttggcgaagtccgcgcccttatgccgaggctttcgccttatcgccttcgcccgtacaactttctaacgaagtccttgtctggcgaagcccgagtgttcgagccatggccttcgccatgagactttcacccgtacggttcccttctcgattttcgccgcttgcatctggtttaagcttgtcgcttaagtcctcggtttcggcaggtccgaccgaaggcccttcgtggtatacctccaacaatctggattcacacatctatactaactagcaaaatgcccgtgcttcgctacggtgtattaaaactgaaaatatttgtttttaaccgaattttttttacactgctttggtacttttgctcgctagaaaaagtctcaaatgatagagggaaatatagctcataataaattattattcaatagtgcgttgctacggagtaatttcaattaaaatcacaagaaataattttaggatttaatttgtgatatgagtccttttagagtaaggcattcttgatataaatttgccaataaacaacatgttgaaaacaatatatttcaacatcaactaaggttttatcgcaattaaaaaaagactaacttcctcttgttgggtaattgtattttgtcaggtaatttttatttttagtttttctatgaaaattagattggagatatattttgagagagacaaagtggacttgttgcttaaaaaaaaagactaaccataccaaatgtggcccaacaactcaatcgcacgctgttagtgcttcatgtgctgcgtgcggcccagtagtgctgcagcgcagagatggaggccagctcgatgcgggattgatccgagccactcgttttgatggatggttcggatcggtttagaatccattaaaacggccggtaccaaaaccctaaccctatttcagtttttcctctcctaactcccgatcctctcaggctgaaatggtgatgacgcaccacgatggatgaaatctgattgttatgtttaaggcccccttctaaactccaactctaaacttcaacttttttgtttttcgttaacacgtttccaaactactaaacggtgtattttttgaaaaatattatataaaagttttttaaaaaattcaaaggaacccatttttcaaatttataataattaataattaattaatcatgtattaattgcttgctcttccttttttttaaaaaattgcccatacgagcgtgacggtggacacgagcggagagcgagagagcggcgcgcctcgttacttccgcccgcccttatctcgttacttccgcccgcctcttttttcttttctccgcccgcccctatccccttctcatccggcgattccttccccctcccctcaccttctacgcacgccgtccccctccccctcccatggctccttcccagcaccctcttcctccgtcccctccccctccatgactccttcccagcaccctcttcctctgtcccctccccctccatggctccttccccatggccagcagcaccctcttcctctccgtctcctgtgtggtggtagcggtgccctcccctctgccggatccagtgggaggggaggcggcggcggcccggtttcccggagggacggtaggggagacggtggcggtggggcagcaccctcccctccgccggatccagtgggaggggaggcggtggtgagatggtggtggcccggcgtccggatccagcgggaggggaggggaggcggtggcagcccggcgtcccagcagcggcggcgccctcccctcctgatgtgcactagggttcccgatcttccgaaaggttctgagaaacaacgatttggacggagtcgcgacacaaatcgatccggcttcttgaacacgcacgctcttgagccccacaatcgcagcaccacgtctcctctagttatcacccatgttgaaacgcggatgacctcgccgagaaggctaatccctgtttaccaatcaaagaacacaaacaagaacgagatagaaaaacaaccaaaattgcagatgaatgattaagctcacgagttggggtcttacaaactgatctagcggcgaaactgttctcgacagattaatctaagcaaaacccaaaaacctaaagatggcggcgggtactgatatatagagtttagggtcgtgcaaacccctcttgacgcaaccctaatgggttccaacacgatacacgggccaaaggcccaaatacggtgacgcagcaccgggacagattctggacgtcaacttgttcggtcaattcccgttgactcggaaagaattttgacgtgggaccaaaaccattggaaaggctatcttcttagctttccatcaatataaagaacgctccaatccgagcacgtatgcgcagcggcggagctagaacaaaacgaagggggttccactcgcttgttttactctggtttgaatcaaatttagcttgatacgggtgcctaagtttaaaataacggggtatatatatggtgaaaatagataaagtataggtaaaaagttttttgaaccgggttcctgggcacccccctaactatactagctccgcccctgcgtatgcgacctgggcgcccgttttagtgcagattggtcctgaactccgaattgcaccagacgtcgacttggtttgggcctccaccttgacttgaacatccccgatgatcctccatggctgtaagtccttctcctagtgtctccttgtcccctccattgttccaaagcacaatataatcattaggtagcaatctattctcgaattcatacaaagaagaacataggaacgagctcacctctaaatttaattgtcgcgcacgagctcttgttatcggtccttgaatgaccgttggaggattgttgtgtgtatccgaggtagtgatgtccgcatcatcctccccctcttgaattgaagtcgtcctcgactcaagctcatcctcttctcccaagtgtggcttcaaatctgaaatgttaaacgtgggactgaccccaaactcgggaggcaactcaagtttatatgcattatcattaatcttctcaactattttaaaaggaccatcagcacgaggcatcaacttagactttatcaattccggaaatctatcctttcgctagtgcaaccaaactaaatcacccggttcaagcttaacctcttgcctacctttactaccagcaattctatacttttcagtcatcttttcaatgttgaacttggttgactcatgcattgacaaaataaattcagcgtgtgccttatcatcattatgaaccctctcactagtaggtaaaggcaaaatatcaattgaagcacaagggttgaaaccatacactacctgaaaaggacttaccttggtagtagaatgtattgtccgattgtatgcaaactccacatgaggcaaacattcttcccacatcttcaaatttttctttaaaatagccctcaacatggtacccaaagtgcagttgactacctccgtttgtccatctgtttgtggttgacatgttgtagaaaacaatagctttgtacccaacttgttccatagcgtgcgccagaaatgacttaagaattttgcatcacgatctgaaacaatagtaaaaggcataccatgcaagcgaacaatctcatggaaaaacagatcagcaatatgaacagcatcatcacttttatgatatggtatgaaatgtgccatcttagaaaaacgatccaccaccacaaaaatactatccctccccctcttagttctaggcaatcccaaaacaaagtccatagaaatatctgccaaaggaatagaaggtacaggaagaggcatatacaaaccatgtggattcaaacgagacttagggtgtgtttggttgggctgtagcttttgtaaaagcagttgtgggctttggcttttgtaaaagtagctttggaaaagcagctacgaggaagtcaaaagcctgtttggttgattaactgtggcttttggaaaaacttgtctcacttacgactggacctcgcctgtcagcctcacacagctcgttcagttcttcttcctcacggtccatttcggcggcgacggggaagagcatacgcgcgcggcagagttgctgccgtcctctcctccgcgcgccccaaccctaggcaagccggcgacgggcggggacgaggagggtggcgctggaggaggacgggatgcggcctgttggggacgagcaacgttggcgtcgggcggggacgagcagggcggcgccggacgaggacgaggctgctccgcgtcaatgaggtgctccacgtcgtcgaggagtttagcggcgtcgccatggacatccaggaggagtacggcggcgtcttggcgaggagaaggaggagcagcagcggaggcggctcgtcgaggagttaggcggcgtcttggcgagaagaaggagcagcggcggccagtcggggacgagcagcgtcggcgccggacgaggacgaggctgcgcggcgtcgggcggggtcgatgtcggacggggagaaggggcggtgtcgagcgaggaggagcaggggcgacgccggcgttggactgggagggtggtgccggtgtcgggcgaggagggcggtggccggccggtcggagggcaaatgcgctgctgcatccccgggcggggagggtggtgtcggcgtcgggcggggagggcggcggccggccagtcggagggcagatgcgccgctccatccccattgccgtgcgcgtgtgaagactgaaaacgagaggagacgagaatagatcgaaccgtttttctcataatggcagaggtgggtaattttttcccccaaaagcagatgaaagcagggggtagaggtgcttttgatttgtactacaccaaaagctggctttgggcaaaagtagttgtggcttttgggccttttggttagcttttggcttttgcaaaagcaaaagcaggttgaaaagcccaaccaaacacacccttagctttctgacaagtggtgcaacgtgccacgaacctctcaacatcctttcgcatccttggccaaaagaaatgcatggccaaaacatctttcgtcttcttagctccaaaatgtccgatcaaccctcctccatgcgcttcctgtatcaacaaaagacgaacggaaccaactggaatgcatagacggttagctctataaacaaatccaccattgatcacaaatttgttccaagtacgtccctctttgcaatttatcatcacttcattaaaatcaggatcaagcgcatattgttttttaattgattcaagtccaaaaatccgacaatcaagttgggacaagaaagtatagcggctagacaaagcatctgcaatcacattatctttccctttcttgtgtttgataacataagaaaaagattcaataaattcaacccattttgcatgtctatgattcaaattattttgagagcaaagatatttaagcgatttgtgatcggagtgaataacaaattctttaggccacaaataatgacgccacgtctctaaggaacgtacaagagcatacaattccttatcatacgtggaataattcaaaacaggaccatgcaacttctcgctaaagtatgcaacaggcttaccatcttgcatcaacacacctccaatgccaactccactagcatcacattctaactcaaaagtcttaccaaagtttggaagttgtagcaatggtgcgtgtgtaagcttgtccttcaaagtgtcaaatgactgctcctgtgtctttccccaatggaagaccacccctttcttcgtcaactcgttcaatggtgcagcaaaaatactgaaatctttgacgaaacggcggtagaatcctgcaagaccaagaaagctcctcagctgtgtgatggtttggggaaccggccaactctttatggcttcaattttcgactcatccacctcaattccctgtggagtaactacatatccaagaaaagagactcgttccgtgcaaaagatgcagttttcaaggttagcaaacaaacgtgcatcgtgtagagcattaaaaacagcacgtaaatgatccatgtgttcatcgaaagacttgctataaatcaatatgtcatcaaagtacactaccacaaatcgtccaataaaaggccttaaaacctcattcattaagcgcatgaatgtactaggtgcattagtcaaaccaaaaggcattactaaccactcatacaaaccaaatttagttttaaaagctgttttccattcatctccaagtttcattctaatttggtgatagccactacgcaagtcaatctttgtgaaaattatagagccacacaattcatcaagcatgtcgtctgacctaggaataggatgacgatatcggatagtaatattattaatggctctataatcaacacacattcgccaagaaccatctttcttaggaaccaaaattacaggaactacacagggactaaggctttgacgtacataccagcggtccaaaaggtcttgaacttgccgctgaatttccttagtctcctctgggttggttcgataagcagcacggtttggcaatgatgctcctggaatcaaatcaatttgatgctctatccctctcatgggtggcaatcctaggggtatctcagctggaaagacatcctcatactcctgcaaaaggttagtaacaacaggaggcatcgaactagcaatatcatctaaagaaaccaaggcttgtttgcatatcaagaaataacacatatcatcatctgaaatttcagcaatttcacatttcgttgcaatcataacaccacccttcaacttaattccctcaaccttagaactaggtgaaagcttatcctttttaggtggaaaaacagatttagccacttgctgattttcagattcatcaagtttcaaactagcagctcgctctttatcagcttctacaatttcagcaggggtcaaaggtagcaaagtaattttcttcccattatgcacaaaagtgtatttattactcctaccatggtgtgtagcatcattatcatgttcccaaggacggcccaacaaaagtgaacaagcttgcataggaaccacatcgcaatcaacagaatctgcatatgagccaatggaaaacgaaaccctacaaacctgtgttacctttgctcttccggaatcgtttaaccactaaatatggtaagggtgtggatgtgtacgtgtagtcaagccaagcttcttgacaaaatcataactcaccaagttgttgcagctacctccatcaatgatcacacgtgcacgacggttgttgatgacgaaaaaaatctgaaacaaattatggcgttgcaacctgtcatgctgctgtacctgcgtgctgagcacccgctgcacaatgatggttctgtagtccgttgtgtcatcacgaccaaagatttcgccatcctcatcctcaacttcttcttcctcctcttcctcttccatgtcagaggtggtgatgtagccatcttctgtagcaacataggcccgttgactagggcaatctttctgcacatgcccaaacccttggcaacggtggcactgaatgcgtcctgtcgaggcgacatatgaggcactcttggcgggtacctgcgtggaacctttacctgactctgctggtcgtggtggtggaaatggttttggtgccgcagaagctccggatgcagctggtcgcttgcccgctggctgggaggacgcccgaaaagagacggccttgggcaatcccgcagatggcgtcgtgcgcggagtgtatgtgcttgccttgctcttgccctgatggtcgcgcccctgtaattccttctctgcaggcatagcaaaccgaaacaactggttgacagagttaaattccttacaatcaacaatgttatgaatttcctccctcaaaccagaataaaaacgacaaatagcatcctcgaccccctccactatgccacagcgtctcacacccttttgtagctcaccatagtaatcctgtacagatttatccccttgttccaaacgcatcagtttcttgcgtaaatctctatgataagatggaggaacaaacctatcgcgcatagctaccttaagttcttcccaagtagtaggtaggaccccctcatcagataacccagcccaccacataatagcaaaatccttgaactcactactggcttgtctaactctatgttgttcgggtacaaggtgggcattatacttttgttctactgtcatctcccaatcaaggtatttctcagcatcataatatcccgaaaaagatggtatttttaacttaaccttagcataaggatcatcgagcacacgattattattattaccttgttggtggcgagtgccacccatacctatgcggtttgtgcgtaggcgacgtcatagccgtccttgccttgtagccggtgcgtcaatatagccactggaatcatacaccgtgtcttcaggatgagcatcgtcgtcaccactcaccacttcctcattggaaggtgtctccaacgcggcgacccgatcagttagcgtggatatccgcttgtccaacctctccatgtggttcaagaagccgattttagtgaaggcatcttggacagactttgcaacggcctccgtgatgtccttttgagtattttgttggagagttcgtagttgctcttggctgacacagtcagcaaaatcctagggactcttctcaccttcgttacctgacattgaaacaccaaaacagaaacaaaacggtgaaggttatccctaataatctactacgcaggtgtagtggtgcctctgaacgattctcagcaatatggagttcctaaccaagctcttataaggttcttaccagcaaagcaaaggatacctggaaggcgtagtcagcgattgcagggatcaagaacctgtgatgtccagaagtaatatgtggagctcggaaggccaaatatatgtatatgagtggtacacaatccaatgacagatagtaatgctgaataaaaatcccaagttacttgcccttagttgctagtctactcgtgtcctagacagtagtggtaacaattatagctcaagaaaaaaacactagtaagcagcaaaggacttgcaggcaagcttcggtgagtttcagcaaaaactacaaaaccgaactagcagataagcttaacggagcgcgtcgtgagctcaatgcactagtggaaatcaacttttctttttttttcttttatttttttgatatatttttctttttctagaacacgaaaataggcacacctccaagttacagctcaatcggagtaggtatctggcctatggatttttctgaaaccactataaataaggtgcaggaacttgtgagctcgaacagacaattttgcaaaccaaatttcagaattttggatttgccaaagccgccgaaggtggggagaaacggatgtaaaatttttttctcttatccgaaaagttaaattttgctctgatgccacttgatatgcactagggttcccgatcttccgaaaagttctgataaacaacgatttggacagagtcgcgacacaaatcgatccggcttcttgaacacgcacgctcttgagccccgcaatcgcagcaccacgtctcatctggttatcatccgtgtcgaaacgcggatgacctcgccgaaaaggctaatccctgtttgccaatcgaagagcacaaacaagaacgagatagaaaaacaaccaaaattgcagttgaatgattaagctcacgagttgcggtcttacaaaccgatctagcggcgaaactgttctcgacagattaatctaagcaaaacccaaaaacctaaagatggcggcgggtactcatatatagagtttagggtcgtgcaaacccctctcgacgcaaccctaatgggttccaacacgatacacgggccaaaggcccaaatactgtgacgcagcacctggacagattctggacgtcaaattgtttggtcaattcccgttgattcggaaagaatttgtatgtgggaccaaaaccattggaaaggttatcttcttagctttccatcgatataaagaacatcccaatccaagcacgtatgcgacctggacgcccgttttagtgcagactggtcctggactccgaattgcacctgacgtcgacttggtttgggcctccaccttaacttggacgtccccgatgatactctatggctgtaagtccttctccaagtgtctccttgtcccctccattgttcctaatcacaatataatcattaggtagcaatctattctcgaattcatacaaagaagaacataggaacgagctcacctctaaatttaattgtcgcgcacgagctcttgttatcggtccttgaatgaccgttggaggattgttgtgtgtatccgaggtagtgatgtccgcatcacctccgccggatccagcgggaggcggctgcggttcggcagcggcggcggcaccctccccttccggtttggtttttttatttgtgttcttgtagtagtgttttgtctaggatttggataaaatttgtgtgtatatgtttcagttttccctctcctattcaatttgtatgatggaattccggatgggattttggttgtgtgtatatgtttcagttttccctgtccgattcaatttgtatgatggaattccggatgggattttgagggcggacgatggggggggggggcacggacgaggtgacgattggaaaaatacaaatcttttaattagttaagattagatataaaaggtacattttgtttcttttctgcatgcacctaacaaagtgtacccataaaaatttgctaactgttcgatgctctcatctaactatcgatgttgcgagttagattaacacaaggattagtgcttgaatcagcacttggattaactcggacaagggactgatccgggtcgggctcaatagtttcgagcgccataggcgaactcggcgctataggcccttaaagctaaattacttttgcttgtaatatactccctccatccctaatgtttgacgccgccgttgacttttttaaacatgtttgaccgttcgtcttattaaaaaaattaagtaattattattatttttctatcatttgattcattgttaaatatatttttatgtatacatatagttttacacatttcacaaaaatttttgaataagacgaatggtcaaacatgtttaaaaaagtcaacggcgtcaaacctttaggaaaggaagggagaaggctacggcttggacgtccgagaaaactcaaaagatcagacgccctacctgctgtaattctgagcagatagcaaaccatgcgctatgcaccatctctttcctactgtatacatgtacactctttagcaatttttgaaatgatttttctcctaacctatctatccgatctatgatctaattatatcattgtattcattgtaattaaatctttataacaagatctcacatgagtatattacgttgaaaaaaacatattgaacatttttatactataaatgaaataattgagttataagtactgaaacaacatacctatttactgaaacatcaaaagaacactattgcaacatttgcaaataaactagtgaaacatttgaaaaaacttattgaagcacctagataataggatgtgcagcatttaataatccatttcaacataaaactttaaatgtgcaacaaagtcgaattaaaaattgagacatttgtttctcacgcgtgaaacattcgattttaacggttgaaacatttgtatttttttatcgaaatatagtcatatggtcttgttaagaagatttaattgttatgaatacaatggtataatcagattacggaccggataaatagtttaagagaaaaggaaattttaatgtttcaaatggttattggttgttggctttggatgaaaaaataactattctattgtgtgagtcctttacacatacgtaacaaaaaaaaagtttgctgatgtatgcttctattgagtactactccatttctacttagttaaatgtgaggatcccgtccgatatattcttccgggtcggacatctgaaataaagcatttccggaaaggagagagtatattttataaagcacatgtcctataaagtgacacaaataaatatttttaacattataaatacaaatcaagcagttgcaaattgtaatataaagcagttgcaaattgtagtatagtaatttattactgataaataatatcaacattataattgagaataaaagaaacaccgtagaacaaagtagtacgaatgaggtgcacaaattttcttagaaccaatgaaaggaagtagcatgaactttttctcttttcttttctgagcaccgaacaaatgcatttttttgtgtaccttgtaagtttgtaacacctaaaataataaaattgcgaagtaaactaaagagcaagaacaaagaaaatcatgcaaataagaaaaatccttaattcgtaacctaattttcttagaaccaataaagaaaagaaataagaaggctaactgttgtgtcgtgccgctggctgtgcatatgctccactgctggttgctttgctttgctatgagatgggatcagtcgatcgccaggcggcaggcctcgtcggcgtcgacgtcgcgtcgcggtcagggagcggagccgagaggagaaaacggcgcagcagcagatagaagacgaagcgacgcgttgtgccatggattgaatcaccgcatcaccttctggcctcagtatatctgtcgtttggttcaagtaaaccctcagtatatctgtacgtctgcagaggattctcgaaggaactcccattaatttagactggatgcttttcaataaagttttaatcataaaaggttgtgtaaattcaaactaagaagtaacctagcatgattattttactttggtaaaacatgaaaactacttcgggtaactaaaaagtaaatttggttgagaagcatgggttgtgcaaacccaacagatttgctccgtagctgcacaagccatggcggatagggcactgagacttggtgtgttggtggtggtcatcacgtacgcggaccaactgcgagagattctcgtcttgtttcatctcgggaacatggcatggatgtggtaagaagtgagctgctgctgaatgcagtgtcgagagctctgatatcgctagttcagaatgattgcatggcaacttctctcttccccatgcctcttattccgagtagaactttatatgcaactcatatgatatgtttgtgcacaacaccaagagctagcatggaacaagattggctagctagtcgagaatgtatatataatctctgcagctaaaccgaccggatgatagcgatttataataaccagctaataacaaagtgaacattcacagggttcacctgatagtgtctgttttattagataatatacctgatagtgtctgtatgtataatatatctacgtgaaatcgttgtgaatggcacttgtgctcacttcagaccaatctgccagtatatataaacacacgatttctaggccactattaaaaaagatttttctatacgagggctccaatatataggttgtagacggaccgtaactaatcgcgtctgcaaaaatcgccttccattttcgcatgcggctccttaaggctgcctgcacggaagaggggggggggggttggggtttctggagagagaaggcacatggtggctaggaggagatgggaggcgcggcagagtggcgacagtcgcagaccacctaggctttttgtggcagcgagctcggcgagcagcggcagggattgcgcggacggatcgaagcgccacggcgggtgtcggtgagggatggagaggatgcacgacatggcaatggatggatggatgcgtgtggcggcggaaagagggcgtcggttttgagaatttgtggcggctgcggtgatttgggcgtgagggcggaggcagggagcgcggcggggatgtgcgatggattgaacacgatagagatgccagataccgccttatccgtgatttcaccgcatgatgaaatcgtgcggtagagatgggtggacggtagtacagattataccatatttgcaaatagtcggtagggattcaataagatgatttgacctataggattggatgggtgcaactccgtctttttatcttagtatagatatatatgtctttctctctacaatcattatgcttttatttatcttctaattaacaagtgtatgtgtatgtggtatgcttttttttcttttttgataaaacgacggcaggagctctgccggaatttcattagaggatagaaaaagttcaggaggtacagggggacacaaagaggagcaaaaggagaacagggaaaaaaacagactcatagatcaaagaacattagaacattgtaaaaactaattaagggggttgaaaggctgagcgtcgaaggtctaggtcctcctttacaatcctcacgatgaaatcctcagaggatgagatgttttggaaaatccttctgtttctttccgtccagaagttccaccaagtggtgagaagagttcctttaactttagattgtaaggatttggggtgtagctgatctaggtcgatccaccaagctgcaatgtcatctggaggttgggttccttggatattttgccattgacatatcgagctccaaactttcctgaagaaagaacacccattgaaaagatggttggtgtcttcaaaggcgatctccacacaaactgcaaatccaattgcaaggccaatggcggcgcaggaggttgcggcgcaggaggttttgagccgtgagagttttctgaagaaggattagccacccgaaaaaacgcatctttagttcagctggactcctccaaaccgaactgaaatcaatcggggagaaagagccttggaacttgaaaagattggcgctttttgatgagtaggaacccgattcattcagattccactttatgtcatcagtggtatgttgctgaagctgaacgttttgaagcatacctccaagctgaacgacttcattgatttcctctatcgacgttatattccggaaagagagaagccaagaattatttgtaagctccgttttgaccgatctctgcttgcgcttagctaggttgaaacacatgggtgcaatatcttttggacatgaactttgcagccacttgtcctgccaaaaagctgttttttcaccgttgccaagagagattgttgtggcagcttgaaaaagtctcatgtcacagttatcacagggtatgtccattccaatccatggcttattttcctctttccatttgaaccataaccatcgaagtcgcagagcgcgagggaatttctccaactccagtatcccaaggccgcctaaaaatttcggtttgcaaactgtactccaatttactaagctactccctgggtttgttttgctaggatcctcacctttccataaaaatgacctatggaaacgatctattctcttgattacccatttgggggcttgaagggcagatagatgaaaggtcggcattgcacttaaaactgattgcaccaggattctcctaccttcagatgtgaagtatcgacctttccaacctgggagacgcgatccaatcttttcaatgagcggtaagaagtccactttcctgagttttcgaaaatgcaaacgtaaaccaaaatagcggcaaggaaagttttttgaagttcctgggaactaagagatgacctgagccaagaccatgttatcacatcgaatggggtaaatttctgtcttattgagatttgtatggaggcctgatgctttggcaaagatgttgagaactaatttgacagtgtcaatctcttgaggactgggtttgacgaacaaagcgacatcatcagcgtagagcgagcatcgaaacatgctaaaacgccctccaattggagtgagctacgaggcctcttccgttgcttggaaaagtttatgaaggggctcgatagcaaggataaaaagcaaaggagataggggatctccttgccggagtctgatgaggacataactagctcggatataaccatgactaccttatgtattaatcaaataaaggtgcatatgttctacattagatttacttgttatatatttgaacaaacgttgctacacaatgagttttgtgtgttttcgtttgcagagatacttgcttgggcgaaggaaaagaaaccgagcataactaatgcatggatgattaaagaagttgattggggaccaaactaagaccttctccaagtctacttctacctcaccacgtcacttttggaccatagaagacaagacataaagttgtacacgttttggattcggattcgggcctcctgacagcatcaacttcaaacggacctagccgctgatatagaaggaatttcggggcccatgagtacttgttggaaagcttatggagtctactttcagatggttttggtcccatgtcaaaattcctgccgagctgccgggaatctgcaaaacaagccatgtatctcatccagtccgaatctgacttgggttttgggccttataattgtgttgtgggcttagcccaagggggtgtgcgccctagggcaaccctaggacgtccctaatcacatttattcagtagccgtcatcgtttagagtcgggttttgcttagattaatctgtcaagaacagtttcgccgctagatcagtttgtggaaccccaaattcgtgtgcttaatcattcatatgcaatttggctgcaatctatcttgttcttgcttgtgttcttcgattcacatgcagggattagccttctcagcgaggtcaaccgggtttcagcacggttgataaccagaggatacgtggtgctgcgattgcggggctcaagagcgtacgtgttcaagaagccggatcaatttgtgtcgctactccgcccaaatcgaatgtttatcaatacatatcggaagatcgggacctaactccctcatcagagtcctcgtgcgtgcggtaatgaagcacctggggatccatttagaagaatttgggaagaggaggttgcaaggaggtttgatacccagtttctccatctagtaccaaaaccatacctctggaggacttctaacaggtaaggccaacccactgtatcgaacgcttttgtgatgtgcacctttaggaaaagcgcttctttgtgatttctatgcagaatatgcactaaattctgcacgaagaggaaattgtcgtgaattgcccttttcctgacgaaagcactttggttttgagagactaattcatttagtcggggagcaagcctatttgcaagcaatttagtccagccgctccttcttttttttgggaggaggcagatgtaagctgtgttcaactttttaagttgatttgtatttagggccatgaacgattttgcagctagcagcagatcttctttgattatttcccaagcatgtttgaaaaaagctccaatgtaaccatccggtcctggggccttttctgacggcacggagaacacaggatgtttgagttcctcttctgtaatatcatcctcttgatcatctaggtcgaaagaagggaaatttagggtagcccaattgagacaggattgcctttgtgatggagtgccaagtctgtctgagaagaaacgaaaaagagtgtcagccttttcctgagccgaaactgctatgccattttgagtctggagagtttgaatgaaattctttcgccttcgggagttttctttgatatggaaaaattttgaattaacatcgccttcctttagccatgttagtcttgatcgttgacgaatttgaatcttgtttaggacagccaaacctaggattctagcttttaggttgctgcgaagaacacattcatcatccgataagggccttgtttcctgtgcaacatccagttgaaaaacaacctcatttgccactgctaactgaagcttgatgtctccaacattttgccgattccatctcttgaggtctcgagctagccgttttagtttgatgtacaggatggcaagcggatttgcagctaggagagggcggttccaagaatcttcaacaacttctaaaaaccctggaatttttaaccagaaagcttcaaatctggaatttgggggtttacccctcatttcatttcctattaaaaagagtgccgcatgatccgaggtcgacgaagagagaggttgcaaagaggcgtttgaaaacatgatatcccagtcaggtatgacaaaggcacggtcaatttttgtttgagttgggttttggcccgctcctgcccaggtgaagcgccggcctgggagatgaagttcttttacctcaatcttgtcaattagccctttgaaacgctgcatcattctcctatttaggcgatcattatttttgtcagaaactttataaattagattgaagtctccaattagaagccaagccggcttcataaacgaggacatggcttcaatttctgctaggaaggctattttgtcagcttccaattgagggctgtataccaccgttattgaccattggaggccctcctcaaacattgtgattgttgctgacagagaaaattgtccctgtacagcttctgacaaagaaaaaaggtttgcattgcaggcaagaataatcccacctctagttccactggccggcaggaaagcataagattggacaaagttttgacctaggatacttaagatgtttctgtcagtaactgttgctaatttggtttcttgcaaacacacaatagaagcaccaactttatgaacaaaggctttaactacatcttgtttggcctgggcatttagccctctcacattccagttgaacaggtgtacattgtgttgagacataatgaaaacaagaagacaactagcattgacattatgggcagcgcgcagtgtacaaaccacaccgaaacacaaccagccatgctgggagaaacacaggtgcgacaattgtacacaactgtggcagctactgccaccaaaagaacttgacagccaaacaactggaactgctgaagtggaggacgaccgctggtacttgtggtcattgctgcgaggtgatacatagccacactcatcacctcatcatgtcttcttggaggaggggacatcacattggcaccaccgccgccttcttcttggcagtcttcaggtgaatgccttcgcatccacccttctcgaccaaggttgtgataatcttcatcgaggcaggggatataggcttcttgaaatgctgcacataaagtttttcgatgttttcatcaaaacgagtttgatcgtttaaaaagccaaagttttttgcaagaatttcttgtgcgaaatgttcaatcttggtcccgaatctgcgcttgcgtgctaggcgttcactatgcctttgaggggagtgaagggtcaccttattgcggcaagggcgacgggagctcacatcaggagtaggaaggatcgccggctggatgggagttgagaggcttgccgcgaactcctggaggttcttggcagcgcctaggaccccgtcagcagcgccagaacccagctgggtactggaagggatgaagacgggggaggcgatccttggcgatgaggtgtctggtgagtacagagaatgctggattgtggcctcatggagcatggggtcaagatgcttctccagcaactccagcacagcgacctgtccctgcgaaaaaatcaccggttcaggctgtacaaccaaggatgaggatggagaaaaaagagtggccaaggcatttgccccctcatcagggctgccgctgcggcgtggaattgcgctcttgcaaggcgaagggacttgtggagacgactgaatgcggggggatcttgtacctcttctagacagccgggggcggtcgtactgcacttggcgagcgagaacggtaggagcagctgctgccagcggagggcgctcgaacatgctggcgtccgcacgtgtcttggttgtaaacttgttgatctcttccacagacacggctacgactttacgaccgtccacagacacggctccaaagggaacggctcctacgctacccctgggagcgctgctctctgtcttcgtcttcatcatctggacctcttttgggatcaggctcccttctacaaggaaggggaaactcccgaaaacggacaccatcagtctctgcgccgtactgccagtcgtacgcgcgggccaccttgctgtgaaggtcttctagggtgtcgatgtgaacgaggatgtcgtaggtccacccttcctttggctcgtcaggcggagggttgtggtgaggttcaaggtctagaagagaaatgtctgtggggagcccttcttcatcagcattagtgatagagaaagtggaggaacgcgggatgaactttggtgcgtcagtccaaatccaaatgtcgaaggtgcggttgtagttctggcggcgagagtactcttcgacatagttgatggagcactttcttccaatgatcttggctgccgtttcttctgttcgagcatgcattgggatcccctcaatgcacactcttgctctgtatctgaagcgcgccggaacgccgtgaaggccttcctcccacgggcagaagagataaaccctccccgacttggtggcaagccggggctgcctcaggatggcatctctatcattctggctggaacaggtgatgaagaagtcttcggggtggaacttcgtaatttgaatgtctgagcgtctgatgcggaaggccgaatgaacatcatctgcaaacacattgggatccacattggagccctgatggccaacctgccaggcaacaatagagcgagcagagaatttctgcctcagtcgctcaatctcccccgtggccgaaataaccacaggctcttgagagggacgagcagagaggtcatccatggaggaaggggaggaaagagcagatcgcgggagcaacttaggggggaaacgaattggggcgagaggagggaaagattcaacggaggtttgggggagcggctgcgaggtagctgtggatttaaaggattttctctttaggcacgaggaagcacaatgaccaatgcccatacagaaccagcagcgaaggggctctctgcattcaataactcgatgatctgaccgaagacaacgaaagcatttaccttccatatgcttgaggaacctcgctcggcttaactgcaattgaaattggttggtgctatcgggagagtgagcagggctcctcctccatcgatttgctttgacttcttgccactctgaaccagagacatcaaggctacctctcggatgctgcactgcagaaaggatttgagctggcatctgaaccttgcgtccactcttgaggatacgaagatctttgggagctgctccttgggaacccacatctggatccgtcaggttgactgggttaaggcgctcagtgacggaagagcagggttgcgctgcagggaagttaaggcggccggcgagggaccggattttgggcggagacagctcctgttgggacttggaactagcagctaggggtatgggagcaggagcggccaggacctcagagtaaaggcggagtgctccaagcggcgctgtggctggcagatcttggagcgtggaggatttgctgggatcttgaggacgcagtgtgacgaaccttgagtccaatcgaggggaaagacaaatcgaagctgcagtagaggaatcaatgccggagatttgaatggtttctggtggatctgggtgggtggagaaaggggattttggcgagggggtttgggctgagagaggagggttgtggcggggaaccgggatggggaaggtttcgagggttggggatgctagcgaggcttggaagacgccgacgagatgctccggcgaggagcgaaatcgcctatggcgggggtgggtgtcggggctgagggaaggggacggagccatggggtttggtctaaaatgaaaaccatgtggtatgctttggatattcgtgtttacgctacattccaatattagttgtgtcacgtccttatggtcttgcttcatgcatatcagataaatttatgcaccaaagcaagtgttttataagttcaagcactatattgcagttaaatggcaagtccatgtaatgctaatgcaatttactccctaagtaaatatacattaagagttagctagttaaaaaacatcaattagtagttctagtcgtgtatgcagtactgtagtgtctacatgctcttttcccatcactagtttgctttgtctttggattgtggtttgagttgggttctccgaaaaagcgcagtggactgatagctggtttccccagcaaaaactatgcatgcaacatattgctttccataaaaaagcagggctgccctggcatttttaagtacagccatccatggcacacacctgattgtcccttgacaagagaggattctcataggaacttaattgatagcaagtggatatgtttatttcctaataatatatgaagtatattcttatacaaatatgaaacttttaatgaagaaagattgtacaaattaatcaaactaagaaatatcctatagctacatttactaattcacaatccacgaaaacttcgagtaattcaattatttgttattatttgcactacatgtttgctttcactgttttaaaaaaataggtgatcattcacccttctgattgactccatcttaattttatagcctctctttcagtctcttatgctttcgcagccttgccaacaatttccctaccggacaacatcagggaaccctggtcatcttggataatcaccccgaatgtaaatgcactttgtaactgcaggtaataccacgagagattaaagtgagtagttctcagcttattccattctactctcttcgtcccacaaaaaaccaatctaggattggatgggacattttccactacaacgaatctggacaggagcgtgtccagattcgttggactagggaatgtctcatccaatactagattagttttttatgggacgaaaagagtagattggaacatggcatccatagcagacaaaccgctggattccaaaaaatcaatgtaacaaaatagagaaaagaaatcacaggaaatggttgcactgtgggagtttaatcagtctcatgtgggcaatttggaagagacatagaaacagagattgctaattaagaatgatcttctatcaaaccaagctgatctaattcattacatttgttcttggatttcttcatggtcaatattgcagagctcacaggaaaaaaaaaagagaacagaatccaccactggaagtatggcttgaagaggagatggagaagtttgcagggaggaagagaatgaaatatacgctgtattttgctccaatttgttggccctgctacgtactggtggttctacctggatggtgattctggcatctaatggctaggtgcagcgttgttgctggggacttgaaattgaacaacaaagagaaccttgcaggtaggttaagcagtacaggattccagagggaaaacttcacacgaacttctttcttcctgatgtcactcattctgaacaagtttacgcaagtgatcttggggaatctcaaaagcatgactaaaagattaattggcttgttaagaaataatatagcggtaatatatctagctagaaagctatgcatagtaatttttttattgatatacatatgttagatgagaaagacgaggtggaataacgagagaataggtgtctcatgtgttcaacttataatagttgaatgcatgatcgaacaggtgtataattaatacggccgaaatgagtagagtgctgcaaggattgcagcatacaaatgtgtgcatttatgtgcaacaattttcatttggagctgaatttcttgaaactcttgcgcggcactcgggactcgggaggtaagcatgtttttgagaaaaaaaaaacaggtcgaatgaaaatgtggtctttcttattatcatagaaaagaatactagctcttcaataccccctcatggaaagtactgttagatagtcccgtgatttctcttgataaactaatgtgcataaaagatgaaaaatatattaatagtagtatttttggcatggcaaatctaccaacaccattttcacaaatcgctctaatcatttgagctacggctgataagcaaaaaaataaatgaacgaaaagaaaattattggtaaagcttttattctgtatttttgaggtttataaacgccatggtacgtagaaaaacgactacataaaaaaacctgctaaaatcaacacagaaatgatgtttctaagtttattttttttgctacggatgacaagctaacaaatacagtacttggtctatattttctaggcttacatgttcttcttaaggcactagaagcagtccatctattcgtccgaaacaatcaagtattacatgtgtatctcggcattcgagcttctgaatatatgatgagacatatattgcatttttctggttttggatatgtatcacggcatgctggcttgaggaggctgtcgtgtgattctccagagaaactagcattgacatgctccctgattccactcattcctagcaagttaacaattcaaaatagggaggaaaagcagatgcatgttagaacagacaaaagattatatgaggaaaaatgaggggtgggatatttaattacagagcatcagtagtatagggtacacaaaagtagtatggtacttgacccaatctaagctaaagagccctgataggaaattatttcggtcacaaattaaattatttttggatcaagtaatttttcttcagattgaaccaaaatatgttcaaatttcaacgttttgattaccacgatatagaacttgcctcttgtagtaatatcattagaataggattatatggaaaagggtttactaaggtcaatggttcagtgtattgatatccatggtgagttacatgaagtaaatccattgtgacccaaaattaaattaaatatccattgtgagtaacttaaagtaaaaaaaaaaaacatgcaggacatcccaatatcattgtttgcagaggattctccaaggaactccatatgttcaaatttagcctggatgcgtgtcaagataattttaatcataaaaggttgtgtgaattcaaactaagaattaaccaggcatgattattcacttactttcacaatacatgaaaactactccgagtaactaaaaaaaaagaaaaatggtcgaaaaacatgggtttgggcaaacccagtatatttcctctgttttctgccaaagccagaaatgaacatatgacaactgaacttgagatggatgctactgatcgagacgggtggtggtcatcacgtacggttacactgatcagccagacacatttccgtcttgtttcatctcaggaacatggtatggatgtggtcaggagtgagctgcagaatgtaggtgctctgtgctccgtattttttttttcttttttgccgtgggaaaggaatttcatttctggacacatgacaaattacaatcgttcaggatatctggattagacctgacacaaaattaaaaacaaagccataccagaagccaaataaataaatcttgacttctagctgtcctaagctagttcatgactaatcccgatttggtcccgctgagtcttcactatcttcacggtctggattctcctttcgcctgaacgaagcaactttgcttatttgataagacagggaagctctgagccatccacgtctatctcattaatcaggtgcctaatagcagccaggggcgacgctagagtcacttatcggggtcagtagaccccgacgattttttgcaaacatcttgtaccagcactaatttaccagctacgaccccagtcaaggaaactactagaccccggtggtccggtgatattgttctggtcaagctcaattagcaactaaacaatactaacaagtagtaaatagaaaattagctagcacttattatacaacagcccaatatacgtatgagatttgagcccagaaggctttgtattcctgctaaacaagtccacaaattgccttgttgtgctgctctgtattcctgctgcagtgcagtctggctcgaagcgcttcgcccaatcttcgccgattggcaagggtaacccactaaccccatcacaatttcttaattattatcatcacaaattggttgtaggctggtttctcaagtccaaaattttaggaaggtagggttctgaaatatgaaatttctccaaatttctgttacataaacataaatttattctttctagaaaagtggaaggtaagaaattagtgattttgatcatctacagcagcgtgggtattttgttttacatattaatcattccattttttaataaattaataggcaagcaaagtataatggagtgtgattcttgagaagaaaaatacccacttactagttcatgtggtactaattctcctttatcattggagataaccttctcggtaataaaagttgtgtagacaatactgcacgcaatcgtatcggtaataaatatatggattactccttgcgttttaaaatatactacagttccaaatgatgacgacgtggttgttcgttttcacaagatgaaggatcgtaactgtacacatgagaagtttgtaacatgtaaaacataaccactttactaaaaaaactttattttatcatattatatggtcgatagttttgttctaggattatcttaagattattataagctatagtcagttagtggtggccccgataactatttttcctggcttcgcccctgatagcagcacattctgtgatcggatttggctggtgcagaatgaagatttggcaatgtctctcttccccatgccactcattccgagtagaacttcgtattcaagtgatataatgttggtggaaaacgccaagagctagcaaatcaagaatgtatatatataatctgcagctaatcctaccggtcaagaagaactgaacattcatatattcacccgagggagtctgtatgtatatatctaggtgaaatcgtcatgaatggcgcttctcttcacttcagaccaatcttccagtatatatacacacagacgattgcttggtgtattataattacacaagaacccatacacatataagaaaacacaaataaacttttatctgtaatagcactgctcagacagattgtacaaatttgtaggtgagaaatatgaaagtcaatagttaagaggcacctaacccaactaacaggcaaaaagtcaggtgaatattacatggcccagcagctatatatgtgagagcgcgatagacttatggggggtggtggcagagaggttcgggtaacacttacagccaaaaactcgaaggtgtgtatagaatgggtgagttccatagagggcaaaaaacggggtgtggtgatgaaggattttggtgggaataccggttattgaaatgcgtgccagggtggagggcctcaaccaaaatgaagggagtagggtggcatgaaacaacaaagagcgaacttcgttgttgagagaacatagcgtgcgctcggccttagcattctgaggggaggtgtgagggcacgacattcgtagagagacgccgttggtgatcggaaaaaggtgcgaccgttggatttgtcaaactcacgaccgttgtcacactgaatgctccgaatgctagctgcaaatagagtcttcacaaaggcaaaaaaaccgtgataaattggcaaaggtgtcgggtttaaaacaaagcggaaaggtccatacataatgtgagaaatcatctaaaatgaccaaatagtatttaaaaccagacacactaggtataggggatgtccacaaatcacaatgaagaagctcaaagctggtcgtagccctagtaaaactgctagtaaaaggaagatgagtgtgactcctaagttggcaagcatgacataatgggtagcactcttcggaggaggaatgacggacgcctgagctaagcgagagagagcttcatgaccaagatgtccaagtcggtgatgccagaggttggtgtcgatggtggaagcaacaaaaggctggacggaggtggttgagggtagagagtccgccaatagggggtacaggtcactggaactattgcacctagcgatctcgatcctggtttggtaatccttcacagagaggcaaaaagattcaaggcaaatagaacaccaattatcacgagcaaaccggcgtgcatatattatgtcttcaataatggaaagagacaagagaatatcgttaagaacaaaggagcgatgcgagtaatgcaagtaagttgtgccagcggaggtaatgggaataagtgatccgttgccagcaacaatgtgtgaaggaaaattgggggcggggcggggggggagcatgagacgcactaaggataccggtattagaagtcatgtgggaagatgcacctgaatccatgtaccactcgttggttgtcaggggcatcaacgtggaggtgctgaaggagctcgcgagtgcctgcgggtcccactgggaggggccagcccaagcatgtggagatggcgtagccgtcggggagggagcggcgctagcccggcgtgctgaggagctccatgggccgcggtgttggcgacatagacaggcggcccaacgactcccgcgaaaggaggccggccgaatatgcctggaccgtgggcctggcctggccacatttgtgttgtgccgacccacgggttgtagggcgtcggccactgatgggcaaacacgaggggggtggactggtccggctaggtgacgtgctgtctgccgccacctctgctattgccgccgttgccaccgccgcgtttgcgacgacgattgtgggagttgccaccggagccgccgccgccttgggagttgttgccggtgcgggcgctggtggtggtgttgcctgaggttgcagtggccacaacaaaggcagtggtagaatcggtggccggccggtgtccctttgtgatctcctccaacaacagctgcgacctggcttggatgaagctagggaagggatgctgcataggaagaagaaattgcatgaccatatttagtgctaaggccattgatgagcatgcggtcggactgcggttcgccgaggtcagcgaggttgtccgccatagtattgagccgacgacaatactcgaaaatggagatatcgccttgcgtgaatccatggaactcggtggagaggttgatggcacgaagctcacaattttcaagaatttggaactccaaatcatgccaaatggagcgggtggtggcagtgggcgacatcacctcctgaagcaggtcgtgggagatggtgcgccagccgaggacgacacagtccatctgtgcccaatcggcatgattaggaagaggagcgtcatacaagacgtggtccgtcaaggcatatttgccaagaaccacgaggaagagaccgcggcagcgtgcatagttaccggtggcgaggtccaatgtcacggggatgagggccttgacattgagcatggcaaccgcttgagcgtggagggcggcatgggtgtcggcatccagaggaggtgccgaagccggggcgcggcgccagaaggtgggggtgcggcgggtgcaccagacgcgccggaggccgggatggcgagctaggcaaaaagcgccagtagttttggtggcaaggcaccgcagggcgtggtcgggagcggcggtgtggaccacgacgacgagtggatctcctcggcaggagaagcagaggctggccgcgggaggtgcttaacgagggcatcgcagacggcgaaggatgccttagtggccactgattcggcaactgactgcgtcgaggagtcgtcgatctgaagacccagcgacggttgatagttggcacgcacagcatcggcgacgatgttcgcgatggtagtgatgaggtcgtagtgcgaggaagaagacgacgtcgacatggcgacgaggcgctgcgcacagagaggagagggtttagggtagagagcggaagcggtagaacaaggaatttgataccatgagagtgcgatagactcgcaattgattggattgatatcggtgcggagtacatataggcgcgaggctttcgttatccacttaactggattatagaaacaaaacatgtacaagataatatttttctaacaatatgtaccctatgacccagcaacatgactcggagttcatctggtagcgtgctattcatcacggtaagaaagcaatgtatgatatagctagttactccgtgggaattggtatattttcctaaaaaaaaggtgatcaaatcaaatcagcatcggtcaaaccattttgtgatatctcactttcatacatgctcgttggtgtttgggacatataactgttttggaatcaatgccgtttgcccttaatctgtttttctatgatatatgttttatgtctgcaggacactatccccactactggggaaagcctctttgctaatggtttgcaacccttttagtcccgggttgcaaaccaggaccccgaatccggaattaaagataaatatctttagttccggttgaaataatcaggactaaagatacactaaagtttttttttctttagttgttatcaaccgggactaaagacgctaccatctttagtccatctttagtctggacaaaagttttttttcttttttttagtattttttgcttgcttgcatgttgatttccccaaatcaaagattcacagataatatcacaggttcacatcacagatcaaatacatcataaattctcaaaaataaatatattacaaaccacatattcacataccatcatccattcatccaagaacacattaatcatcaacatcacccatgagatctcatccacgaacacaatcatgaaatcaaaatcacaaattatgtacacaatcgcctcatgaacaaaatcacaaatccatgagtagcaacatctgctccgccatcaccacgaccgcctgccccttcgcctcatcctcttcgccactcctcttgttccgagccgccgcggcccggatccagccggattcgcccgcggccgctgctggagatgccgccaccaaatccgctgcaggagggagcgagggggagaggagggggagaggaggagggggcgagcgttgccggtgagggaggcggggggagaggatgagggggcggagggagccgccaccggcgacggaggcgaagggagcagagggagaggagggggctagggaggcgagaggggagaggaggagggggcaaagggagctgcctacgagggtgaggagatatggcggagggaggggacgggcgagagcgagagagagggagggagtttcacgtgtgcgcctgaggagataaggactagggaggggtaacatgcggctgcatttttcttttcaatctttcgtcctggttggtataaacaaaccgggactaaagtgttaatctttagtcttggttgctagcaccaaccaggactaaagataatgggccctgacacggcctgacgactttttaaaccggtactaaaaatgatccttagtcctagttcctatttgaaagtttttgcaccacctagcaaagattagttttccagtagtgtcctgtcaaaagttcactagatagaacctccctgatgttatgtgaaccttttcgttggtttttcaaaagccttataccatgatattctgataaatgaaatgagcaaaggaccatgagccacacgttgaaacttgaagttgaacagttcataaggataaaaaagcaagtgtaatacatatttacgcacaggaacacttcgtaatattaaaagagtacctagtgttaaaataacacagtacaaaatgtaaattcaacatatataaatggtattagtcacttctcaggtacatatattcaggtaaaatatatgtacctgataaattcaacatatataaatggtattagtcactcgtatttaatattcggattttacagttaatatatacccgccaaggataaaaattattaaagagagtaccagacaagaggtagttgtgtggttctatttgacattcagtgtattattcgagaattggtttggaaagccttgctagtaatgcactcaaatcgacattgagattgggacatagccacccaacgattagaccgaccgagggattggaagatctggaactttcctttggccaactacaagcagttgatcaatttcaccatttctttcattcccttttctttttttcttgagtttatgcacgagttgatgccattgctttatttaaaatcagaagcaccaatcatgcatgtaggtatactgttagagtggtggactagcagagatttattaggcatggctcgtatgtatttctcctaaattataagatcttgtccggttagtcaaacaaggcctaagatggaaaaatcaccaacttctatatggaagtgttcagagacgagaacactaatcggagccatcctttcgctcattcgcggaataagcgaaacgacatatttataaacgaaaagcaatttgtgaataaaacttttatatacatgttcttagcgatctaaaaacaaaaacataagcatttaagattgaaatttaagattgaaaatttaagattgaaaatttaaattttagctaataagcataagcagcgaaaagatgagccccatagcactgactgcgtcgacgtttcccatgcgcatggctcgttggccaagaattgcttgtggaatttgtgctgccaaaaacaaaagatgacaatgtcatcttgtggggagaaaaacttgaggaaattacgtgccgaaagcgttcctggtgcttcgcattcccatcaaaatagctcgtaaaatggaattttgtgtttgttttttattaattgggctataaactctatggctgaatagaaatgatatggtttttgacaaatcaccatcaaagtcttatgtggagatatttttcagggcaacgcattggcaccagccatgttgggctccactagtccactacaatggtgtaatgacaatataaagctaataaatgatggatgccgtaaggttaagtcaatggtcatgcagattttctccaattttgggtggagattcacaaataggattcaacggttgtgggatacaaaatcataaaaaatatgatgtgaatgatttacaatggggataattttattttaatatttgaggtttaaagttctttttaattcccgttgcaacgcacaagcattcagctattcaaataaaatcaatagagatcaaccactgcacagttatgcgtgttttcttattataaacatttctattaatctttcaatatatagaacctagacatgagggatggatttcgttgcgcttaaaaaaataaaaaatctgtcaaattataccacttcttgcacaccgcagagcaattctctggcttctatggctagagttagactctctgtttggattgattattgggacagtgaaattgaccatttgattgtactccaaacctaacttattgtttactttaagagaaagaacggcgttttatccttttccatgtcatcactcaggagaccacatgatgtgatcgcagcatgttagataggatgactggatgagttggttactaaaagcaaatgcctcactaattaaagagtcatctttccactactatgctgccaacatgatttggtccataggcaggcatagtacgaatctttcaccttttgaaagtggggagagtcctggtgccttttgataatcagtatcaatggttggatcaaagatggacgtaggagattcatcttttcagagataaactttcagctttcgatctgatccatcggttccttaggtctagcggctgagatgatggagcagtggcaagttgctgaaccaatattggtaccattgcacatattagtaaggcgaagacttgaccacattgtagcatcatcctttttgggtccttagctcagaagcaaggatagctttccatgattccatcactcattaatagctaggtacaaggagaagatggcaaactagagggatcaggagtagcaccagatcacatagaaggtgaggttccatggggaacatcctcaagtgcttcatcagttgcttcgacggagaagacgaagatggtggtagtggccatggtcgcttccccaacagctatcctccggtctcaagtctccattaccagcctctgcatttggatgaccttcaagtgccattatcgcctccaccaccatcaactaggcagcagcagccgccaccgcgaccggcgctctcaagactccattaccagcctctacgtttggctgaccttcaagtgccattatcacctccaccaccatcaactaggcagcagcagctgccaccgcgaccggcacgtcctcttggttaccatcatggagtcctctggccgacgatagagatcaccccatgcgatgacttcctcaacttagaattcacaactaaggtaatttaattataactcgttataacataaatgtttatcaatatacactacggtttggcacctaagaactctgatacttcaaattttgagaaacctatagtaaaacaacctaacatgtggcccattacacatacaaattttcgctgtaccaactgaactaattaaccatgtgttgctaattacagggttgtcacccgatgactttggagtgcatagttttatttagcaagtcataaagtttgacacataaatttttatttataactaaaaattatattcctcaaaataaatagctatcgtagtattctaaaccaatatactagtggaattttcattttatttaattactattgaacgactaaaaggttttcatagtaatgcagtaaaagaagctttaaattgccacttttacctgtgcataaaaggaataaaacgattgtgttgaacctactggtgaagtcataggcagtgtttggcaaatgtctaatggaaattatttcccacccatctttaaatcctaaccattcattctcccctatccatttaatcctaacccttcattcatttcccaatcccaatcccacccctcatttcccattatccaaacacacccatacagtatacgtcacttcagccttttaaaagttttgccctttttattccatacctttgagaattttcttctccccctttgtgaaccttatcttcttattttttttcttttcttttgggatatatttggttagggtatccacaatgtgaccaaaaagtagtccttataactctatatgggtacctttaccattgtgagaggtggcattaggaatagccatatgataagctacccatagctataaagaccacctgtatagattaaaatatactatctctctccttttgcttctttcatgtgagagaactatagcatttggaagtactttttttagtgtgggtcccatcttaatgtcaattgctatctatacacattgtgaaaataggaataacaaaagaccatttatgtgggtcccacctatatggactagttgatccatatacattgttgatgccctggttgaagatggtacggaaggggctgtacttttttcttcttttcatattttcttcttttcataatttttcatacttttttcttctttgtactatgtgccggtacctatgtgtcggtaccttcatagaaggaagatatcggaagataatatcataaattatattaccttttggcaatcttttcaaatgcatattttcgcaagatagggtatttccagcccttaattactcagggaagaaattgtgaaaacaacatagctctttgtttgcatagtggtaaaacatgccccaaagatatgtgatatctatatgttcaacaaatatcaaatgcacatcccactgtcattaagatacatgttggacaataacagaggatacatgagtggtgagtatcagaccaattaatgttaaatttcagaacatatgaacaaagtgtatcaagaattgcctaaggccgtgtttttttgcttattcaccggactatttttttaatgtttcaaaaatacgtttttttctaaaaacatttttcttctatattatttataccaattatttaagctatatggtaaatttacttttaaaaatatttaatttatcactatcaagcacataatgcgcagcaataatccacttaatagaccaactcaatttgggcttaagtaattaacagatcatctagtaaaagaaattatgaggtacgacttttttatgttgttgaagatacttcattttaaatatgatactgttgatttttggacacagcgtttattaaaaaactattctctctgtttcatattataagtccttttaacttttttcaaagtcatttatagagaaacgtaacaatattttcgacacaaaataaacatactattataatataatcaatattagatttaatgaaactattttgatgttgtaaatgctactatatctatcaatttcatcaaacttagtgtagtttgacttagaaaaagtcaaaacggcttgtaatatgaaacaaaggcagaatgtaaatattgtagttactttatttaccattaaaggtattataacaataactttgcatatttgcactaaaattatgaataaggtggctgacatatccaaatgtaatcatcgtcatgtattgagaaatagagggagtaaaactttatccataacttcttattataactttttgttataaaagttagaactactatagcacacccagtacattatataccttatacaacagaccagaacaaagtgagagtgatatatttacttgatatgtgtattcatgtactgggtacgtaaattaatctgctagtagggcgtgtgatacgttataccatgcccactgcttgtgttttagaaggacctttatgaaaatttatataatctaatagatttatgatattatgaaagtatttttcatgacaaattatacattccaattttaatcttttcaaactatgtaatttattatttatttatagtaccttttttaaaaaattaaaaaaaagtcaaatgcaacattcttgaccagacagcgtatttgttctaacaaagggcatcgataagaaatcaatcccaaacacatatactcagtctccaatttgactgagttcaaccatttcttccatatcaagtataaagttgattgatctacccacacatacaaaagaattgccaaaaaaacacataaaattaggtatctgttcaactattcaatgacagcatgcacacaagcgcacatgccccgcgagttggttactttctcttgaattgcagtaagtttaaataatacaaacactaaattattgagtataaaatctctatcttggggcatttgtaacacaattctaggttttataatttggttgatggaagcccagtttcatttcaaaacaagattactttttgtctatgtgatatctttgcctatagtatttctatatagcatatacttatagaaaatattggcaggtttgtgaagggccccagcatcacagtacaccatccaggaagacggaccttaataggtaggcatcagatcctaacatctttttttgtttgattattttttcaaaagctgaaacattggtgacacatacatatatagtaatacgtatctgagttgttttctaattgtttgagaaacaagccatccaacaatatttgttttgtagatctaaggccctattctaacttcataaatatacatatttttcctcgttttccgttagcccgtttttcaaactgctaaataacatattatatgcgaaaactttctatacagaaattgctttaaaatattggataaatccattatcaagtttgtaataattattaaaacttaattaatcgcgcgttaatagttttctcattttgtgtaccgcttttaagtatatctcaccaagctacatagccgatgaggcagcctttcagtggtggttgttgcccctctcttttttttttgacgtgaaacagcaggaggagaggctcctactgcgctctatatatatatatatatatatatatatgacactcatatggggcaccatggtgcccgggcaccatggtatctaatgtacanaatcactcaaattttcaaaattttcaaattgggagtatatacctagttataataattcaattcatatctatacctatcaacaaaacaactcaaaattaactttatttcacaatccatgaatacctacctaactaattatatgtatggatgctatatatctagaatcaaaatctaacaaaaacaagttcaaattcagtacaaacatgctttgaactagttaggggagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatatatatatatatatatatatatatatatatatattaa

SEQ ID NO: 19764 - DNA, 1637 bp, Oryza sativa
cctgtattgcaaaaaaatattatgtttttgattattcttaaggggattttcatttgtggtatttaggttcctgaagggcttgcacagcatgttacatcacctatgcaggcacaggttacatggttaggagaagatccagatttaacagcttctgaacttaattttccattaaccattacattttgtatacataagtcaataattctaaagctgcattgagtcctatagttcaatatagaaatccagttagccacccaaagctgatactctcttcgattgctatcaggtataataccctctttataatatccaatgatttttagcaatggaactatcacaattaacactgctgtatacatgtattttaatgagcacatacacagttttttgaaacaaatttgtactttatttttttggtataaatctatatagcttataaataatgaatttatatcctgtaggcctcgtgatcatctgtaagacatattacccaagccactgtatcctaaacgtagaggtttaaaaattaataattttcattgttttttttaactcggaacaatatgctttagttctattctttgcgaagaacaatattcttagtcaagggccattcagctaaaatttttgtttctctaactaaattaagataatagttttgcacttttacttttgataggtataggaaattgttggccgcatacaaggatattaaatatccacccaaagaatcaccagatgctgctgtgcttgttgctgcccccttgagagggatcgaacgaactaatttggaggtaattatttgaaggtattaggatagtcacaaaatttatctacatatatatgaagcaagtaaagaaatattattcaaatgctagtttctctatttcttagcaactgaagtactcaatctatcccagaatagttttttacatggtctctaacatagaactttttccttttaatttattttccataagatattatgaatgctcttttaaatacgaatctaataatatcacatgcatggcacaaaacattgttagttattttacttattagtcaagggaaaatgttgattttcctaaattatattctgaaaaaatgtctcaattgttggtgatatagtacatgcagatacaacaaaatttcataaggacgttagattgttcgcatttcctgggacatgaaaaaatcgtatggatcttatttcaaaaaaaattgtatggagaggctatacgctataatattgtgcacatttaacaaaaagattgttggtagataaaaaatctattttccctagaagtgtaagagaatgtctaggtttaccattagggcagtattgttagttaaattaaaatcattctttttgtatcaactcaaaattataacattggataatactatcaactcagagaataatctgttaattgttgatgattttctccaaatctggactgctaaagaaattataaaaccagttaccattgttttatttttgtctggtaactgttttactttcagattaacaccacaacaaggcaatgtggacatatgtttaatatattcagtctcctaaactcaggaagaaattaatatttttttatattgtctgttattagaaatgagcatcattt

SEQ ID NO: 19765 - DNA, 8824 bp, Oryza sativa
  unsure (1)..(8824): unsure at all n locations
cgatgtgacggaaaagtgggaagttggtgtgtgtagggaagtttgatgtgatggaaaagttggaagtttgaaaaattattttgaaactaaacatgacgcaaataaattgtagcaaaatccttaatcatccaggatattctttggattctatttaatgtaagttggcataatagttcaacaaatcgattctatcaccatggaaaaaaatgtgtgtttggttcacagggcattcttgcattttatggctttccaattcctacaatctccaaagaggcatcagaaaatcatccatcatcaataccaaagggtgtgctgttcgtgctaaaaacattgccggtcagatttcacatgatatatcaccagtattgagtaaaataatgattctcacaaatctaaacatttatatcaggttaatgcaaagtgcatagtagatggtgatggctttactgcttatgtcgacacactggatcctatagaactgcgtcaggattgcaatgcaagctgtcaatcccgtaactctaagaagcaaaaattgtgggacaaaacagcagctgatctacaaataagtctcgaaaatactggacaaaagtaagtaaactgaactttccttctcttcatgttgcttggaagtcaataatttcttgtgaaacagtacatgttattgatctgggcagaacaaatgcatttgtgtttcagtactatgaaatactcctatggtaaccaatcagcgccagaacaaatgcacatttggctttccatattctgatacatattcagttatgattaagtgggatttaaacttctcagggaaatgaagagagaatatcaaagaaaccaaataaaagtacattagaaatgtgtttatttaactagaaaaaaatacccgtgcgtggcaaaggggaagattattttattcttattattgttatacggtttagctataagataaaattcactgtagtaatttatttggatatatattttttaagaaaaccatgagctgcaattaggattccgacttttatctcaagttagtatttttttaaagagatttcttatacgactcattttgtttttccaaaagcaaatgaacatcaaatccgactcatacacagatctgtatttccaaaagcgagcgaacataaaaactgactcaaacacaaatgaggtaccaaaataccggaaaaacatctttaatttttataatagtagagatttattattttttgaaaaaatacaacagcagaggcttctactgtgatgtatatagaagggcaaagagtttctttaagttttatagaagaacatagtatttcaagaagagactaggaaattatgtagaatatgctaagattgcatatagcttaacattataatattaacttaactaaaaatggtccctacaaagaaaaacataactaaaatgctactacaattgtgaaacaaatactggaacgtaataataaacaacctattctctctctggaaacgtatagaagcagagcaaatttagcactcacaatgatcatgcaaatagagtacatattgaattaattactattttccgtgcaactataaattaaaacttgcaagggttgcaaaccaactcttggtcgtctagtttatttaagtcttattatgctgttgatcttttttagttcacatagaaatttatacataaattcaaatcgctacgtacgagcaggaaaatgttctttgggggccgtgagatcctcgcaagaaaatacgaaataagactgaggtatactctatatgcacaacacaactcaacacagaaattaatcagatatacagtgttaaatttggcattcatattgacaggggcattgatgcaccggagataggcatgcagtatggaaaggagtcgcaggatgcactggtgaaactgatcgctaggaagtgtgtcacgcttcatgtttatgggcaggaccaatttaagcgcttcgtctgtgatatccattgtggtggtgtgttcatccaggtggacacaaagccatacaccattgtgtcattagtcattgattttagtagaacaattttgtttggatggaaacgatggtgaatgtggtgtaatctttaatttcaggagcaaatgctggtgaatggtcatgcctggcacttcaagaactatgacaaacggccacaatttgcaaaggtaagaaactatggagtatatttcagtatattctttaattgcgatattcatatatatattctgttatgtaaatattccgttttgaactttgaaaatgataaatattattagcaacataagactaataaattgttagtcatacttgcagtattgaagtaagggatcatattaccgcacaccgaatcagcacgatttctgattatgtttaacatagtatttctattcaatttatcatatattcctgtataatttttgtgacatcctggcccaattaggatgaggcatgtgttgtccatgtgagctgtgtgcgcatatttactaccacattgctagtttagcacgagtggaaccaacttataaggcatcttccctctaaccatattactctcgagttaaccctttttacacaaagcgatgacaaaagtgtacctggggtggtatgtttaagtgggcccgcccgtcgaatgggctggctaaatcggttctggatggagggttgttacaaatggtatcagagccaaccctcgcggttacgcgtacgggttagtgtacgggcatatggcgcatggttgttacaaatggtatcagagccgaccctcgcggttacgcgtacgggttagtgtgcggacatatggcgcatgtgggctctatatgtgaggcacatggcatggtatatggcgctagcattaacgtacggacgtgccctaagagtaccacattgctagtttagcacgagtggaaccaatttataaggcatctttcctctaaccatatcactcctgggttaacctttagagagggttttttacaattttctattcaaattcaatttatgttgaaatacaacagtttggtgcatcactgcaggttcttttctttccatgttgaatatttggaacataaaagagcgtagttatcttgtacttgataccatgcaagatccagttttaaacagtagttctccatattgaacttatcttttagaaaagaaatttaccatacagttgaaattccaatctcgtttgagaactctatagacatacgggtgtgtgtatttgtgtgcattttctgatgaaactgctttggttacttcttctccctcggattgtgaagtgggaaaaaatggcacgggatgcacgtcaagggctttgggcatatgataaccttgagaagccatgggaatggagaaagaacaagaggaaggcatcgcgacatcacaattcagatgtacgttgatggactctggtcacttggatgatgatcttatctgaaatgacataatttggaattggatctatggttactagacagttagccccagttgagtatgtataaaagtatgatgtactttgtatatagtaagattattaatctcgatctgtattatttataaactaatatttgagtgaagaatgtgtagatgaattatgatatgataccgcttttcaattaaagcggtgaaagggtctagtactttttaactagcttgccttgtttacgcaacatgtagctacataaatactacgggttaattcgttaggattgcagcaaaactcaacaaggccataagattggcacttctaaattagtagtggtttctattttgtagccaaaaaatttgcatgccaaattatttcttttagcccaatgttggaatgcaactctggcagtgaacaaaatgaagcaattgccagttcttgccaaaaaaaaaacttgtggagatggacatccctgcttttttttttgtatggcaagaggtgtccattgccaaaatgcaaccaaatgtcaataaaccaaacaagcccaataagaacaaccaaatggatataggatccaagaaataaccactactatggaaccggtcagctgtaacggccggaactatcatctatatcgcaaaagtgtgtggtcactgattattagtcagtgatgtgaaactctcatctgtgtcagggtagatgtcatcaccgatgatagatctctttatcgggccccaaatcccacccttcaccgatcggttctctaggccgtcacagatatgtcgtcggtgacgggctccacttgcaactcgacaaatgtgttgttgttccctttgttggattcgtttagagcccatcatggatgatcatcggtgactggttccaattgtgacccgacaaaggtgttgccgtcacctttgtcagaatcttttaaaacccgtcacagatgatcattggtgatggatgaggtttttcactcaaaagataaatttattttattggcttatctcacttctagtttgttttttcttttaaattttgtactaccatgtagaaaataaactagcaagcgggtttttatgcgggtagtgagactacccatttgcatcccacccaatcgttctctggaagtctgaaaatgaactccagccaacacatttgttaggaagcatatgagtggagagaagagggataacaacgaatcttgaaaagaaatgagcgaaaacactaacacgaggagtagaagtagccaaaaaaaaagttgttgatttcttttgtacactactacataaaaagggttaggtgtcggttgggaactcgccataggtgttgaatttctcaaatggcacctagcaagtggcacttttgaggttctaggaatgaaaaaagaatgccggctcgaatcgagtagatgcattaggcagctccccttcactccaaccagattacatagaacatttaattcatataatgaacatttaatccaagaacattaagaatataagagcatccaagaacacaagaacggaccgaacactaagaacactaagagtacaaagaacgggccaacatcggggagggcgccacccctgacaccgccaggtggtagagtgccgcagctaggtggggagggccatcgccatcgatgggtggggagaggcacgcgacagagagagaccaagaaagagaggtcaaagaccggggaaagcgaacaagtcctcctcaccttattcgttcgagagaataattacgaacggtcagctcggtttggtttttacaggtgttggtttttaaaaaacaaacacgtataatagattatcgatgttagttttgtaattaacaggtgtttagagagaaaattaaactttgttctctctgtccagggaagaaataaaacatgtgcgagtgtgccgatgtactaagtacacaaataaaatagacaaagaaaaatatattttattataattcttgtggaactacaaaatacaaaatccttagttatttagatattctccacggtcataggcaaggtgtatctgactttaagtgattgtgttctcctgattccaggggtgtcataaaacgcctggttaattactctcacaagttaaactcatgagaagcctccaattaagtcgtgctagtctcatcgtcatcgatcttcgcttcgcattctcctgtatgttggaaatatagtcattaatcggcatattttaatccaaaatgttaaagcaataatcatggcataagcagtgtagggcgatcttaacataaccagtagcatattatgcgcatcatgaatgtcaggaacaggaacatgaacataatagtaacgcatagaggcatcatgaagaacaggaacaagaacatagcgcacatagtatagcgatagcgctaacaatgcgaacaggagcagaagattataccccgagaatggccctccgctggatggtgaggcagaattgcctccgttgttgttgtcgttcacggcacctcctcctggcgcaccagctccggctcctgttggcggcgcaccacctccgccatctcctccagcagcggcggcgactccagacatcgcgatgagcagtcgtgcgggaggcactccccaaaaacctgatcacccgcctacccggtgcagatctcaggcgaaggtgtggtttcggaggcactgctccttccaatctctcgtgcacgcaagagatcagaagcgaggaagcgagagcaactcaggcggagaaggagaaactaacaccgggaaagaagcgatgaaaacggatcgcactcgcggcctccttatctatcaggagaaagaacgtggacgcgctgttgcggagggaatcgtgggaacgtgggttagtggctgcaaaaggatagtgacgtgacgtgacgtgacgcacgccgccagccagccacgccacgcctcgccctcgccctcggcccggcccggcccggcctggcccggcgcgcgcgcgcgcgcgtgtggcaatccgacccccacctcaactggtcaacaaggagtctccaataactccctatttaggttgagatattcctcgcttaaatcctgaggtggtattattatccttaacacttattatgggcctttgagatttaataggataagttgggcatagcccaattattctaacaatccccaccaaatttcaaggctcataagaaatgttctcaatgttgtgcctgtttgatataccagggttttggtggagactattaagttgaacttccacctaggaaatgagctacatcagaccacaactgaacaatggactatgccttgaattgtcagttttgtgtgatcaggtttcactcagaaccttgactggtactgggctgccgttcgcatcccctctgtttggagcatataagtcaaactccaggcctttcatgagtatctagagatcgcccaaacctcatagactgtgactagcagtcgaactcatataggtgtgttccttctaagatgttctgcaggtcaacatctctgcttggaaaagccactcggatcacattaaggcatgagccatcctaccatgcaggaaagaagagaagcacatcatgaaaatgagcccttttcaagggtctcttctctcagtcacacaatagtttgtttcgccatccaaattcacgggatctccgatcacaatgggtatcaagcccatttccctcgatgcactgtctatcacattacgtggtagccccttggtaaactgatctgccagatttctagccgtttggacatagtccaatgctatcactccggagtttttctgttttctgacagacttcagtcttcttttaacatgcctggatgacttcatgttgtccttcgaactgttcactttaataatcactgtttgattatcacagttcatcaggattgctggtactggtttttcaaccaccggcaagtccatcaggaactcacgaagccattcggcctcaactgtcgcagtatctagtgctgtaagttctgcttccattgttgacctcgttaagatggtctgcttgcaagacttccaggaaacagcgccacctccaagtgtgaacacatattcacttgtggcttttatctcatcagcatcagatatccagtttgagtcactatacccttctagtacttttggatacccggtatagtgaattccatagctcatagtgccctttagatagtgcattactctttccagagcctgccaatgatcatctcccggatttgagacaaaccggctcagcttgcttacagcaaatgagatgtcagtcctcgttgcgctagccaagtacatcaatgaaccaatgatttgagagtatctcagttgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatccttcatttcaaaactcttggacagatagtccttgacctcctcaatcacattaaggctggtcccaaagatcaatatgtcatcgacatataagcacaagatcaccccttctcccccaccatagcgatagtatacacatttgtcagcttcgttcacaacaaagcctgcagatgtaagcgtggtgtcaaacttctcatgccattgcttaggtgcttgcttgaggccatacaaggatttcaacagtttacacaccattccctcctgaccttctagtacatacccgtctgggtgatccatatagatctcctcctccagctctccgtttaggaaagctatcttaatgtccatctgatggacgagaagaccatgagaggctgccagagcaagtagtactcgaatcgtggtcaagcgagcaactggtgagtatgtgtcgaagaagtcctcgccttccttttgggtataacccttggcaacaagccttgccttgtacttttcgattgtaccatcaggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19766 - DNA, 605 bp, Oryza sativa
aaactaaatctctttataaatatcaaatagagtactaatacgagtaaagctaaaagccgatatttcttatctacatgatgagactacgactagttcacggttgttgccaaataaggttaatatttacatcacctacgagcaatctcggttaggctacaaaaggctatggtaaatatttggccaggcgacaataggctgagtttgttttcacttttcagaaccacgggtgccatgtcggatccatcatgcacaggttcctcgaagataatgccgcttccacgagatccgtgacgcctctttggaccgactgaggtggctcagatgaattctcctcctgaaatagggagagaaaatgctcccagatgtgaatataagagcaggtaaaatagcaggctataagctagctataaacatattttaaagagataaaggaagagagactcccaagaagtaatgtgtatatgacagataggatcaggtattaatagtatagtaagcaactaatgtatgaattgggtattacattggctatagatgatttggagctagcaattggctatactattaaacttgatctaacttgaatgacttgataatgaatttgg

SEQ ID NO: 19767 - DNA, 677 bp, Oryza sativa
  unsure (1)..(677): unsure at all n locations
nnnnnnnnnnnnnnnnnnnnnnnnnnnnnnnnnnnnnnnagatctctgaccagcacaaatgcccagtgcaaccgcttgagcgttttctaagcgatcgaacagagacaaactaattcgtacggattgaaacaagaatcatcttctgcagactcccagatcccatgaaccaattaaaactcccagagtaattctcaattgaatttgagcaacagggcagctaaatcattgcactactacacagcagccaagaacacgcactccagcgaatcagatccagacacactacaacaaacaaataatcaaaacaaaactacaacaattctaaccatcgaagcccgaatcaaattgcaggaagagcagcgagagccaataagccatttttaccatcagatctggcgcaatgcaccaaggaggaagcgaggacgaggaagcagacgagggagatcctggaatccattctcgccgacacaattcctcgctgctgcagcggtgttactgttgcctcggccggggaggaagaaaagtgaggtgcgaggcacgcaaaaagtatgagaggagtgaggaggaaagaggcgagtttctgtcaccaaccacttctttttaaatttactctttattgaatcttgataatctttactctttccttccgggctgggctaaaaactttttaagtaaaa

SEQ ID NO: 19768 - DNA, 647 bp, Oryza sativa
  unsure (1)..(647): unsure at all n locations
actatagggcgaattcgagctcggtaccctccttttctaatttattttgttttgctttaaaaattcaaattctagattgcgcttgcagcatctagcatgttctcattgatgatttgcattttacaggtcgttcagcagcaaaggatgccaaaagatcttctgcaaagcagtttaaggcccatcttagttaacttagcacatacaaggagtcttaccatgccgttgctccagggattggctcgtctgcttgaattactatcaaactggtttaatgtcactttaggtgctaagttattggatcacttgaaaaaatggctggagccagaaaagcttgcccagagtcaaaaatcttggaaagctggagatgagccaaaaatagctgcaggtctgtcataattttattgcattttcctctctaactatcaatattttgtttgaaagaggacacatcacacgagatttagaaaccagatcttcattcttttcatatattattgtactaatttgatacacagaacttaaacctttttttcgcaaatgtgtaccaaatgatgcttgtgctctcggtatcttccaattttactgtagaannnnnnnnnnnnnnnnnnnnnnnnnnnnnnnnnnnnnnnnnnnnnnnnnnnnnnnnn

SEQ ID NO: 19769 - DNA, 695 bp, Oryza sativa
tgcgatgcaagtcgaccacggattcacgacccagagatccttttaacccctgactacaattttttgccaagattttcctgactcgtatttgcatacactcgaaaaacaatcgcactggttccaaggctaaacatctgcattcatgctctgaaactaaatctctttataaatatcaaatagagcactaatacgagtaaagctaaaagccgatatttcttatctacatgatgagactacgactagttcacggttgttgccaaataaggttaatatttacatcacctacgagcaatctcggttaggctacaaaaggctatggtaaatatttggccaggcgacaataggctgagtttgttttcacttttcagaaccacgggtgccatgtcggatccatcatgcacaggttcctcgaagataatgccgcttccacgagatccgtgacgcctctttggaccgactgaggtggctcagatgaattctcctcctgaaatagggagagaaaatgctcccagatgtgaatataagagcaggtaaaatagcaggctataagctagctataaacatattttaaagagataaaggaagagagactcccaagaagtaatgtgtatatgacagataggatcaggtattaatagtatagtcagcaactaatgtatgaattgggtataacattggctatagatgatttggag

SEQ ID NO: 19770 - DNA, 1824 bp, Oryza sativa
  unsure (1)..(1824): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacatcaggcgctttccatgcaggattcggtctctccccaaaaacttttggttcccggtcaacatcgcatgtgtgctcccatatctacaataaacaaaataacctagttaaaaatcctggagaatgagacaggatgtagatgattaaacgagtgtcttagagttcacaaaagaagacaaattaacctaatgtaactaggaaaagcaccaaagtacctcaatatcaaacatctcaagtgatggtgcagcttcaaggaggtttgttgtccataacaattcaaattcagaaaagatgctatgtatagatagcttccttagattgctgaatgcacggaagagttgttttccttctggctttatccatagctaaaacaagaaacattcacgtcaaaaaaaaaaagaaacattcacgacaaaaatgaaaaaagaaacatgagaattgatgttatgcatggatgagcgtacatttgaattagttaaacaaaattaaggcatgcatcagctttagaaatgcatacatataatcattgaagtattgctacttaacattaaacatttgttcttgctcatgtgaaaatatactagtagtacatcacgaacaactatatgctaatgataacagcagtccatgaaaaaggatggacttaccttttctccttggaaatccaatgttagagtatgtatatttgtagtaccacttggaacctcacttaaaataaatccttcatgtttatttgttgcaccgcagataagagatacttcctgaagattcgggacaacatcgaatgacagcggggcataagggcaaagccaagtgtcccaatttagtcgctccaatttgggaaggcagagcacctcaagtttctccaagcagcatacatcaagttcaagaacaatgatgttcgaatttggtgcacttattttccatatcgcattcttccccacatcacaattggatagactcaggtatcgtagttgattgcagcattcaaacagatgatggtgcaagtcccaacgggcaaaacatagattgtaaagagagagccttgtgaggcgagtaagcacactaggatagccactgaaaaggtctttcacagatgaagcttgctgtagaatgtgcttatcggtgcaatctacaatctcctcctcgtccagaacagaaaggtccatatcttttaaaatgccaacctcaattgccttatcaagcataggaccgacaacacgtgagtaattattgatcaggtaaagctttagttgaaacctattgatgggaaattcgctccgagctatagtcaataagctcctgatccctttggttagagatgccattgcttcatccatatgttcaaccttgatgcggttcggttgtgggacaggtagaaaatccttgacatcaatggtgaactcagggagcaaccaaggcagatgtttccagcgtgttgacaccacacttgtccttacagccgagattatgtccactctccccaagatagacagtaaaatgtcatcagttagcattgagagccgatcctcatgatccatatcctacaacaaaacaaacatcagagcacacatttgtcaaaggagccaacagaatagacattataacataataagcaacaagagctagtacaacttttcttgattctaaggtatgtttaccaggattctttacattataatgaaatattgtgctctaattttttcccatatg

SEQ ID NO: 19771 - DNA, 9716 bp, Oryza sativa
tatatagttttgtgttaacagcctcttcttccaactcagtaatctcaagaacaatcaaattcaaatacaatctcagaaaaatagaagaggaattgagatggaagaagtagaggaagcttctagaagtggtagtgaagaggaacacgagagagagtaagagagggatagagatcgacggggttcaaccgaaccaagccgccgccgccgccgtggccgaagccgccgatgtctcatctgttcgatgcctcgagcagggctgctgctgccttttgtatcctttcttcagtctccatgggctgggcttgtagtatggctaacatagcccatgtacaacccaattgagttcctaacaatcccctcttcttagaattcggcttgtcctcaagccgatgcaaaatattgcagatgtatgtgaaccatctagaattccaatagtcatcttcctgaagaacaaactgatgggtgctaagattgttgcttcgatataactcctttggagcaaaattgcatgcttttgattgatcgttttttgcccagcactcttttggcatccacctttgattggtttggctcttttcatagcactggtccttcctagtcatgccaagcaacttagtatcccatatagccatactgttatatgtaagatatttttttgaaattgcacataagtgtagtccagccttgaaactagatcctctgctcccatggacaacgacaataacactaagtagaaatttccatgtcctgtgtatgagcaggcactgcaattgcttgtgtgtcataagattcagcagcccaattgacttacaaatattcagtgcatgtgcatcaagtacttgagtagaagctgaatatttcagaacatgtgtgttcatctcaagtatagaagtgtcaaaactgctgatcatatttacctcttgcaataagttcttcaccataattttaatttggaaagtcctctcattccttatcagttcaagcaatttcctcatggacccacatcttgctccagcctctgaaacatgtagtatatgtgaaccattcccgatgccaagctcatgcctgacaaatgctcttgctggcctgacaactgtatgcctgtcttggtcactgtacacagtaccagcccacccaaacttaaccatctcatggcaaactagaatggccaaagcttcaagacatgtaaggccaacaatatgccccagatgatagcagtgcactagagaccaactattcaacagaattatgtcaattgaggtcctgttgtctcttggattccaaggtttgcataagatttgttcttgcccattaatatgctcctgcaggctagatactgcaaccattgtgcaactttcctgattcaacaaattccactgctccatcctagcacatagactcattcccactctagttttccagcacttgcattgcgcagcctgaacaaaagtatttctacaatttgtttgatttggtggaggccatggcttcaactcaccacggtgcaaattaatatccttcagctcagtgagaatcattacattaccttgacataccaatgcaagacaacttacttcggtaggtggcagccaaggtggcaaatgatgtacccttgaccaattgagtttgaattctggaccagccataggctgcaaatcccatccattaatcactccatcacaggttggaggtggccatggtggcatcaaacctacacttgtccaaaaggaatcgagtacataccatgggatgtgccacacctcccctcctctaaccacaccacctgaccagggaggtggccaaggatctctcttgggatgccccaccagcaacttcttgatagctttgaggcatttcatcaaacactcagtgggcatcagcttggcaaggtccatttcagcgatcaaccatggcgacaagacttcggatgatgcatcaggtaatacaacaccctcaggcacacccatcatgatctggcatgtgaccctggcgtggtctgcaccacccttgacatcaaggccaactgtcgaacagttggcgggcatcgccttggtactatcaggggtgtcaatgttggtgctgccagtggtgccgtcaatagctaccaactccattgatgacacgacaagggtggcgcaagtaaccacagtagccacagtgtgatcaggcttggtgtcggagctggaacatatcgtcgaacacttggtgggcgtgaccttgggaaggtccttggcggcaatgtaggggacaggatccttgtcctcgacgtccccaagctcgaaggcaaccatcggggcaggtacctcgcggatgtgacttgaattcactgccacccaagtgaagttgtggttgtggcattccatcaaacagttggtgggcgctaaagaaggtgggtgccataggtgtcaaatatgatgcagcgttgaaaatggcggtggttcccttagtgtcagcaatcgtctcctgggaagccttgctctgacgagcctctatgtcgtccaacttttgaaaattttgattaagcttgtcctctggccggcgctggcctgccatttgttcaaacttctccaatatccgatccaaagcttcatctaaccatttctcctctttattcatggtggtattgatgagaacgggctgtgatatcctctgatcttccttggacatcccaggttggcttggcattccatcgagcagttggtgggcgatgcttggatgaaaaccttcccaactcaattcttgctccatcttgcatggctgcctccccaacacctccatgacaaaaatcccagtgaaccgaacggctctgataccagattgttaacagcctcttcttccaactcagtaatctcaagaacaatcaaattcaaatacaatctcagaaaaatagaagaggaattgagatggaagaagtagaggaagcttctagaagtggtagtgaagaggaacacgagagagagtaagagagggatagagatcgacggggttcaaccgaaccaagccgccgccgccgccgtggccgaagccgccgatgtctcatatgttcgatgcctcgagcagggctgctgctgccttttgtatcctttcttcagtctccatgggctgggcttgtagtatggctaacatagcccatgtacaacccaattgagttcctaacattttgttacagtcaccaaccactggaaactaagctaatacagtcaccaacgacaggcagcaccaaccaagaagttcagggaatttcaccaaaataaaaggcgaaatcctaaatagaggcttgctgcttgggttcctaatcatgttctagttgagatcacgcgggagttgttactgtaacaaaatcggtgagcagataatactggtgcctagtggcgaatcgggtcagaacaaactcacattgttgtggctgttatcgagctccatggataatccagccttggtctgattcgcctccccgtgtgatggagtcgatgcggagcaggaggggatgggcgcagaaagagaaagcatcctcgagcgctcggcgacggcgagaccctgagggcgccttgaggctgataagagcggcggcgggtggtcggcaggcgccggtgttgaggagagcggcgccggcggccgccgcggcgagctctcgccggcaatggaggagaatccgaaaaggaaattggattagtgaccttacgttagatattaattacggatctgccactcggttttccggtgggccatagagaggcaagcttatatgggctgggctggctgtggatatatcacaacttcatgaaaagaaaaaagtctgatttgacttcctcaaccattggccgccgaatcttattcgtatccatggactgcaaattaggaataattaggctgtgtttgagggaggggggattgagaagattgggaagatacgtaaaacgaggtgaaccattatcgtatgattaattgagtattaactattttaaatttcaaaaatggactaatatgattttttaaagcaattttcatatagaatttttttttgtaaaatacacaccgtttagtagtttgggaagcgtgcgcacggaaaacgagtcacaatctcccccaatctcttttgaaagaacgcagccttagtattagtagcttctttggacttagctattggtttgtcggaaaagacatttaaaattgtgaagtgtaaatgatctacgaaatagtggtttaggttatcctgatttggcatactagaaaagcaaaactgcaactgctacgatgctgaaataatgattaagattgcaataattcattaaacaaacaatccgtgccgagaaggatgaactcatgcatactgagatgttcatcaaccaatcgcccaaattatgtcttcagcaagtacagcgtcacttgctctctgtccaaattatcatacaaactcatcaatcacgtcagggatccgcgatctacatttggtaaccgcggcttgtgattgattatctggcatcttcggcaccatctctgaattttctgtgtctatggaggttcagacatgacagtggccgtgtttagttggatcaaagtttggattttggttgaaatcagagatgatgtgactgaaaagttgtatgtgtataataggttgatgtgatgaaaaagaactgaaatttggatccaaactttggatctaaacacagccggtgtcactcactcagggtgtgtttagttcgcaaaaatttttaggtgtcatatcgaacgtttaactggatatttgaaggagtttacggaaacaaatgaaaaaactaatttcataactcgtctggaaacgtgtgacgaatttattaagcctaattaatccgccattagcacatgtgggttactgtagcacttatagctaatcatagactaattaggctcaaaagattcgtctcgctatttccatacaaactgtgcaactagtttttttaatctatatttaatgctctatgcatgtgtccatagattcgatatgacgttcttaagaaaaaaaaattgggaactaacaaggcctcactgtggtcacaccaaatccaattcaatgaccgagcaaagtcagaatcactcgccctccaattcaacatctcaaagattgcaaccctgcaatctccggtggtcgccggagctagcgacgccgtcggtggtggtggtggggctccggcgagcagaacgcactaaagaagctacacaactagctccacttttagtagttgtgtgctcagctcactttgatcacttcgtcactgcgcccctttttctctgacggcattgtagcttcttcacatgcattgcactcctctttctcatcctaataatcctagggccttgtctccttcctcctgtccatgcatgcaaatcatgttctgttctgttcgccattgacgatcgatttatcgagagggccaccaagcttctttatcttttttccaagctcgtgcctttcaacgaaagttcagagaacacgatcagtggagcgaaaacaactctcccactctgaccaatcatcggaaaagttcatttttttgatacattaaaaaaaaactagcttaatgatggctttatgatcttatgaaagttactctgaaacctgaaagggggtttgattcctatgtatctatgattgccactgattagctttcgattctttgcttttgtggctgtgtctgaaaagtgttgcaaagatatatcttccaaagctagtagcttcagaaaacacatgacaacgaaggttttttgtttaaaaaaaagttgcaaattgcgatgagccaaactaactttctaagagaaattaaatgaagagccaaaattgagctgaaactaatgaggattccgtagtgaactgtacaccattagtccattacacctaccgctcattcaaagttgcagagacaagaaacacggcaagagagcttttcgattgcttgcatcagaaaccggaggtaggtgtggtcaaccccatattgacaggaagattgttgctccctccgtcccataatttaagggattttaagtttttcttatactgtatgaacactcgtcttattcaaaaaaattagaaatattatttattttttgacttactttattatcaaaagtactttaagcacaacctttcgtttttttatatttgtataaattttttgaataaaacgagtggtcaaacagtgcaagcaaaaacttaaaatcccttatattatgggacggagtgataagtagaaagtaaagtgaccattagttcggtaaaaaaaatgaaactattaatgatttaaagttcagtaaaaaaatgaaccattaatgaattgacagtagagtacgagtagaaaaggtaagggcatccaatcatccacgtgcttgtgcagttagtgcgttgatccataatatcaaagactacagtagtacctgaactgtcccaaatatcataccagtagaagatctgctctcttttttttctttgtaaagatttcttgtatcggtccatgctattctagatgtagattttggtacatgcttgagctgctcgtgattaatgctgaaaaatgtttgttgtaacaatgtacaagttacttaaacctatattggccttagttttgaaatcacaattaaatacggaaatgtctaggataaccgggttttggtgtatatatgcagagcatgaattcattttacaatcaaagtatattgccaataaaatcctatttattttactataaccaaaattattacttcgttcgattccaaataaattgttggttttgactttgagttgtcgaccaatagtatttgaataatctaaatatctagcatcaaaattgtataattagacggggttgtttagattgcaaccaaaataaaccttactaaattttagcaatgccaaaattttggtaatattgccaaaattttggtaggatttcttatatatttatcaaagtttgacaagaaactaaatggatacacatatttgataactttactctaaaaaaaatggtatggtttgaaatgacatcaatctaaacaagcacgtaatctaaagtactttagtaatatcttatatacaaatctatttactcttaaattgcttaaaacataaaagttaaattgcatctatttgggtcaaagccaataattatcacaatccttcaacatcaacaaggctagtacttaatcaattatatctcatatgaactatataatgatattgaatcatgtaagaaacctatcgattctccaccatcgtcaacgtcaggtcccaactgcctctcaacacaactgcagaaatgacaggttcgttcactggcacacaactgcagaagtgagctggagtacacatttctgctgtgacctggtctctatgcgatgctgaaaggaagcaaagaggcaatgcaatgcatctgcatgcattgggattggacttgggagtagtcggagatgagccactgagacagccaggttgcctccgttcgaacgttccgttaagactgcttcttgcctttccaaaatcagctgtaacactttgcaactgtagtgccattatgcttaatgctttccagcatattgtgtctttgttctctttgctcttttttttttaatcttctgaaatgtgtttcatgcggtgtgttatacggctttttttagtgatggataaaccccggccgctgtgtcagaatgtggtcttgttcctaggttcagagcattccactgcacaattatggataagggctcctttgggtgtgtttagttcacaccaaaattagaagtttggttgaaattggaacgatgtgacggaaaagttgaaagtgtgtgtgtagaaaagttttgatgtgataaaaaagttggaagtttgaagaaaaattttgaaactaaaaatttatttataggagtggcaaagaattttgttaggatttaaatttatatggtttttttccctaaatgtttctttggttcatagaaaatgaacgaaactttatatacgattgtattcctatgcttaacatttcataggaaaattatcgagatgtgtgatttttttaataaatttttctttgtttcttccatggtaccaacaaagggctcttatatatcattccctatgttctggattctggtaggattcgagaaccatacgacttcgattttcgtgttgttcaaatcctgcgaatcaaggggcctaaatgatggctgtgaactttgctttgttattgttcctaaaatattatagtgcgatgatgcaatacaagccgtttttttgacaaattgacccttttcaaaaacttatttcgaaactaacccctgccaaaaacttcaaccaaaaataggccgtcgcctcagcgccaaacacattggcgctgacgttggccgtgttagcgccaacgggactggcgctgacattgtgccaccgtggcggccggggccgatccccagctgacgtggcagctacctcagcgccaaccggactggcgctgaggtgggacttggccgccaaggcccagaccagcaagccttctggatggcttgcaggctgggacctcagcgccagccaaaatggcgctgaccttgggaaactcagcgcaagccaacctggcgctgaggtgggacttggccgtttcggccttggcccagaccagcaagccttctggatggcttgcgggctgggacctcagcgtcagcaaaaatggcgctgaccttgggaaactcagcgccagtcaacctggcgctgaggtgggacttggccgtttcggccttggcccagaccagcaagccttctggatggcttgcgggctaggacctcagcgccagccataatggcgctgactgtgggaaactcagcgccagtcaacctggcgctgaggtgggacttggccgtttcggccttggcccagcccagcaagccttctggatggcttgcgggctaggacctcagcgccagccataatggcgctgactgtgggaaactcagcgccagtcaacctggcgctgaggtggtacttggccgtttcggccgtggcccagcccagcaagccttctggatggcttgcgggctaggacctcagcgccagccataatggcgctgactgtgggaaactcagcgccagtcaacctcagagtcagggaacagaatactgccgaagatgtacagcacgtacgccctacagtatcgctgtactgtagcctcatctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggatgtaccggtcgtcgaacagtatgtgggccgtgtgacctcttactcgaagggtcttcaagcgctgcatcaatag

SEQ ID NO: 19772 - DNA, 885 bp, Oryza sativa
  unsure (1)..(885): unsure at all n locations
nnnnnnnnnnnnnnnnnnnnnnnnnnnnnnnnnnnnnnnnnnnnnnncttctcaatacattattgaaactctccgccatattactagtcatgatgctatgacgacacccgttggtatcaaatgctcttgcccatttgaccttaagtggcatatggtcttctacccacttctttggcctctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctatcagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcaaacatacgcctcgtcccaatctccctaaataaccttcatagcaacttgcttagcacgccatgctttgccatacgtaggccgatagtgccatatttgctcaactgcctcgacaatcgctgctg

SEQ ID NO: 19773 - DNA, 539 bp, Oryza sativa
  unsure (1)..(539): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatgatgcaatacaagccgtttttttgacaaattgacccttttcaaaaacttatttcgaaactaacccctgccaaaaacttcaaccaaaaataggccgtcgcctcagcgccaaacacattggcgctgacgttggccgtgttagcgccaacgggactggcgctgacattgtgccaccgtggcggccggggccgatccccagctgacgtggcagctacctcagcgccaaccggactggcgctgaggtgggacttggccgccaaggcccagaccagcaagnnnnnnnnnnnnnnnnnnnnnnnnnnnnnnnnnnnnnnnnnnnnnnnnnnnnnnnnnn

SEQ ID NO: 19774 - DNA, 670 bp, Oryza sativa
  unsure (1)..(670): unsure at all n locations
nnnnnnnnnnnnnnnnnnnnnnnnnnnnnnnnnnnnnnnnnnnnnnnnnnnnnnntgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagcccgttttgctcacggatatcagaccagtcaacaagtacaatgggcatcgtattgcccgaacagataaagctagcatgccaacggtatacagcgagtcgctctttgtggaggtgacgattacctaacaa

SEQ ID NO: 19775 - DNA, 727 bp, Oryza sativa
  unsure (1)..(727): unsure at all n locations
nnnnnnnnnnnnnnnnnnnnnnnnnnnnnnnnnnnnnnnnnnnnnnnnnnnnnnnnnnnnnnncaagctcggcatacaccagaaagttccttcttgagagattgtggaacctcgcctgtagttgcagttggatacttgtagcagcggtgaagcaatgcattaaccacagcaagaagtctttcctcgggaagagtaacaaatcttgatccaatttcagacagtaaaacctgaaaccagcaaaaataaaaatattagcatacttagaaacacaaacaacgaaagttctagcactagattgttgtttcttcatgtagatttcttcaagattctgtaatcccaacaattcaaatcaaatagtccctccagtcccattacaaacaatattagatttgttgtcttgtttgaaaatataaggcatacatttaaatttagtgcaagcctttcccccaagtctaaaagtatcccatcctctcttggactcctttaaacatttatgcttgacaaccaacacataccaccattttcgaagcacttaatggaagggcaataaagtcattctcttatggattcctacttcactttttgtccctggccaaaatatgccttactataagaaccaaagggcactgaatatgcatggaattctgttctcttaaatgccagctttgtacaaaataaaattcctgggcagcatgctaaaaatttctattgaaaaaaggaatgggca

SEQ ID NO: 19776 - DNA, 12355 bp, Oryza sativa
  unsure (1)..(12355): unsure at all n locations
nnnnnnnnnnnnnnnnnnnnnnnnnnnnnnnnnnnnnnnnnnnnnnnnnnnnnnnnnnnnnnnnnnnccaagaaccctcattgatggcggcagtgcactcaatatcctcttcgccaaaaccttggatgatatgcagatccctcgctccgagctgaaaccaagcaatgcgccttttcacggagtaatcccaggattatctgcaactccactcggccagatcactcttccggtcacttttggcactcgggaaaacttccgcacagagaatatcagctttgaagttgccgatttcgagacagcataccacgccatactcggacgcccggcgttagccaagttcatggccgtcccgcactacacgtacatgatgatgaagatgcctggtccccgaggagtcctatccctacggagcgacattaagcaagccgtcacatgcgacaaggagagttgcgacatggcccaaactcgcgagatggcgtctgcccgagaggaaatccgactggctgcaaccacggtgagcgaaggagaagtgcccaccgccaagatttcaaaaagtggggaaaccgaagccaagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgtcgatttgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattacactgatctcaacaaatcatgccctaaagatccttgcgggttgcctcgcattgaccaggtagttgactcaaccgctggctgcgagcttctcagttttctggattgctactcggggtatcatcagatccgactgaaggaatccgactgcttgaaaacttcattcatcacgccttttggggcatactgctacgtcaccatgccgtttggattaaaaaatgcaggagcaacttatcaacgtatgattcagagatgcttctcaacacaaatcggccgcaacgttgaagcctatgtggatgatgtagtcgtcaagaccaagcaaaaggatgatctgatctcggatctagaagaaacctttgcgagcatccgtgctttcaggatgaaattaaaccctgaaaagtgcaccttctgagtaccgtcagggaagctgcttggctttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaactcctcaccaagccaccggtcttagcttcaccacacccgcaggagccgttgttgctgtatgtatcagccacctcccaggtcgtgagcacagtcttggttgtcgagcgtgaggaagaaggccatgtccagaaagttcagcgaccaatctacttcgtcagcgaggtcctcgccgactccaaaacaaggtatcctcaggttcagaagctgttatatggtattttaattactaccaggaagctgtctcattattttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgctagctgattttgtcgccgagtggaccgagtgccaagaggatacccccgcggagaaaatagagcactggaccatgcatttcgacgggtcaaaaaggctttcgggcactggagctggagtggttttaatttccccgactggagaaagactaagttatgtgctttggatacatttttcggcgtcccacaacgtcgccgagtatgaagccctccttcatgggctacggattgcaatttccctagggataaagcgtttaatagttcgaggcgattcacagctggttgttaaccaagttatgaaagagtggtcctgcattgacgacaacatgatggcatatcgacaagaggtacgcaaactggaggataagttcgatggactcgagctcagtcatgttcttcgacacaacaatgaagccgccgacagacttgccaattttggatccaaacgtgaggcggcgccctcagacgttttcgtcgaacacctttatacaccgaccgtgcctcataaagatactactcaagatgcggacactcatgacatagccatggttgaagccgactggcgagagcccttcatacgatttttaacttctcaagagctccctcaagataaagatgaagccgagcggatttcaaggcggagcaaactttatgttatgcacgaatctgagttatacaagaaaagcccttcaggaattctgcaacgctgcgtatctttagaggaagggagacaattgctgaaagacatacattctgggatatgcggaaaccacgctgctgcgcgcaccattgtcggcaaagcttaccggcagggttttttctggcctactgcagtatccgacgctgacaaaattgtgcgcacatgtgaaggttgccaatttttcgccagacaaattcatctaccagctcaagagttgcaaactatcccgctgtcttggccgtttgcggtttgggggctcgatatggtcggcccgtttaaaaaggcagtcggcggttacacgcatctctttgtggccattgataaattttccaagtggattgaagctaagcctgttgtcacgattacagcagataatgctcgtgatttcttcatcaacattgtgcacagattcggagtacccaatcgcatcatcaccgataatggcacacaattcaccggcggagttttcaaagacttttgtgaagactttggaatcaagatttgctacgcctcagtggcacaccccatgagcaatggacaggtggagcgagccaatggcatgatacttcaagggattaaagcacgtgtttttgaccggctaaaaccctatgccggcaaatgggtgcaacaattgccatcagtactttggtctttgcgaactacacccagtcgggccacaggccagtcaccttttttccttgtctatggggcagaagcaatgttgccgagtgaggttgaatttgagtctttgtgctttcgaaatttccgtgaagaacgctacgaagaggaccgagtggatgacttgcaccgattggaagaagcccgcgaagcagctttaattcagtcagctcggtacttacaagggttgcgacgttatcataatcgcaatgttcgatctcgtgcctttctagtcggcgacctggttttacggaaaatccaagccacacgagatcggcacaagttatctcctctatgggaagggccattcattatctctgaagttacccggccaggttcatatcgactcaagcgcgaagacggcactctcgttgacaactcttggaacattgaacatcttcgtcgtttctacgcttaacttcatcattgtatttccctattttgactgtcaacatcaagttttcttcttgccgttgtcagtcgggggctatcatcataataatggagtatgattttttatcaattcagtttgcttacttggtttatcattgccttgtttggtttttctacttagtttgcgaggactgaaagtttttaatagcttctttgggttttaggctcaaccaagcttagcaaaaacttttaagaaatcaaaaacttcgcaagaatcatcaagcacagcataaatacaccagtattgtacaaattgagcctccatgtattacatccaaactcaatcagagtcagtcctttcgtcatcagagtcatcattactcggctggaggtcgttgttgcgaaattgttccacaacatcactcgcaattttgtcagccgcagtttgcgcactactgataagatctagggcagcttcttcacttgtcccgtctgcaaacccatcaatggtgtcgacttcaattctcgggtacaaggattttgtcatcgccaaggccatgccagctcccatgcttccagccttcttgatattcttgaaatatacttccggagcaacactcagcttgtcaaatatttcggttgcgtcgagtgtactcggaccaccattattgaggaacatggcttggataattggtgcagcggcattggcgacgtcatcccttgctccttcaagcctcttgatcttaccaactaggacgtcaaactgagcttgagacttgattttccggtctacaaaacacatttataatcagaatctactgcatttaaaagaggaaagttcagatcatcagccggcagtaccttcaacttctttcaaggctgagtccctttctgcagccagttctgttttgtcttttttcaaggcttcaatctgtttttccatctgagctattctggtggcttgcgctgtttgaaatccaagtgtttgaggatgcaattatgacagcataaatcaatggaacagatctggatgattacctttggatgaaccactcagctcatagtttgaatcttggagctgagcgattcggtcccttaactctttttccgtctttttggcgcactccttggcctcatgcagctggtccctaactgcttctagtgttcccaaatgaggaaccagcttttccaaagttgtagtcttggcctcattgcgaagatggattctctgcatgatggatcatggttcagttctgctaaaaagaaaacaaagttaccgaaggccatcactcggaagacttacgtttacaatacgagtggcttctccgagcgctttcttcagctggcacacttcttcatcttctttctgacggtttatgactataccggcggcttgtgagttctcgtcccaccatttgatcaagataggaggacgagagtcgtcggtcgcctttatgcgagggatttcttctccgtcatcacctgatggtcctgatgtgtttccaagacattagacgggtacactgaggttatttaaatcgccattgtttgagaagacaactaacctgaagatgtgcctagctgggcgtgaggtgatctttgttctttacctgaagacccagctatcgagtcgttaccagcctccggtccttgcgaagtcgtcgtctgcgcttctacttcgggaatctcttgatcagggcctgcgtccgactggtttccagtcgggggctcttgagttgttgccgtttcagttgttgccgactggtttccagtcggcggcgggtcactcggattggctctatcgcacgaagcatgggcgccagtcggctgactttcagcggtcggctggttttcagcagtcggctcggggtccttggatatactctgctctgtcatggcaggatcggggtcttttccagatggatctatatcagatggtttcctgcaaagtgttctttcggtattcagcatcatttttatgagcaaaacatgccgaagcggaatcatatcgagagatctaatacctggaagatgttctgatctttggcattgcacggccggccagttttttcctgggcatggtacgctttgggggtttattaggcgaacctttatccccagatttatcatcgtcgccttcatcatcatcaagtaccagctttctcttgcgaggacctgtttgaccagccaatttggaagtctgaggttgcggatctggtctgattgttggccctccacctccctgagtggtgtgttggcgaggagaccggcgctgagagattggtggatctgacttcatcaatgcatattcctacacaagatgcttccatagttagtcaattcagcatgaagataaaactatgttctgatcatggtttgagggtttccgatgcatacctgtggaggcggattgaatgcattatatggcacgactggcagttggtgagagtagctgactacaattgcatttgagaagattttgtacatcctctccttcatgattttgaaatccaaggagtctggttcttcacggttgggatcatgtttgccgtcgaactcgaatgctgtgcgggatctttccttgattggcgccagtcggcatttgatgaagtgccgagtgatttgctctccctgtaagccttgttctttaaggtttaacatacgatccaacaactccaaggcttgtactgcttcatctccgatcggaagagagttccaagtgtcttggtacattggaggaagacaagagtacccgggaagagcaggctcgggattctgaacatagaaccagttcgcatgccatcctttgttcgaagtcttgaagggcatcgagaaatatttttggcttagagttccccttagttggaatcctgcccccccgactacacacggtttgttcttgtttggttggggtttgaggaagaagattcggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacgatctcatgagtatccggagacgggaaagcctcaccgtgcgctggtcgccacccgatgatttccttggcaggaagaacgccgtgcgccaccatctccttcagattttcttctgtcacgtcggatgtcgcccattggctttcgaagctttctccctcttccgccatcggtttcactcaaatgtgctgatttgattcgagggatggcttgggagaggtgagggattgaggcggtggatcacgggaaggattttgatgcacttttttgaggtggatttggccggagttgtgaaccctagttcgccggcgcagctttgcactgtagcagggagtggggaaaatggcgagagttccggcggggaagacgaagcgtcgcttggatataggatttttcagtttagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgctcaaatcctttttatgcggtcatataattctttggaattattgcaatgcaaattaaaaaggtgcccgacagaaaggcgttatgctatttttgcaagcttttttaggctacaaaagctgtttgggttaactaggaatgacttgtttttattatagtcatttccttggcgtgttatatgcctgttttcacggtaaatagtcatggcctaggctatttgacttttttattaccataatctttataatacttgatgggtaatctttagagtttttatattcggatacctgtcaagtgtgttcattcgtgaactttttagagtgtaaaccactcggatttcttttattatggctaaaaagcagtcggctaacatgcctatttaggcgccgcatacgcttttgtcatataatgcacaactgtgttattattttgtctttcaactatatgtttagtttgttaactaatcacatagttgggggctacacctaattaggtgcatctattcgatgcaccatattctttttcttttcgccctttacagtccacttggcaggttttggcttgaagagttagaagtactcggattattatctttgagaaggctatgatggtcgactgcaaaggactcgggggctactgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacaagtagggtgaggcatagctcctgcagctgctggttgcttgtcgtgcgcgataggaggtccggcggggatcccctgcactcgtcgtgtccggcggaggcggcgccgctggctgtggacgaggaggggaacagggacttgacgttgtcagagactcgatctgcgcccagcgaatgtggaaggaatgagccagcagcggacgcggagctggtcatggcgctgccggtgttgccgaatccgtaggacgtcgaggtcgcctgctcggtggcctctggctgctccgtcgacgccacgtcgggtggtggtggggcctcagcgcagtcgatcggggagctcgtcgatggcggccttggcgttgcacatgagccagtcgacgaccttgcggggctggtcgtagaaccgaatggcagtgtgccagtgtgcgcggcgaggcggatgcgccggtccccgctgcgtgtcccaaccgttgtccctcttcaaggatccatcgccagttgtttactagccgcgctgccgctgccacgaccaccgccgtctccgcggcttcctccagatctttcccatctttctgccaaacaatgggaaaacagatgaatttgaaaaagaagtaactggaatataaaaattactatggacttttttttgtaaaatgagatggtcaatgctaatgtggcactttcgctgaggtggaacaatggcgtggcaacttttgcatcatgagcgcacccacctagccaagtttttgtaccgctacgctcggttttcaagtttttgcacctaatcgcacccacctgccaaggtcttgtaccgtcaacgcaaattttacatgcttgaatagatgtttggagaacctatttgataggaagtctagatatgacacagagaaatttattttgatccatgataaatgaatcgaataatgataataaattatttactctggctacattaaacctatggaatttatcgtaaaaaacaaaattataaattttcctatatgcatatatatcatgttatcatttttttctatattatgcgtatgtatctgcgcattctaccaaatttcttataataatatgttgtactaaatgtcttaggtattaatttatatctctagaatatgcctaattatttaataacattgacatatatgcattttgtaacttatggggttagtttgtagattatattttattataggactaaaatgcaaaaaggtcattacatccccattcccccattgtacctctacacttccacagccctccttttcctttccattgctgtagctgttcctcattcttttttctctcccgctaatctgttatctgtggaggactccagatgataaaatgatgtggaattgtttgaccgacttcctccttttacatcggacggttaatatccattccaccttttctttgcttcttaatccaatggctatgaattaatacatgacgtggctcagtgttgtgaaatcttgaaatttacttttcacaaatgtagatatgcacagtttatagtcgacctttagattcagtcctcattgtttcgcagttcatgttatgatagataagggctgctgaataataacctggtgatcttaaagtctaatcaattcaattgcctgctcaattcctagcttgcctctaaatattttgagagggattaccagggaattgaatgggctgctgctgccatagcatcacaccccaattttcgttcgggattaaaaatcatttaataatttattttctagaaattaaattaaaattaaaagcaatttaacaggtgaatttaatgagggaaataaaatttacttttaaaatcatggctggaaatatttttgtaatattctccatgccctaaaatagtctctagaatttcccgtggatttttggaggtcaagaagtatttttaaaagcacaaacatcacttaatcaattaattaaattgaaaaacaaataaaaatctccttctttctatttgggccatttggactaagtccacttcgcctcccttgggcccgtccccttctctcttctcccggccggcttcgtccctgcctagtggtcgacaagcccgcttcccccctcccttttcctctaagtcgaattgacgtccctccttctttcgtgtcgccaacaggaagagcccacctgtggggctcacctttaacctgcaggcacctctcccgaaactgccggcgttccgtgcctcttctccgcaccccatggaattggtgcggacgcgggtcacctcccttcctccaactttttgcccccatgtcctgcactgaggccctgtttagttagtaaaaaaaaaagttttggctttatgtgccacatcgaatatatagacacacatttgaagtattaaacgtagtctaataataaaacaaaatgcatattccacctgtaaaccgcgagacgaatttattaaacctaattaatcagtcattagcaaatgtttactatagcaccactctgtcaaattatggcgcaattaggtttaaaagattcgtctcgcaatttacacgcaatctgtgtgattgatttttttttctacatttaatactccatgcatatgtacaaacattcgatataatagcgtaaaaagtttctgcgtgagaactaaacagggcctgaatcaaagagaaccaacactatctgtgcttgctgatgcatggtaatgtggactcttttgcggttctatactagaaattttgtggacttgattactacgagaaactttgtggcaagatcatgttatgttgaaaaccatccgtgtagtagtaatttatttactaagagaaatcttgtggtgataccaatacgttaactctaagtaatttatttactaagagaaggtgtacaaaccaattaggagtactactatcctaagtaatttatttactaaagaagagctgagaacgaactaagagtaattcatttactaagaggaggaatcaaattgagaagggttgaaaacaacctgggagtaatacatttacctggtgcagctgacctgcaaagaatgcaaacatcaaaaaagaccagcaacgcataacatggctactaaaagtataattacatccagaaagtatgagattgggcagttagccatgaaagcaagagggcattctagaaattagtcaccttcttttcacccatgctctattgaacatgcaattatatctgtgcttatgttaactttttctgtgacacactagattgaacctaaaacagtatagttaatgcttatgttacattgctggaaagcagcatgagtgaatgctttttaataagtaggctagcaccagattttatgatatctcaggattagatttcacaattattcatcattgttttcatcctgagaaaactaacgagtgaaagaaccttaaacatgtgtcctctcggctctcggccacagcaggaggcatatatgtatgaagcaaaaacatactagtcaataggcattaatcgataagcaataacgcaatcaacagtacggtagaggacatgcgcatggtaagaacgcaatcaaattaggccaagttttagttccaaaatttttcttcaaacttctaacttttccatcacatcaaaactttcctacacacacgaacttgcaacttttccgtcacattgttccaatttcaaccaaactttcaattttagcgtgaactaaacacacccttaaccaaatgatgtaaatactctacaggaaggaatgcccacaatccagcagtacggaatgccacaaccaaattcacacatagccacaaatcaaaaatcaaataaaatctagccaccaagcaagcacacgaccaaaaat

SEQ ID NO: 19777 - DNA, 9876 bp, Oryza sativa
  unsure (1)..(9876): unsure at all n locations
ttgaattttcgatcgttcagatccgaacgtgcggcagcgatgccatcggctcaccgcggcgcacgcgggaatgggcccacctgcttacctttgtgtaattccggtttggctgtgcaggcgcggcaaatatgggaatttctttttactactttactgtagatacatctcagctactgttgtcgctggttgtaaagcagcactacttagtttctaccagccatgttaggggagtttctaccggccacagcttctcagataatctcagcttccctaaacaacccagattatcaaccagattttaaaaatttataattatagaatctataaaataattagaaatcggaatggataacctagcttctctagaaatagggtcttggttgtgttgttcccactcctttcccaactaatctcctcgtttttcgtgcgcacacttcccaaactactaaacaatgtattttttaaaaaagtttttatacgaaaaattcttaaaaaatcatattaattttttaactaatacttaattaattatgaaaataaaccaccgtgtgtttccattcaatcccgaacacaacctaaataaactggtttaattcgttagcatgtaaaaaaagtaaatttcacaaaactacagaatttttatcaaattatcactaaactacatatttagtgtgatatattataaaactacatacttaacactaaatttctcacataactacatctttaaggtggagtatcgtaaaactacatatttagtaacaaaattattacaaaactatatgtttagtgacaatttaatctaaagttacatgtttataactcaaacataacactagtgcgaaggacttaaactctaaaatctatagtttcgtgataactttgttattaaatctgcagttttgtgatactccactttacatctgttgttttgtgataaatttagtgttaaatctgtagttttgtgatacatcatcttaaatatatagttttgtgataatttgatcaaagttttgtgatacgtagttttgtgaaatttacttaaaaaaagtttcaattcgtcgatagaggttccctcacctctcccggtcgcccacattgcctgagcttgagcttaatcggttccctcaccttcctcttctttttctctggaccgtcatagccctcgctcttattgttgtagactttccagtgccactcagtcatctcctacgccggccgccggccctctccccgccaacgggctctagagaaagtgagggggagagatggagagagtgaataggtgggagtggtataagtccatttacatgtgagtattacatattttttttattttttaactaagataccacgtcaaccaaacattgattcgtatgatctgtatgattttattcaacccagttttaaaatatggggttcaaaaatctgattttattctccttaggtttccgccgccaccgctcacggaactacgatccgacacgccctcgccgctcccccgcccgctcgcctgcacacacactctctctctctctcttcatgtatgttgtcggtggatttcccggatcctctttttttttccggctgttcctaagggagaaaacgtgtgattttcggtatcgcgtgagatttaccattctgctgtagttgctagaatgctactccctccatatcaaaatataagtattttttacttctatatagtcttcgagatgttgcttggactaacaatatcttaaaaaaataaaatgttttaaataaaaatgttgcatattatgattgtttgtttaatgataaatctagtaacgtcaattttacatgattgagctttttttctattaatagtcaaagttaaaaatgtttgacttgacaatatgctaaaaatgcttatatgttgggacagatggagtagttgttattattacttactgcaattgaaatgatcataagtagtaggttaagttaagaacaagttggttttgtggttgtatgaattcgttccggaatgtttgggatgccaccatgagcttatcattgttagaatcggactcaacgacccttacaatttacatatcataaacaataagcaggatcgttggtttttccctacaagcattggattttacacttactagttttgttacaaacggcccaacacagattctccatggagttaaacaaagaacatatcctcgtaagttctgctctccagttcccgtcgtaataattatattttttcatttttattaccgatgctttaattcattaatttagcacaatctaattattgtagcaagtggaggatgaagatagactcagcatgcttcatgatgatattttactatcaatcctggggagagttgacatttgtacagctgcaaaaacaagtgtcctgtcaacaaggtggaggcacctaccttggcagttaactaaactggataaccaccgtgtacattgacgaagctatgtcaactctcaccaaagcagcaaggagtctgctagctgtgccgcagagagaaaccttcattacaagtctatgccttaagctctacttgatgggcaattactcgagagataaaggatttctattaagtgaagcgattgatggtggaatagtaaaagatttggaccttgctattttgaacgagaaggaacctgaagattgcgatgacaaagatatgttttgtcaggccagagttctgaaagcctttgctggtgcttttcctcgtgtgcttcacttcctcacaaggctctctgtacaacgtgttatcttcaccgagacattcatcatattctgtttgactgttgcactcagctggacattgtaaggcttagaaattgtgatgctgggtccaatgctgtatggaaaatagatgcgccaaactcgaaactccgacattctggagctttcgttgtgcagcttttggagattcgagttagcctgcctcccatagcttgaggaggtccattgggagatttggttctgttcctatgcccccttgtcatttggcttcgtcccaagcctcagggaactatttcttgcatgtggtgcccaattgggcttcgaaggcttcatgttaagcgaagttttacaaggcaccaaagatttgcatactttgacaatagatttccaaggagaaaaggtaattgaatatgtcattttgatgaatcattattatttttttatactataactgctacagtgagtacatgcttttcattactatgaatctgttaattcagttgtgttggacttttgcacaagtcatgaggatctagcagtagaatgctgtcatagtttcagttggttcagttctagtactacttaggtgcattcaccttcagtttttattttaataaagaaacaacctacttaggagcatgcattcttcattaagaagaagaaagacatctgaatttgagttaaaaggacaccaacctaggtggtgtgctgtgcatctacacctctcagttttggttttaattcctcttcactcaagacttgtaattgtccagaaggattttattattaggaacaaactgagactaacccttgtttgtgcaatcatttaaactcatcggtgtgctttgtttctgttttttttttctcttttcagctttgggtacaacctgaacaaaaacaattctgccctgcattcaacaatctaaagactttatctattctttgtgtttatgttgaatttgacctgttatgggctttaaacctccttgaagctgcgccatccgttgagctacttttcattgatgtaagttttcctttcgttttttcaaaatgtaacaacatgacagtaaatgtagctggaaattctcactatttgcaaaagatttacacaaaccaatttctcacactaaatgcagacctgggaacatatatgcttggtggaccaaatggatgaagagggaagaaaggatatctatggagaaagaacacatccttcatgggagatatccgagtttactggcaccagaaaatggcgattgaaaaaactccagtttgccggctttaggccactcaagcaacagctggtatttttaaaagccatcatggatcttagggacaatatttcatcgccatctcagataattttcctgtgaatcagtagaatttgtgttctatagccgcttcagagttctatatgtaaaaattttactgtgcagcaatgatcagctcttgcatgttaatattatattttaattttgagtaaattgtatgcgatctagtgcaaaaaaattgaaaaatgagcaataccagtacaaaaacttgttcgctttgataagcacatctacaaagcatgcaagtcattgttcaactgcattggttctccaatgatcacaagctgaatacacaccggcagccaactgccaacctaaatatccaaagacatacttcaaatgcatacacttcttttgaacacattgcgtaaggaccattatatattgtagtcaaaggtttaagaaaaaacagtcaaaagaatacgttccgatccatatcctcgtagcaaatactagcaagttgtcaatgagacaaagttcaattcaaatatggacgatccaaaaaaggattacatcaaaagtaaggtacactctctgcagtatgatcaaatctctcaaatcatcagcaaacatacaatgcctaccaacaaaagaatcagttgattgaagggatgaactgaaggagcccagttggagccagggggagcaggggagtaatcacctgaacccgagctcgtgctgaggacaacgaccacccaatctccctcattcgcgatcccaacaccagagaacttggtgtcattcagatactggttgtactgtgacttggtgtagttggtcagaaccacatcaggtacaagtccgggaacgcaggccggcatcacctgaccgtctccggtcaccgacgcgttgagatggcaatggtcgaggtactttgggtagtcggggaactgctgctcggtgccagggacagtgtttgctccggtggtgttggtgcaaggttggtctttgaattgctgtgctagctgctcagccaagcaggcagcattcttgttctcggatagcgcagggactttgagggaagctctgtagctgttgatgcccttgagaagctgtgaatcacttcctggaaatgggaagcagtgtcaaacaaacaatgtaaaacaatgattgtatctccaagttttcctgatttaacagtggaatagtttgcatgcatatcagatctcgaccagcaaaaggtagaattttatcgttcgatcttcagcaaatgataatcgtaataagtactgttaacaaatgacaagtgtatgaataaatgcatctcaataaactatgatacttcatatgtcaccaaaaattttcacttgaaagaattttcattcgaaaccatatgcataaaaactgtgccatatgtacctaaacacatcaactccaatacatagcaattgtgacttaagttactgaaaaattttctccttagcagactaccactgagtcctccccgcaaaaaataaaataaaataaaataaaaaatctaccactgagtcctaaacatcagatcttgcacatcaaaagctggatttgtacgaaaacagcttcccaaacaagattttaactcaaaaaagaggaccaagcaaacctcgaaagtggctcacaaatcatgaccatgtgactagttacatcaaaatgtatagaacaccagtgaccagatctctgaccagcacaaatgcccagtgcaaccgcttgagcgttttctaagcgatcgaacagagacaaactaattcgtacggattgaaacaagaatcatcttctgcagactcccagatcccatgaaccaattaaaactcccagagtaattctcaattgaatttgagcaacagggcagctaaatcattgcactactacacagcagccaagaacacgcactccagcgaatcagatccagacacactacaacaaacaaataatcaaaacaaaactacaacaattctaaccatcgaagcccgaatcagattgcaggaagagcagcgagagccaataagccatttttaccatcagatctggcgcaatgcagcaaggaggaagcgaggacgaggaagcagacgagggagatcctggaatccattctcgccgacacaattcctcgctgctgcagcggtgttactgttgcctcggccggggaggaagaagagtgaggtgcgaggcaggcaagaagtaggagaggagtgaggaggaaggaggcgagttgctgtcaccaaccacttctttttaattttactctttattgaatcttgattaatctttactcttccttccggtctgtcctaaaaactttttagtaaaaagtggtgataaatgtttttattagggtccttattgtatatttacactggcaagataattcgattacttttgtatcttgtaccttctgggccatttttcactggcaagtggtaactttttgggttacagcctagctttagcagttgtagttaatttgcttaaaaattattgtggtcacataacttcaataaattctgaaaggaactgtataacagtttttatttattatatatccaagtcaccttcattacattttttatatatttataaataaatagtgcctaaagaaggtctagaaatagttttgttcctcatgtgaaaaataattatccctagagtcgactgcaggcattagatgctttagtagtcataaatttccctgtataaaatcacggaaaaattgtgaatgatgcataaataacggtaatgatgcatgcgctgagtacattttatttatttatacatacaggtcgatattcatatgaaggaaatacaaatacaataatgtagattctgagaaaaaatagccccttatttcacctgactataactctataagttataacacttattagcgataatatatatatatatatatatatatatatatatatatatatatatatatatatatatatattcttaacgatttaaaaggttgtattgaaaaataaactacgatgaaaaatatcaaaatcaatttaaaattaaattttaaaatttaatttttggttatggctacgagctatttgtgttttaagttaatacatgtttatggcatggtggtcgtatagtactccctccgtcccaaaaatacttaatgagaagtggcaatgaatctgaactaccctttattcagattcgttgttctagtaggggtcacatcccctcgcttgagtttttttcggacgaagagagtatgaccctgtttagattccaatttttttcttcaaactttcaacttttttcgtcacatcgaactttcctacatgcacaaacttccaacttttctgtcacatcgtttcaatttcttcaaacttcaaattttagcgtggaactaaacacaacctatatttgcatgggcccacccccattatattctctgtgcttataaaacaaacttcatatactctacgaaaccccaagctgtcggtgtttctcaagtagttgctacaacgtgatcatctgagatgcggccacaaataacaaatttattcttatcaggaaaagaaaaaagaagcattagttgaattaagccatggacaacgtgaaacaaataaaagaagaaaggtgcttggtcgatgcttttcatcatcaaataattaatttcgctgcgtgtgcgtcttctccggttggtcctgcactgacgttaaaaaggttggtgtagatgatgatgatctgtgcagcgagcgagcgaacggcgggacagagagacagctcaccgtgtggcgacggcgatggtggaaccgacacagcgtacgccaacactcaacacgacgcggcggtgggtaatacgcagcgccagtgcactacgtacgtaccttacctcattgtttgctaaattttaatttcagaattgattttaaaatttttttaatgtagttttaaaatattagtttcctgaccacatatttacccctatattataacttataatcagctcttaataactaaccaatggaagagtgaatcactgtgcagtcgcagttgagtcacttacacaggacatttaaactatttgccacctttaatatgtgatgtttaataatttattactcacaatctatgacgtgcccttttacatatctacaagtacgtagtaaattgttaaatgtccacttacatataagccccgctctaacttttgtgcagttttcgacatttcctgtgaatattataactgtaaactgtgtatctctataactgtgtacaaggaagcctcacccaacaatggagttgtggttcattttagcaatgaagggcttttagtacttccaattctaacgcaacatattgaacgcacttaactgtatgaatatatcggacgcactcctacatcccgctgcgatgcaagtcgaccacggattcacgacccagagatccttttaacccctgactacaattttttgccaagattttcctgactcgtatttgcatacactcgaaaaacaatcgcactggttccaaggctaaacatctgcattcatgctctgaaactaaatctctttataaatatcaaatagagcactaatacgagtaaagctaaaagccgatatttcttatctacatgatgagactacgactagttcacggttgttgccaaataaggttaatatttacatcacctacgagcaatctcggttaggctacaaaaggctatggtaaatatttggccaggcgacaataggctgagtttgttttcacttttcagaaccacgggtgccatgtcggatccatcatgcacaggttcctcgaagataatgccgcttccacgagatccgtgacgcctctttggaccgactgaggtggctcagatgaattctcctcctgaaatagggagagaaaatgctcccagatgtgaatataagagcaggtaaaatagcaggctataagctagctataaacatattttaaagagataaaggaagagagactcccaagaagtaatgtgtatatgacagataggatcaggtattaatagtatagtaagcaactaatgtatgaattgggtattacattggctatagatgatttggagctagcaattggctatactattaaacttgatctaacttgaatgacttgataatgaatttggacttgctaatgttactatccaaaatggttttccagttgattgaagatagcaatcctaaaacatagtactaactgatagtaggtgcgcaacaaggtgaaatcagtagggaatatagtgcagtattggagcattgctatcatgtgaaattgtctaactaggaacaagcgagtgaaacacctcggcttgctgaatatttcactttgtgcataagtggcctctccaaataacaataactaagtaaagaaaggattagcagtgatagcattatcattttaaaagttaacggccagctagggaaataagcatgactgaaatcggaaaaaatgatatatccagagaaacaaaaatcaagtttaaagaaatagtttacctcatcagcaagataatgtggtgatattaatttgatacgggtaatgacatgctccacattgtttatcaccttttgctggaaatccaacgggttaatcattccagcagcaactggaacagaaggaatgccaagtggcctcctccatgaccaagataacagttcatcacggaaaaacatagccaaatggtgccatatatgctggctttgctgaaaatcacaaagaaaacaatccgattacgtaggaaaaatagaaagatgaaccacaagggactaatattaannnnnnnnnnnnnnnnnnnnnnnnnnnnnnnnnnnnnnnnnnnnn

SEQ ID NO: 19778 - DNA, 1599 bp, Oryza sativa
tgaatatttccccttgtgcataagtggcctctccaaataacaataactaagtaaagaaaggattagcagtgatagcattatcattttaaaagttaacggccagctagggaaataagcatgactgaaatcggaaaaaatgatatatccagagaaacaaaaatcaagtttaaagaaatagtttacctcatcagcaagataatgtggtgatattaatttgatacgggtaatgacatgctccacattgtttatcaccttttgctggaaatccaacgggttaatcattccagcagcaactggaacagaaggaatgccaagtggcctcctccatgaccaagataacagttcatcacggaaaaacatagccaaatggtgccatatatgctggctttgctgaaaatcacaaagaaaacaatccgattacgtaggaaaaatagaaagatgaaccacaagggacaatcctaatattaaccaagacggaaaacaattaacagtaggagtactatcattagcgcatcctactataattcactctttaaagaatgatactcacttttggtgaaaccacagactgggcagcagaacacatggcagacacaatgagaccttcaacaccgaaatttgagaagaaagcttgcatattgcgtgtcagcctaaagggaactagctcattgaactcaatcattccatttggatcataagctgcagataagcaaatgtgagtaataataatttcacgtgcattatttacaattactggtaataatcaagaagagtacctggatggaaatcattctggaagatcttgccagtatttttagcaaataatattttgttaggagccctaccaccaatctgcaacatgtacgacatgaaacaggacagagccacttggattgcaaactgtttcttgaaggtccagaggtgattcccagttggtagaatcttatgcatgtattgagagaagatattatcattaacgatatttttagtaatttcattataggcttgcaagcgtaattccaccactgcttcaggggacacctgccctgagatggcttgatttagctgttctttgaaaattgtaataggtgaatcagcttctctattatgtcgggcacagttaatttcatacacctccaggaaagtgctgtacatcaaatcatcctctaccatccgaacctggatcaagggaaattaaacataaggccaggatattaccttggaagctgaaataaaacagctaaacatgattattatcaggtatggaagaatggaaggtatttcacctgtgaccaaacaggaataatgattggggtgtgaatagcaagatggcgctgcctcgactctttatgtttgtcaaacattttgtttagtacacggaatagctgcagcattctctcatcactccgggcatttggagtcaatgatgtctgaacaataaaatggcgctgtgaaccatcagagccaataagtgtcagacgtcggaagctactaccgtgcctccggacaataggaatatcaggtccaactctgtccaacttgacagtatgatcaggtgcaacctcctgcaaaagacaagtaaaacttaaaactagcaca

SEQ ID NO: 19779 - DNA, 1108 bp, Oryza sativa
  unsure (1)..(1108): unsure at all n locations
nnnnnnnnnnnnnnnnnnnnnnnnnnnnnnnnnnnnnnnnnnnnnnnnnnnnnnnnnatcactccgggcatttggagtcaatgatgtctgaacaataaaatggcgctgtgaaccatcagagccaataagtgtcagacgtcggaagctactaccgtgcctccggacaataggaatatcaggtccaactctgtccaacttgacagtatgatcaggtgcaacctcctgcaaaagacaagtaaaacttaaaactagcacatagagaggtgaggaaccgtgcgagaagcataaaactttcacaagactggctaaccatccatatggtaagagataatgatgagtgacatattgacttcaatactgaggataaaaggtaatcactgtgaccaacctgatctgtgaagtactgcccgggaagttctatatcaacaacatggaagtccctgagaattttactttcttcctctagctttaaaattgcagggaaccgatcctcaacattactctgaagaacattcttccagtgcttcaatctctcagtgagttcagcaagtgttgctggaaaagtagtagcactttctgggtcaagatcacgttcaaaatcttgcttgtactccttgacaaaatcaacatgcttgttaacagcatcttgtgaaaagcaagctcggcatacaccagaaagttccttcttgagagattgtggaacctcgcctgtagttgcagttggatacttgtagcagcggtgaagcaatgcattaaccacagcaagaagtctttcctcgggaagagtaacaaatcttgatccaatttcagacagtaaaacctgaaaccagcaaaaataaaaatattagcatacttagaaacacaaacaacgaaagttctagcactagattgttgtttcttcatgtagatttcttcaagattctgtaatcccaacaattcaaatcaaatagtccctccagtcccattacaaacaatattagatttgttgtcttgtttgaaaatataaggcatacatttaaatttagtgcaagcctttcccccaagtctaaaagtatcccatcctctcttggactcctttaaacatttatgcttgacaccaacacatacc

SEQ ID NO: 19780 - DNA, 9081 bp, Oryza sativa
  unsure (1)..(9081): unsure at all n locations
nnnnnnnnnnnnnnnnnnnnnnnnnnnnnnnnnnnnnnnctgaaaccagcaaaaataaaaatattagcatacttagaaacacaaacaacgaaagttctagcactagattgttgtttcttcatgtagatttcttcaagattctgtaatcccaacaattcaaatcaaatagtccctccagtcccattacaaacaatattagatttgttgtcttgtttgaaaatataaggcatacatttaaatttagtgcaagcctttcccccaagtctaaaagtatcccatcctctcttggactcctttaaacatttatgcttgacaaccaacacataccaccattttcgaagcacttaatggaagggcaataaagtcattctcttatggattcctacttcactttttgtccctggccaaaatatgccttactataggaaccaaagggcactgaatatgcatggaattctgttctcttaaatgccagctttgctacaaaataaaattcctggcaagcatgctaaaaatttctattgaaaaaaaggaatgggcaaagaaagaaatggcttattctataccattgtcatacacgttggcctgtatgtatggtaagactctaatttaataaaaaagtaatggccgtagtcatctccaatttcctaaaggtttataaaccactttgttattacttcttacctcaagctcattggctagattggtatgcttgctcctaagagcttccattatatcctttgcagcatcaaatgcacttgctgcagaagttacccagccaagtccattattgcgtcttgctggcatttgcgaaccatctgcaccagttgaactcggttgaccttgatcatggccagcgcttgtaccaccctcaacattagatctgtctgactcttgtccttggagattacccccatcatgagaaactgccgcaccacctgactgggtagcttgatgaacttggttgtcagaagtcatgttcccacccccaagattagatgtcctcgcgttcccttcagataagttattggcagcattgtttgccagcatagcctgctgcatacgctgctgagctattcttcccatttcagtttttgtagcaacatcacgacgttccatcaagtatgtccgaagccaataatacaatgcctgcaagaaaacctctcagatatgcacatatacgagacaagaatatgcatcgtcaagttcaagaaatcgatatgaaaaaatgacatcacaatcacctgtggataaacttgggctattttcagcaaaactaatttgcagtgttgggcttcacttctctgtaatgatagcaataactgaggtatccacgaaagccaaacccaatggggcaactgctcaagatatttatccaaagcccttccagcaggttcattttgtgtatcgaagctcagaaggtagagaattcgtgcaagatggctccttgagtttgaaactccatatttgatgccttggaagaaacaacttacggcatactcaagccaaatctcatcttttgtctccttgaaaacctggcaacacacacacatcagatctggatgatgaagggatattattaagagcataaaggataacatgcataccatatcgcagtaattcccccagctaatccatgcttttggcaaatgcttaaaaagtgttatagcatttgaataagcaacatttgcattctcgcagtcattcatttttagcaggaagtcacctctcagacgaaatatttctgctttgttcttcacagggaaaaattccaaattggtgttattgattaagttaagaccactgactagttcgcctttcatctctaagtatgccttggcttgttcacatatcttcacaaatgcttcctgtaatcagattagaatgcaaacaggtaaataagatgatattgaacgcacactatgcagtactaaaaatttgatcacaaaggcaagtcacctgaacttccatggtagcatgaccatacatcttatcgagtatagttacacaaacgtcaggaagaccttgtttgcgagctatgtgagcaagcttgttcacattccaagctttgtctcggtaaccaagatgatgaagttgaggatttgtttggccaaaatctttgaatgcgtctattactgaattgtacatctcattcctccactggaggaggtcataccaaacagtcatattatcccattcattaggagttcgaagtctccatgtctcaagaatatccttgaggtcagcaaaggagttgtgatgattggaattggcaccagaatttcctgaagctggtttgttcccatttgcaatgtcaagcagaattttagaggattctttcacttcaaccaactgctgaaactgctgcagcagaggcattcgggactgcacagacatttcaggtaactgccaccattgttctagtgcaagttcaacacctttgctgacaaggttctcagcttcaccaacaccattagtacctttgtcatgaagagtgaaaaatgattgaataaggcgtaactttggtgtctcttctacctgagcttttggaataacattctccttcatatatgtccagtcaggcgccttccaaaggcagtctaagagaatctcgtaattctccacaccttttccaaaatcagccaatacttcccactgacctaattgagtggcacaagacaaccactgttcttcccaaagacacatttcagccttagggactgtgttattatatgtaccttgagttgcttttatcattgcctggtaaaagagattttgtgcctgctgccagtaaccgtgttggacaagtgatagcccagctctagtttctgctgtgattgatcttctcttccataatccatatctcatgtcatcctcattgagaagcctgtataattcagccagtgactctgagcatttggcctcattcatatgcatcatatggctctcgagtaacgcaatcgaagtatgccatgcattgcaggtctttccgatatatttgataagctcactaggcatgcgcggttgaggatggctcaagtgaagaccttcaaggagtgcctgggctacattaggtctgcatccttgctgcctcttatgataatcttttgacagaagcgcaattattggcttagcaagagcaacttgctcctctttgtgtaaggttacccaaacaattgggaatacaagaacccacaaatgatatgcgacgttgggatcagcaaatgcaagttccctcaatggagccatgacatctgccacctacattattaacaaagagtacatatgggttatcaggtcaaagatttcatacaaggagatttgtcataaggaaccaggttattccatttctcatgagcaaaactaacaaattatccatatgcagcagtaaaatgaaaaggcaacaaacatatatggtatgaggcagaaaatactagcagcaaagtagttttgagcacaggtatttaccacaagcttgcttgcctcatttaaaaactgagcatgtcttgtagtcagagaatcaaacgataaagatgtaccatccaagctttcctgagcatcaggagcctgttgtggcataatcatgcgatctgaaactggcccagatgtcataagtgcaggaactcgagcagaatttgcagcgagtgtaattggctcattttcaactaatattgccaaaataagatccaggccttgcttcaaccagaaaacatcactcactgcttcccagtcctgggtctgtattataaactgcaatctagcaaataatgtttttccgacatagtcatggtaaagtttgaagaatcgcttcctcatttctgggtctttagctctaagtccaagcatgtattgcctctccaccttatgaaaatactcttgcctcaaagccatttgatacctgcataaaaagaccgtcaggaacactacaagatactaataagagcttgctgtatgtatgtacttacttagctgtatctccacagagtgagtaaagaagttgcaaatattttgcatcccattcttcttgtacagatgggggaaagctttttctgtcaactactgataacttctgaagataagctattatctcctttggattaagtgaactgacagagccagtagatgaagcaagtctgtagtcatcctcaatccaagcttttatcatgtccagtatgcatagaagaacgctaggatctgtgcctttttctgaaaggagtgcttgaagtgtttggcccatagatcgcctgaactcagaagaggccatcaccctctcacttatgagttttaagacggtcttcatgttagatatgaccatagggtctactgtggggcgtgaattaactgatgaatcctgttcaggcctctgtccctgagattatgccaggtcaatgccaaggtaaatggaccatcatgccaaatggaatcttgccaaaacatttactcatggtgttgatgatcaaatcacatagttaaacactaacaaaaaaaacatcctagatgtatctgtggatttttcatcttaaaaatagtaaacagttcaaaatgataacttcacataagaacctaacttacctatagataccaagacagaacaccaggttaataataatcagcacagtgaaaactagtcaactatacggatcaacaaagttaaataatatagaaatactgtgcaaacatacttgtcgaacatggttgccagcagaagatcccatgtcacgtgcaagacgttgcaggactcgaagaagcaaacctatgaacggatcaataaaattcttctgtacttctgcgagtgcgttgaggacaaacagtgcaaagcttatgatagagttagcattgctaggttcaagtgatatctggggagtggttacagcagcaagatgcttttgaatgagatcttgaactctttggtacaacaactttatatcttgtggtgttgtagctgcttcaaggggaaacgcgctgaataccatctttagcaatgaacaaagagacttgccagcatccaacattttgttgttgaagcaaggttccagtatctaaggaaaagagatcccagaatgtatcaaagagtcaacgtaagaaatatctgcattgatctccataaaatacaaatatagcaaaaagactaatccagagaataaggttcattcaagtaacttacttgagaaatatggttgatgttattccggatgaagaggcggggttgcttttctaagactttgttcataacatctaggccctgagcaagtgctgttgcaggatccttggactgagaaggtgtcaaattcccaagcaatttctcaagataattaaatttaacattggcatttggccagacttccaaagcttgagtcagtagatcaagagcttgcttgtacattgagctagattccttatcctttggttcaatcaccagcgacacctgttcaatcaacaaaactatatgagtattcaagacctcagatcaaaaaagttctgctgaagacactagtaaggtggcacaaagtgatcaacattctcattatatcagaaaggttcacatgagaggatggaaccactaataggaatgccttgtcaatccactactgcaatcaaatgttacactgtgctttgtctcttttcaggagaaaaggcaagccaggccgcatgcctcaaaagcaatcacaatgaattaggcaatgaggcaccaacaacaaaagcaagtaccatcagaatgtccagtattaattttttttaagaacattatcatgaaatctaatgaagcaacttgtaaaatttagagcataaaaggtaaacataaaaaggataatcacccttataaggaatgtaatgatcatctcctccatagcagcgttaggtttgtactcctcatctggttgcccggaagacccaggtgtctcgatattaggtattgatgcccccccaggcgacatcacgcaaaggggttgcaaccctggttcaactttcaccctcttactcaaatcatcaccaaatgtgggaacatccgatgagcgttttggatcaccgccaataacaggactaagcatatcaccaatttgactcgtgttctcactttcctgcacaactttcatctcactttgtctctgtctttcccacgccaccaccagtccagcaagttcaattgccagtcgtctattttctgctgttgtgttgtatggtagtccaagacggctaagggagttgaccatctggggaacaaaatgggctctgcaactgtagaagaggtctgcatgacgaacaataagctggaatatgtgaatcatgttgggaattgaatggccttcctccacaaggattttcttggtgtatctaatccatattggcatgcggctgtcccctggagggagtcttctaggaagggcaggcatgaggatgtcaagagcttgcttcaccagcagcttattttctggttggcatgtccgcagtagagcaataaaaacctggggaaataattcatcatattggctagctcggtgcaatgacctggttaaatgcacaattactcaggaagaatttaatgttatactacctgcagaataatcttttcaggagcttgataggcctctaagaaatgacacacgttcacaaaagcccattgcttgctggaattatcttcacgtttgagatggttccaaccgaactttatgagttcctttcgatggtgaacaagatcgctctgtagatacttcagaagtaatgttgcaagctgaaggagttctatcctcaagggttcatcatattcagcactgacctaaaaatatatacatataaaaaagcattgctgtcatggggaagtaacaaagagaaggctgacaggtattaaggtagagtggttcacttcccacctcttccggaggatcaagaagcttgtcaacaatagttttaataatagatggatcaacaacttcccaactttgcccattttggaaagaatgagctagcattggaaggataagtatctgcatagcaacgactaaatgatcttgtccataatgctttgactggaatatgttcagaaagtgattaagaataattttcttcaaatttggtgcatagccttcagcaacctatatggaaaatgtaaaaatggtaagaaacagaaagaactggagagcgacacaagtaactgtcatgaattagaaaaagaaatggtgtcacctctataacataaaattccttaagaaaactataatcaatgcggctacggtacaagaatattgatagcatatcaaatagcgcaccaacttccgtacgatcatgccttagataatttaggaagcattttatgagccgcttgctttccatcacctgttcagaaagtaagattgttaagatccaaaggtctagacacttgattagtgcagtatggaaagatgcaaggatgctaagaaactttaataaagcaatttattgagatgtaaagcacagataacatgtacgcatcatgtcagcaaaacctaaatcattgaattcaaagaaatcaagcgcataagagaaaataagcacccatactaccggacagtgtttgcccattgaacagaacatcataaaatccagaatgataatcctactagcatggcagagataacagtatataacagatagtagcagtagtaaacaaagatgccaaaatttaaatatcatgattccccgaaataattctatataaagaaccaagtatgcaacttgtccatcaactctaaatatcgcatcatgaatttaacatggcaattaaacaggtgaaagaagataaaaattacgtaatcggaacagggtagcaatagaaatacgtaaatctacgtaattggaagtaaccaattaggttaactatggaacccagaaatcgatcaccgatcaagtaagttattcagcttgagaactactataatttgttacccggataaaggtcactagcaattgaagagcagcaacaagagacaatacaaaaacacaaataaacgggcaatttacaaaggcacccaaagagaaaatgcaaaatgagaaaaataaaaggtaagtaggaacatcaatgactacctgcggtaaactcaattcctgctcattttgcaggcgatcaattcttgagggtgatttccaagcaagcaacaaagtgtcaaagacaacccggttgttacagagccattcaggcatcaattttacaagggttgaaataagttccagtccattaaagtaactgtcagaaccagtagccatgtttgatgatgattggcctgtaaaaccttcagttatggcaccagtaagtccctcatccttcactgaggaagattgattaccagcagcttcagtttgtgaatagaactgtgaaaaggcgctagcaagtattttttgaggcgattttgcaagctggtcccttaactccccagtatcagagcagattatgtacatgaacctgaaattttaaaagggaagtataatcagtctctggacatgtgtagatctgggtgttcacatgttcattaaagtataactttacagaacaagaagagcaagctagtgtgccacttatactacagtatgcatcaaaaataataacagcagggctcaatagctagtctcataaatcccaaggtatatgttaaaaacataaccagaatagcagtaatgatctaatacagactaaaagggaagtacactaatgtaaatgaacagcatgtgannnnnnnnnnnnnnnnnnnnnnnnnnnnnnnnnnnnnnncacaaaagtttcacaaagttgcagctaaacaaataagactaattttggtgaagtgcgtaccttctgaaatactttggatggcttaatcgagcaagaaaatagtcaacggcctccacggcatagcggttcaaaaattttgcaagtggagcacgataaggactgttgatttcactataaaattgatcttcaggaagtgccctctctagagtcaattaccaacgtaacaaggtcatccaaaaatttgctcgccgccgggggaagaaggtgaaaaagctcaatcatagctgcccaaaaaaaatagannnnnnnnnnnnnnnnnnnnnnnnnnnnnnnnnnnnnnn

SEQ ID NO: 19781 - DNA, 9926 bp, Oryza sativa
cagtatgcatcaaaaataataacagcagggctcaatagctagtctcataaatcccaaggtatatgttaaaaacataaccagaatagcagtaatgatctaatacagactaaaagggaagtacactaatgtaaatgaacagcatgtgaggctaactgaacctttttgtaagtcttgcacaaaagtttcacaaagttgcagctaaacaaataagactaattttggtgaagtgcgtaccttctgaaatactttggatggcttaatcgagcaagaaaatagtcaacggcctccacggcatagcggttcaaaaattttgcaagtggagcacgataaggactgttgatttcactataaaattgatcttcaggaagtgccctctctaaatcaattaccaacgtaacaaggtcatccaaaaatttgctcgccgccgggggaagaaggtgaaaaagctcaatcatagctgcccaaaaaaaatagacattagttatataaactcctgactccaaccaaaggcaacatacaaagacgacagcaattggtcattttgatgtctgtaaacaagagaaaaattggacattttgaaccactttacaacaaggcaagacttgatccatttcatattatctagctcctataaatataagttggaggtgatggtacatccacctagatctttttgcgaatggatatgtgcatgcatatgtaaatccacctagatcttctatgaagcatttctacagtaaaattggaagataccgagagcacaagcatcatttggtacacatttgcgaaaaaaaggtttaagttctgtgtatcaaattagtacaataatatatgaaaagaatgaagatctggtttctaaatctcgtgtgatgtgtcctctttcaaacaaaatattgatagttagagaggaaaatgcaataaaattatgacagacctgcagctatttttggctcatctccagctttccaagatttttgactctgggcaagcttttctggctccagccattttttcaagtgatccaataacttagcacctaaagtgacattaaaccagtttgatagtaattcaagcagacgagccaatccctggagcaacggcatggtaagactccttgtatgtgctaagttaactaagatgggccttaaactgctttgcagaagatcttttggcatcctttgctgctgaacgacctgtaaaatgcaaatcatcaatgagaacatgctagatgctgcaagcgcaatctagaatttgaatttttaaagcaaaacaaaataaattagaaaaggaagaaaataaatattctctgaaattccatgtcaatataagaaagcaattgcagtaaacaccacctgacgaagtccctccttggcaacattgacaatctctgtagtcctgcatgtcagagatttgaagaacattgagataatctttgcacgtaagtcgctatgatttggagctttcagatctccccatgccattgcagtacagagtagttcaatgcatgccgtcctcaatttgttccatgtcataattatttttgcattcatcatcttggtgacccaaacagtctcatcagcctcagcaatttgcagtgcttcttgcaaaaagttcacgagctcaggagacaacttcagaagaggtggtcttagtgctaaacagaaattcaatgctgtaacagtacccacctgagatagaaaaaaaaataagtaaaggatccatcacttatatcatgaacatagaaatcctcagaagttaaaacataaaatatatatcttacctgctgctcaatgttcttggaacgcaaagatcgtgaaatcagaggctggagcaacgggaggtacagaggctccagcaattcagagacctcactgccagttctacttgcaagcagtgataagcatgcctgcacattcttcctcacaacaattgaggtatttgggttaaacagttccactgcaagaaactccacaactccctgaaaactttgtcggcgatgttcactgtttgcttcatctgcattgtttactacccgtagaacttgtgttaggacatggtttgtctcctcctgctctttgtttgcatgcatcgggagcctcttaagaacatggataagcccgcgtacaactctaacctggaaaatgcatagggtatccacagacactttaccaaccagcgctccaaggcccattacaccacccatctgagcttgccatgtgctaccataacaacaatgcaacaggcgtggcaataattcctcaaatactgcaacccgcacacttggaggaggagaataaactggattcaaagatggactagaaactaacatgggggtactaggaccacctcttagcataccagtatgcttcatgcgagcaagaaagagtagtgtctcagcaaaagtatttaaagcagacagagcagcttttgcatgttgacgattttcacttgagagtacttcaaccaatgaatccataaatattaaaggatccaactcacggagattagatgaagagttgttccttgatctagatccaatgctagatgaaagggacgaaccaacaggttgtacatatccagactgactggaggatgaagaatcgatatggaaaagcatagcaaaatgtcgacataaatcaacaacgaagtcatccttctcgtctgtaaggctggtgtcagaattagctgcaatgatagctacaagcagaaccttgaaaacagatttctctgccagtagttgtgtctttgtcttcacacctaaatctccctaaagatcaagtagaaaataaagggaaaaatcaacaaaacacactcaagttagattaggcaaaagatactccctccattccaaattgatctacatatagtttttttgagggtattcctaaatgatctacatatttgtgttcatttattaggtctattcgttatttgtgcattggagtaaatggacattgatgcatgcatccatgcacacatgtatttataacccacatgtaatatcttgatttgctattggctaggaaatagtggggatggtgcatgcattgagtttgttgctagagtaaatatagtatgagagagttattagcttttcttggtcttgatgtacctatgaaatatgtagatcaatttggaatggagggagtacaacacaaataccagaaagaactgctgctccagtcaaatattaatatacataaatacaagtcatcattttggtatgaataaaaatccaaatttttaaataataaaaaggaggtaagaggcaaaagtttcaaacaataatggcatctaaatgcagctggacataattattccaaaaaaggcaacctacagattttagagagtatacgatcacaccgtttattgaacaataatgcggaagtttagcattgctatttgtggtaatacctgatttaccacttttatgcattaccaattagacatcaagagattgaatggaccacaagaaggctgtcactacttaataaaaataaaggtccatttggaacaagaaaccaactatagtccaaagaatggacatgactatgattgtaggttagtttggggaaaagggttaaatgaatacagaaaaatcataatgtgacatgttgtcattagtttacaagataacatggcatgctgaataataagcattaattaatttctgaaatcatgcaatgcagtactccctccgtcccaaaataagtccaattttcaccgattccacacataccaatacacaaccaaaacgactagaatgcccctactttatcaaataccaatgaaactattcttcactttatctactcccaatacaattattccctactttcacgaactccgatgcaatgattactctaataatgaacttatttattttgggacaaatggaaggagctaaaaatgaacttattacgggacagagggagtaaaatgtatcaattatgggagctactggacaatcccataactgcaattgaatgctaatcaatagtcaatacaagcctacgttgattttaacaatttcgatcacgacaaataactttgggacaatgtaagatcgatgatgtcaaatgtcagaagatgatcaagcagcgtgagcaaaatacataagtaatattaacaatatcaatactcaacatatattcaaaccaaccttcatatcagaagcatcattgcgacgccttgatggatccaaagaagatattagcagtgtcccaagaactccagggctcacaccctcaccgggtacattttcccgtaagtttaacaaagaatccaagcacactcgaataaactgaagagcctgtttcctgtagaaagcttccatactattaccttgcataactgcactgactgcaaagtgtatgcatctgtccagtggaactagaaacggtgttgcaggctcaaaagtcagaactaaacgaagtccatgttccgggttttccttgcattcaagtgcgaggggctccttcaaaaatcgcctatttcgaccccctagcttacctaacagttccaaggactttgtaccccatgtgtagggaggaggcctcaagtgagaccataaagcaagaatgacatcagacattaaattggccatgctaggttccaaaaaatcagggttgagactatcaatccaaaattctagtgtacgaagagctaagctcacaaggtcatcactccctttcagagcaagaacgagaggtttcatcaaacgaggaatgtgaggcagcaaagaactcaagcgagcaggtaatatcaggcaaagctccaaaatcaagtctcgcatatcttcactagttggtccatcaagcatggagagcaacatattgaggcaaggctgtaaagacggtataagatcacgcatcaatgaatcaaatttagcaatgttcaatgcacggaacatgctacggagaaggtgcatgtaaccaagaggtttctcaacttcagtggcactcttcatgcaaacttccattattactgggacatgtggctgaagagtgcgctcacaactttctggggcctttgctgcagcgacaaacaaaaagcgaaagagttgcaagacaagctttgctgcaggcgaatctggctgcttcagcgcgtcaagttttgagctaacgaggaaattaatcaatacatctgtgaatggccgaagaaccttgggagcttgcaaaaggctagaaaatatgtgtaacagctggttgtttgttatcatgcaatcaaagaggtctggcatgcaaaaggaaaacatgtccattatatcccgagcttccattatagctagcatttgggaaaaacattgcagaatgtctctctcctcatccttttccttaaaaagagccaaacagtgaaccccagattttagaacacccgaagtcttccgcacctataacatatcacataattttattagcaacagttcagtttaaccaaaagaataaaggtgcatggtgatggtttaatggacctcatcctcccgcagtcccctgaatggttgtactgataaatttgatgattgttgactttgttgctgcagaatacatgattggattataagagctcaaggatgataacatactgaataagatagtacccacaaacttgggatgtcaataatacctgtgggcgtggccaatgagcatgggttatgctccagattattgtcttcattcctggtatgtgtttaacatgaaaacattggagttataaatgcttaaacactttgtatatgtaaatactttattaaaaataaatcatacctagtacgagtgtccttatcagacttttgtaatcattaatctcctttgtgtactccaagggtggttgcaaattcagcacagtctgtaaaattgttggagagatttaaataacccataagtacaaataaacagtagcttgtctctggtttcaccacaggtccctcattttgctgcatggccctatcttattttataggccggatgcaactagccaacaataataactaccagcatatgatgaaaaaattgctatatttgtggtttcgtgtagagcagacaggggcataaatcttttatactcggcatttgccatgaaaggcttgagtataatcaagttattcacttactcatagtagtaacacattaaatgtctggagtgaatgcacaagttaatagactaacacatgccctattattttgttttgagaaactcagctagacaactcactgttttaagtaaattcaattacataaatgcaaagcatctgtgaattgcctccataaagagggcctatgacacacctgtaatgggacttcaagtttcattctcaaattttggtgttccttcccttcctcgccttcttcaagcaactggagaaaaagagagcaagttgaccacacagtgtaacaaaccaaaaaggagatagcattgatctttctgttgagaaaagtctaaaatacacaatagttgggagctccagagaatatttaatgctatacaattaaagtcgatcattagacacatatccttaagcaccaatcatcaaaatctggcattaaattttcgttggatataaactgaggccaaccacagtttgccagaataaaaaaggcacgatagccagcttttaccgttgtcaattatgcagaactgtcccactgttttagaaatagtaccatattataaaatagactaacaggctctgttttatttcttatgcatgtacattgcagtacaccagtgcccaatgcatctgtcctcccatgcgtacaacatgtgccagtgaactgtgcaaggttatattatgccatagcatacactataaaatatcattaaaagcatgccatatacctgaggaattgtgcgcttcaatgtcctgaacttcccaacaaatgcatccagtatacgcccctagtcatttctaaaaatcagtaccaacaaaagaaactaactagcgtatcggaacaggaaagcagttctttttaccaacaaaatccgtgcttcatccatgcttggctgatcaatacctttttcatatataggctcaaccttgaagagttcaccaaagagtagcagttcagttcagtataaaaaaattaattcaccattagtactataattaagtatgaagttctttgtgcacacacaaaatcgtaaaagtaaaagctgaacaaaacacaatatgtagatcctattattactactaaaaacaaatagaacaatagggcataagcataccagattcaacatcaaacgagccgatgtcgtatgaatgacaagggttagcgaagaatcatgcatattccgagagaacaaataaatgatccgcgatagctgcacaaaaatgaggtcactacgttaatgacatctgaacatagaagatcaacctccaagagtggagtttgtactggtgatagtgatatcacccccaatgaagtgcctagttttcataatcttgcagaatgctggatcaagaaaaaatacagtatatttctgcgtctgaatcagcaaaagagagatgtggcacctactcaaactaatgaactaattgtttgagcaatgcattgttcatattgaattacagatggtgtttgcctgtttggcagttccccgtgcaaaaagaatataataaattgccttcctaaacttcaacaatgcaagtgttgacattcttacatagcaacaccagactaacaaaaaatgagcatctataaaaaaaatacatggttcacaaattacacaaactaaggaattctgcaagaatcaagattaacctgcggaagagaaaggtctccacgaacataatgcaccagctcggcaagaagggtataggcaagaggtctcaatgtctcgatgcaaactcggcctgtgcctatcaaaaccctgataaacaagcaaaatgtttggaacaaagagtaagagaatgtgtatgtactcaacatctccacagagacaaaagggacgaaaatactatgcacccagttggtttgagtagtgcacagttatcataatcaaacaagaaaaggagcagcttgacagacacttttctctgcgtactttctagcacaataaacagccagtgtcttattaatagttatagtttctctatttacaactttacaacattttttaagaactaggagctgtttgatctcgaattaaggataagtgctgtctcttttttttctgatgaccccaagtgggaaattaactgctttgaattgcccttgtctcttagcaataaatagcttgtgaccatgggttaggcgcattttgttttaaaaacaagttaacttatcaaaagtgcttaaatagaataccaatgagttcagacatcaggactagcaagaactctctgcatactaaaccatgttacacccttatttacagaacatggaacaagaacttgccagcaagcattcgacatattagtaatcaagaacaactatgcatcagatcccagtaaggcaacattcaaataaaacatgaataaattgggtaatcatataaatgaaaagtgtacctctcatcaagaagtgtgtcaatcaagggaaataaaccacgcctgtactcagtgttgagaacttgcttcaagccaactagcagctcctgcaattccatacacaaaagtttatacaaatgcatttcaacacaatgtatagttcattaactttgagaaagatttagataataacttgccttccttatggaaacagagtccggggggcatgtaacaagcaagttcacaatgctcttgcatatgctttcctcatatgactttatatgatccgcgttgctcttcagaaggtacgtcaggaatgacaatgtctgcaacacaaaaatggttaaccaatcatgacctccacagacaaggaaacaaaattgacagaacctgcagtaccttgacttgtgcaccctttaactcaacaaagggcgtcttcaggtgtggtggcactttgtctggccccttaatagagattgcagacaccatgagtggtagcaagtatgggatatttgtctgcacaagcttagcatacaactggaacaaaaacatcactactagagggctctctgtgactatcttgaatgaccgtgcacttggattgagttgtccaccgcctggcactgccaccgtgcctggggcatcagcagtggggtccaaatgctggttgggcacggcagcagcaatattggcactgacattgggattatcgaagaaatgggtgacagtattgggaaagttgcggtatatggtaacaacaaaatcaaggaacggctgcacctctgcctcgacagtagggcgaaagttacggaggagatcaaatacaatcctgatggcaagaagtgcattgtcctcattgtcctgtgtcaatacacgaagagagagcttgagcaggtcttgcacaaagggtcggagcacctcactgtggggtagccgattgaggatctcaatcaccacattccgcagcttgtgctccgcattctcagtgccctgtggtgcggtgaagttgctgaggatggccgagaatgctctgaagtagcatctaagaaagttaagatagtctggagtatgagtcatctccaggctgtcccgaacttccatggcaagctgcagtcggacttgcacagctgcagagtaatagggcaaaggatcagattattgtgtcaaaacaaaatggcactccaccacaaagactatgtctacaagacagactgtaacaggtttacacagttcaaaaggtcaaaatgaaaccgatgaaaaaccatgtggtggtgttgtgagatagattggtacaatccaaccattgaacagaaaaatagaagcttgatatggtgttcagttcagacaaaaaggtaaatttgaaggcaccgagcctgttctcaaaagaggcagaaaattatattttaaaaaaatgaaaggataaaaatagaaattcggg

SEQ ID NO: 19782 - DNA, 3792 bp, Oryza sativa
aagaaggaggggggagagagagagaggacagagagggcgaatggtagggggggactcgggatcgcggtattatgagggggggcgcgtttcggtcaggtcggtttgggtttggggttgcgttgcatcgggttcgcccgggtcaaccgcggtggatcgggtggagggagttgggccgtgtacctacacgcggcggcggcccaattttgtactggagatgggccaccggcatttggtgagtccagctacgtctctagatcggcctgtgggtgtactgggacggaaactatctttgttgggttagatgggcttcaatagtcactaggaataagtctattttttgtctatcctatcttgctgagtactgggaccgaaactatctttcttgggttagatgggcttcaatagtcactaggagtaagtctactttgcgttcatcatctcttgctcctgattgaattgtctccctctatcgtaaaactagatataacgctttccacgtcttgggaaaccggtgcaaatcgatttctatggtggtttttggaaacggtttctaccgacatcacaaattgaccacaattgactcattgagtgagttagcaggggttagtttttccttccttccaattttacgtcggcctataagtacgggaccgaaacaaatattgtcaatgggcttcaatagccgctatgaaggcacattgaggtgaacactaaagcccgttcctccgtcagggcaatttaccactccttccgtttaatactttaagacgtaactttttccttgcaagtctagctagttttagagaaatatagcaacttttataacatcaaaatagtttttcgctacatcaaaaattaaatatattttatactttatttgtctggtgttgaaaatatcactactatgttttctataattcggtcatacttaacattgattaagaacaaagttaaagtcttataatatataacggatggagtaattatcatcgcaaaaaatcacgtcaattagacctagactttaacatagtaccattttttacaggcaacggtgttttgtatttttttttattgcgatacttttaaattttctctactcctaataattatatgtctggttactcacccaccttacaatgctcgtattatttgcttcttagcagtgtaaactaatgttgcttcttatgagtttcaccgtctttaccactacaccagtccttcgtcctaatagtcatctccaccacgttggtattgtttacaccaatattatcccctacaaccattaccccacacccctagaagcaatctcaaccttaccgaccccatttcgcctacctttccctaggagatccattactggcttcttacatattcatcacgctgtcattaatcgcttgcctaaactagcggaataatcggttcccaatctcctattgatatctttgaccttataagttatttgccatcaccattaataacttggaggtaaaggataccttacaatagttagttgttttcaaattgagatttgcttagacattccctaaacatataggctgcgttcgatactccaacaagaattggatgaaattttgaatactcgtaacatgtttttcaaactgctaaacggtgtattttcgtgtgaaaactttacatatgaaagttgctctaaaatatcggattaatcaaattttcaagtttgtaataattaaaactcaattaatcacatgttattaccacctcattttacgtgaagcacttaatctttatctttatcttaatcttcatcttcatcttcaggagattcaaacagccattcccgtcgcatatgagattaagatcataggtttgcctcaagttacaaccgataaatctaacgcctctttgggggaaaaaactgcatatggtacatgaaaagatatatgttcttttatttattttgctcactccttcgctttccgaaatgccttcgtcagtaaaaaggggaaacaatgccttgagcgcccggcgtgcaacggtgtttgtgaacttcactctacggcttcaaatccggcgttttccacacaacaccctgtgtgatctgacggcatccaacgttttccattcggctggatgaaaacgaactggtcagttcatcctgacagatacatttgcaccaatcgatgcctgggtcactcaagtctctcttcagattaagtaccttcgaagattgccaactcggttgcttctcatatatcctttcgatgttgttcacacgtattccttgcccatgtcaccaaaatctcaaaacaattcgaattagtgtacataataactgcagtttatctaacaaaaaatgcaactagatttcataactgtacatgtacttcgctatcaacaaacagtgcacgcttcggttcttgtctgttggaatagagaaatcagaactgcagaaagccaatcggtttgcactaacctgggctacatgattttccaagtcagcacttagtatatactgttaatataaccgggtcaagatggcacgaggcggctgcattgatcagcaatacagtgaccgttgagatgattgttttttttaataaaaaaaacagatatagttattaagatgataatttcatccttacaagaaactgtctaaccaatcgggatttcgtgagctgagaagttgctgcactgatttaaacaaattgagtctacatcttcgagtcatgaacaagcaaacagcatagaccaaaaaactcacaggaaactataacccatatggatcactatcaaaatctccctgctaataaatttcatgcttatcatagggataatgtgccttcgtgttaagtagccaggcacgtacatgtgtgtcgatctccttaattaattgccacatttcaatcgaaacaagctactattctcttcaagcaactaacctccaaattcatcatggatttctttacacccaagtggcctataaaatcacgagaattcgatcagcttagaaccatttaaaaggaggaggtagccaatggaagaaggcatcaaggaggagacgaaggcagcagcagcagcgagctcaggtcagacgacggcggcggcggcgacgagcaagagcaacagcaccaccgtgggcgacatggcggacacgacgttcaagagcatcggcgacgtgctgaagctgctgccgacggcgacggtgatcgtgtacgaggtgctgaccccgatcgtcaccaacaccggcgactgccacgtggcgaacaaggtcgtcacgccggtgatcctggtgctctgcgccttcttctgcgcgttctcgcagttcacggacagctacgtcggcgccgacggcaaggtgaggtacgggctggtgacggcgagggggctgctgccgttcagcggcggcggcggcgccgacggcggggacgccgccggcagggacttctccaagtacaggctgcggttcggcgacttcgtccacgccttcttctccgtggcggtgttcgccgcggtggcgctgctcgccgacgccaacacggtgtcgtgcttctacccgtcgctcaaggaccagcagaagaaggtggtcatggcgctccccgtcgtcgtcggcgcgctcgccagcgtcgtcttcgtcgtgttcccgtccacccgccacgggatcggctacccgccggcgaagcccgccacggcgtcgctggcgtcgctgtaggcggcgagcccgattagtcgatttgcattgccatgcaggcatgtgcttcctttttatgggttgtgtttttttaaatatttgcacgtgtgcatatgtgttct

SEQ ID NO: 19783 - DNA, 7317 bp, Oryza sativa
  unsure (1)..(7317): unsure at all n locations
aataaggccaagagctagtttgatctcgttgatttgcctcatctttgtgcagtttatgacttgttatattccatcgcaatggatgaatccgtggggaactatatgataaacttggcaaacatttatgagtttttcatctgaattgaatgtccgcacgattatattagcgaaaatgttcagtaagaactctatgaatgctgtagttagcattcgtgcttagagcatgaaaaatggtagttcgatcttgttgatttgcctcatattgcgcagttcatgacttatagggatggtttggtttgggggtctaaattagccttaccaatatttgacaattttaatagcgtttagtgtctatttggtttggagtcaaattttggcatgcctaagaaaataagtcatttaaatagttaatttaggctattttgacttcaatccaaacacaactttgccttaccaaaattatgcatgccaaaatttgctaaaatttagcattgacaaaaattggtaaggctaatttaggccacaaaacaaaccagcctatattgatgtggaaatctttaattgaaatggatgaatctgtgggaaagcagatgataaatttggcaaacatatataaattcatctgaatattgcaaggtagttagcatgcatgcttactagagcatgacaaaatggtagcaccaagaataaaattatttgcaacgaggtccgtcctcgccgccggcggccggtgagctcgaacacgcggtggccccggagctccggcagttttgtctgctccgacgagacgatctggccggtggagacgttcgggacgccgtggcgcctgtggccgaccaacgccggggttggaaaccggacgtagccggtgaggcggtgacgtcacccgttgaggcccaactaataatatgggccggaagttcgccacagcaccgtcccggcccaactagcattacgggcctcatatgggccaataccaaactacggcaggccgcaccgtcacggcccaactaataatacgggctggaagttccccacaacggcccaactagtattatgggccaagctccgctccggcccaatagctagcactccaggtcggagggagcagcgcgtccgtgtgttggcctcacgctcgctgcctctcctcttggcccggagctcacccacgcacgcagccgtctcgtctcccttcttctctctcctctcctctcttctccggcacaccacaccccaatcctcccccgatctccccaatccgagagctccggaggagcagcgcggaggcggagatggcgctgcggcgagcgctgctcagatctgccgagatctcccccgatcgcaaggtccgaatccccgcccttctccactctcctccttcccccccatctctctccggtctggatcccccaaccacgaggggcgcgaacgctgttaccgcctttgcgagaatctgagaggagtgcgcgtagcgggtttgagctgtgggagggtggaggagggtttgcaccagtcgatgtgtgttggtggtgcgcgcatggcgacgaatctcttcttcttccgggagtagaggataggtcgaggggagaggagtaaccgatgtagagcatggaatgccgatggacagttaggaggggctccatgtccgtctcttttgcatttcgtattagttctgtagggatttctggctgtaaagtgtttacgacttgatgcttaggatcgagtttcagtttgttgcggatgtggtttcttgttatgtcgtggatactcggagcatgccgtaaattgcttggataggccattcaaaatctcatttgtgaaaaccgaaaatgaccatgcagttgcagactagttactacctctttgtattcggtattgctgatgaaaacatgtgctacactcctttgcttgattgaaatagagaacaataattcaaaagctcgtttttgaactgaagatgaccattcagttacaggcttgttgctacctctttgtattcaatattgctgatgaaaacatgtgctgcactcctttacttgattgaaacgcgaaacgatctttactctttctactatattagtgtttccctgatgccccgagcggaataccagtattgtggttatcttatttcaatagattaaacaaacatggtgcatttatgaatatgctacattctgtagggatataaatgtgtttgatattggtatttcgtggcttctcctttgggtacaactaagaacacaacaaatgatacttcacctcaaagtgatactatcttttatgcctttcgtaggcttacttagtttttactttgcatataaaaccactactacaaataggaaaatcgtattgcagatactgaaaacctgtcctttatcaggacaggtatgctctatgctgcaatgagattatcaaaaacaccaacttgctgccaactgagcatttgatcttttctcttgttacttagatacttctaaaataatgctccaacattgtaggcacctgctgggcttatatataattcatgtttcacttatgggctgatatatttgaacttgatgtatttattttggtttctaaatctgcaaaattgttcccattctattcgttgatttaccatttacctgcagcagcaagtttgagttgaaagtagagatccttgtcaccatgttctaattactctattctagttcacttaactagttaaaaactgaaggcaagagcatcagaattctgtatttctgatcatttcttgatgttcatgttgttcttaattttgcttctttcaacacttgcttggatacttagtcagctttcaaatgaagattactttagtcttttgcttttgacaagtattggcgtattgtagtaaagtaactacaaacttttttttgtcctgaatcacatctcatggatcaagctgtgataacaaattggttttttttttcttgtcaggctgcacttgagtacctccattatctatcgagagcacagcctactcgttctctaacaggtgctggcctttattctgctggcaaatcattcagcactcaggctgctactacatcaagcacaccacaacctccaccaccacctccacctccggagaagactcactttggtgacctcaaagatgaggaccgcatttttaccaacctctatggtcagcatgaccctttcctgaaaggtgcaatgaagaggggtgactggcatagaaccaaggatttggtgcttaaaggggcagactggatagtgaatgaaatgaagaaatcgggacttcgagggcgtggaggtgcaggattcccttctgggcttaaatggtccttcatgccaaaggtatctgatggacgcccttcttatcttgttgttaatgctgatgagagtgagccaggaacttgcaaggacagagaaatcatgcgtcatgacccccacaagcttctggaaggctgtttgattgctggagttgggatgagggcatcggctgcttacatctacattagaggtgaatatgtgaatgagcgtctcaaccttttgaaagctcgggaggaagcatacgcagcaggtcttcttggtaagaatgcttgtggatctggttatgactttgatgtgcatatacattttggtgctggtgcctacatttgtggtgaagagactgccctactggaaagtctcgaaggcaagcaaggtaaaccaaggttgaagcctcctttccctgccaatgctggcctatatggctgccccacaactgtcacaaatgttgaaacagtggctgtgtctccaacaattctcaggcgtggtccagaatggtttgcaagctttggacgcaagaataactcgggaactaaactattctgtgtctcaggtcatgtgaacaaaccttgcactgtcgaggaggaaatgagcatacctcttaaggaattgattgaaaagcactgtggaggtgtgagaggaggatgggacaacctgcttgcaattattcctggtggttcatctgttcccttgttaccgaagcatatatgtgatgatgtgttgatggactatgatgcactcaaggctgtgcaatctggattgggtactgcagcagttattgtgatggacaagtccacagatgttgttgatgcaattgctaggctatcgtacttctacaagcatgagagttgtgggcagtgcacaccttgcagggagggaacagggtggctgtggatgatcatggagaggctcaaagtaggtaacgcgaagcttgaggagattgatatgcttcaggaggtcactaagcagattgaagggcatactatttgtgcccttggggatgctgctgcatggcctgtgcagggacttatcaggcacttcaggccagaactggaaaggagaatccgtgagcgagccgaaagggagctactggcagcttcggcttaggacactgtcaatgacgatcctgcactagtttcctgatttctttcacagaaataatgcaaactgatggagctcatctctgtatacgaaatgcagctcccctgatttgtttaaacctttatgtggatgtttatttaatgcactcagaagctggtgaattttgatggactgatgaaaacttttttaagtagaaacaaaatgcagttactgtaccatgtatgtcacatgagccagcaaaatatgatggtggatgtggacgtgtaccctgcttgtttttttttcactgttaaactatgcattgtttgaaattgtctagagttcgtgtgagctggttgaaaccatgtctacatctggggcctatgtttgcatctaatgagccagcataatctcatctgcatggcatattgttgatctgcatacttctatagggccaccggccctggcatgcatctgttcgtgattaaccaccggatgcttcatggtggttgggatatctacaaatgtattctggacctgtgtttattgtactgtttggtacagcacgtatccatcagctggtatgccgtgccgtatccagtagttgccaccgtcagatatctctggaatagttgggcttgccggttactgttcttccattttgtctccaggaatctgaatttgcaatggaacagttgagttgactgtgtccagaagatgtgtaataccaaactattttataatctctgttaagtaaaacatgagcattaagcaatgacaattcaactaaggcttgtttagattcaaactttttccttcaaactttcaacttttccatcacatcaaatgtttggacaacttttttatcacatcaaatgtttgtacacatgcatggagcattaaatgtggacaaaaaaaaaatcaattgcatagtttgcatgtaaatcgcgagacaaatcttttagtctaattatgccatgatttgataatatggtgctacattaaacatttgcaaatgacggattaattaggcttaatagattcgtctcgcagtttacaggcggaatctgtaatttgttttgttattagtctacgtttaatacttcaaatgtgtatccgtatacttcaacaaaattttggcacacgaactaaacacaacctaagcaaccaaagcttcggccactcatcacatatacgagtagaagatatgctgatttcagggtttaacactgagggtgtgtttagttcacgctaaaattggaagtttggatgaaattggaacgttctgacggaaaagttgaaagtttgtgtgtaggaaagttttgatgtgatataaaagttagaaatttgaaaaaaaagttgggaactgaaccaggcctgagagcctaagtcactactgcatctcacttccacttctcctttacggcaaacagctcactctctgtaagtagaaccagatgtaaggtagtaaccacaaaaaggggaagccaggccaaaatacattacttccacttcttggtcatacatcacatccttcaacctcattccaaatattagctgtatacacaattaaaagcaacccacaaagaccttttggcaccaacaaagattaaaaaaaaaccctgaaatttactcaatcagaatgtcatttagctgcccataatcccttttttgaacacttcttgtttatcttgactactctctgtctctggttgccgctttcttcatcagtttctttcttgtcctgtattgttacatcaactttaacgatgtgatgatcagatgttccttttgaggatatgaccgtgtaagatcctggcacgaacttgtagggagagtttggtgaggccagtatgtaatccacccttgtgccatacttgcatgtcccttgtacatctgaagttcataaaaagttcagatattcagtaaccactatacagcaacagcgagtaactgaaaaactaacaaagatcttgtgtttcataaggtagctgaaattggttgtgcaatgtgataaatgcaccttaggtcatcaatttttagaggaaatcatctaaaaatgaggagctgcagtccatcatatacatcataggttcagtaaagagcagattaactgaaatgaaactactttgttggccatatggtatctgaacaagctgagaaatgtaacctctcaccttgccctttagcaacaaccaccacagcctcacattctcctgcaaaatccttggcatcaacatactgcttccccttcaggtacttcatcacctccgccttcggcgtcggcttcccgatctcctcatagtactacaaaaccatcaaaattttgcacaattcctcaagttactcatcagtgttccagtttcagcgacacaaaaaaattcttgatacttgaacactgactgactgctgctaccttgacgatgtcggcccatcgctcgtcgcagtagtcggtgccgtcgagcgcattgagccctccggtgagaatgtgagggccatcgctggagcgcagtatggcgttcatttgcttcatcctccagctctcatcaaggtggtcgagatgtgtgcagtgtaagttgacctccccggctctcggaacctcaatggtggccctcagcacgttcctgcatgatttggaaaacaaaattaacgcttaataatcacgtggagggaccatggatgggaagcagaggcaagaggagttatgttcactgttcagatggccaggcacaatcagatatgttgctgtcatgaattcatggtgttttttttttttgctcccgttttataggctcatagctcgttgaaaggtgacggttttctgtttatgatagcaacatagagtgtaattgcagagcaaatttctctaagnnnnnnnnnnnnnnnnnnnnnnnnnnnnnnnnnnnnnnnnnnnnnnnnnnnnnnnnn

SEQ ID NO: 19784 - DNA, 4537 bp, Oryza sativa
ccatatggtatctgaacaagctgagaaatgtaacctctcaccttgccctttagcaacaaccaccacagcctcacattctcctgcaaaatccttggcatcaacatactgcttccccttcaggtacttcatcacctccgccttcggcgtcggcttcccgatctcctcatagtactacaaaaccatcaaaattttgcacaattcctcaagttactcatcagtgttccagtttcagggacacaaaaaaattcttgatacttgaacactgactgactgctgctaccttgacgatgtcggcccatcgctcgtcggagtagtcggtgccgtcgagcgcattgagccctccggtgaggatgtgagggccatcgctggagcgcagtatggcgttcatctgcttcatcctccagctctcatcaaggtggtcgagatgtgtgcagtggaagttgacctccccggctctcggaacctcaatggtggccctcagcacgttcctgcatgatttggaaaacaaaattaacgcttaataatcacgtggagggaccatggatgggaagcagaggcaagaggagttatgttcactgttcagatggccaggcacaatcagatatgttgctgtcatgaattcatggtgttttttttttttgctcccgttttataggctcatagctcgttgaaaggtgacggttttctgtttatgatagcaacatagagtgtaattgcagagcaaatttctctaaggcttctggtttttgtcaacatgaaaaaaagaactttttttttcaaaggagaaagaggaacgggttagtgttgaataattaagaagaaattgtgagtatattgggagtcgaacacatgacctcaaggtcagagtcaaaaccagccacacttgccactacgctagcaagcgcatctaagattttccttttcgaacaatataatcgaaaatgtttgtccaggagaatgatgggtaattcttaccacttttctgggtgaaacagaagttaagatgatgctacatgtaccatccaaaaacttctctcttctttttccctgaaatactagctatatagacctatggtaacatatgagtttgttctttgtttctcttcactagttacacaacacaaacaacaggatgattatcacaaggaagcagcagtcgttgttgtgcaattacttgccaaggcgccgctgcgtggccagatgttgctatccatcaaagccattgccccgctaattgtcttgccaagaaaggccctgcctagctactacttctactagtaccctttctcgatggcgactgctcggaggacgcacggatttcagattttcagatctctcagttctcacgagattatgtggcagcagcactttgcttttcattgaccacattatgtcagcattactgcattaggatagtataattaatattgcctatatcttttttgataatgaaaataaatctagtttctacatcaagatgtatgatcatggccgtgtttagttcacactgaagtttgaaaatttggttgaaattcgtacgatgtgatagaaaagttatgtgtatatgaaaggtttgatatgatggaaagttggaagttcggaaaaaaaaaactttagaactaaacagggcccatgtccgagacgagtgtgaccagggttcaccttttcttattgagatccgggatctctacccctgacggtacgacagttctggccaacttttggtcaaattttactgtttcgaatttgaattcttgaaaaccatttgaaatttaacaccggaatccgcttttctcctgcatctaaacctcgaaattccgcggttttcaattggaccctgagtatgatatatatatacatggagacctaccattccttgtcacacaacttccactgcccttcaactgcatctagctatcaactagtagtagtagttaattgagcacacctaaacctgtactccaatcacatgtgaacgcggtccttttcgcttaaacctaaccaaagcgtcacgcgtaacccattttataggtaataatcaagcaaaacaagccaaattaagctacaattggggtgcccattttggccttggattttatgggatccgtatgcatatgcatttcccagggttttgatctgccaaaggagcagctcacctaatcctcattattattattctacctttctaagaaaggagcattagttgctaaaaatctaaattaaactacgcatctgccatacttacccagtaatcatgttgcctcttgtcggattgtgtaacaaactcctaatcccaactgctactgtcaccgcaatctgctcgatcaattaattaactaatcaatcgctttgtattatagcaggagaccaggagctagctagtgatctgagaccttgactaaactccccatctttcttttcttaaaacatcttttaaaaattatactatcttcatctcaaaatataagcatttcttacttcatctcaaaatataagcatttcttactccgatcagacaagtgattgtctacattcaaaataaggccgtgtttagattctaccctaaaattttttgccctgacatatcgaacctttgagcacctgcatgaagtattaaatataggctaaaaaataactaattgcacagattgcgactaatttgcgagacaaatcttttaagcctaattgctccatgatttgacaatgtggtactacagtaaacatttgctaattatggattaattaggcttaataaattcgtctcgcagttcagttctgtaattagttttttatttttgcccgaacaccctatgcgacaccctatataatacccgatgtgacacgccaaaactttacatccctggatctaaacacccctaaaaaatacttatattttaaaagcggaggtattacttaattatataactaactcaatccatcattacaaggtagtaaaaggtggtcagcttcaggtaagctggacgacggcgacgctcaccgaaccgaccacctgcgtcgtcgtcgtcgctagtccctcgtcggattcctccggcgacgggacaaaacccaacggcaggcgtgcgtacggtacggcccaataattgggcggcgaccgcgacgcgtccaggaaattcgagacaacgggggcagctagataccaagctgaagaagaagcagaagcagcagcagcaaagctaagctagcggccggacgacatggtggttgcgcgtgcctgagtgcctgaccgacggcagctagcgccgacggccgacggggttacgaccgggtcactgcgcgaagtggggcccacgcgtgcatgcgtggggccccctgtacgcatgtgacatgtcacgagccacggttggacaaaggagtgtatagtacagtacagcagtatgagtgatgtacagatgtaatggtggtagcaatctgtctgctgttttacagtgttactcccttcgaaaacaatttaaaatagaatgagatgttttctagtataataaatctgaataagcttttatttaaatttattattgtagaaaacatcttattccacgtagattggtatttttagagacggaaagacaggatgttagagggtgagaatgtgagatgcaagcatagcttggcagctcatgcgcatctgaagcacaggatggaacattcagattcagagagtatggcgtggcgtggcctgccagctctgaatcccattattatggcagtagtctgtactggcaatttgcaagtgtgcaactagtaggagtactatctagtattgtcgtgtagaaaataagagatatatacatatactgaatccaatgaaaagcttttcttgctactcatcgagtgctcagttggtaggaattgtactgaattttctggaaatttacttaacctgtttctacacttttcaccctttggcttgttaaaatatcaaaatggttcaaaattttatattgaaaaaaattacggacccatcggcatatttgcaaataaatagtaatttgtgaataagacttttatatatgtatttcttagcgatataaaagtacatgctgaaaaataaactttgatgaaaaaacctcgaattcagctccaaatttaaagttaaaaatttaaaatttagttgataagcataagcataagaaaaaaaaaaagccccttaatcgtttgcaaccactgtacaccgtaaagtgaaaaatccatgcaagaaatgtgatggttgatgcgaggaaattaaattacggcgagggaaaaggagacgatcggactgaccggaagtcggactggtcggcgacgcgctgcgacttccagcgcttgataggccaccgggagagcacggcgttgccgtactccggcgcccagctctcggcgaacacgtaccgcatgccgagcccctcggcgagctccgacagcgggctcatcccgcgctcctcctccgcgcgcacgttctgcagcccgatgatgtcggcgcccacctcccggagcacctcttccacgctccgccgccgcccttccggggtaccgagctcga

SEQ ID NO: 19785 - DNA, 2105 bp, Oryza sativa
ccttgctcgccgttcgcgccaggctcgcctgcgccttcaggatgcccttgggtcgccgcccgccgccggcggcgggggtggtgacacgccgcgcggtctcggtagctgtctctgcggacgacgccgccgccacggccggcgccatggagaacatcgcggcgttgaacgtcgccacgcggatggtcaccgcctcccccgtcgcgccatcgccgcgattatcccgacgcgctcccgctgccgccgccgccgcctccttcctcccgttcgaccccaaccgccgcacggtcaccctcgccttgccctccgcgccgccgtggcggcgccggcgcggccgcgggtgcagcgcccggaacccggcgagcacgcgtcgcagcatgagcgtcgtcgcttgcgtgtgcgtgtgcgtgtgcgtgcgcggggggcgcccagtgcggggctccgcggcgagggggatagcgtaataatataccgctgcgtgagcgagagagtgtcgccgtcgcgcgcgcgcgcccgcgtcgtgacacgcgtggcgacgacggcgacgcgacggatcgcgtccactctactttgcttgggcgctggatatgacaagcagagttagtgacacggcgaaattttggttgtttattttgggtatattcgtatgcgtgtacgcagcaattgtaaactacctaggagtacgtggctatacgtatgtctgcatctgtcacaagtgagatttgttgcttcctgtacctatgcgtacaccgacctctacctcacggtatcttggcatcttgtcttctccatgtccaaactgccgttgtattgccgtttttttgacaaattgacccttttcaaaaacttatttcgaaactaacccctaccaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcacaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcgtgtcatgtcacataaatttatgttagacttgaatggagagatcgaatggcaaacatatatagatatagtattggagtcacatttcaaatctcttgaggtgtttgcatggaagaaagatggtaggatagggaagaaagaagttatagaccttaatgaaagtccactca

SEQ ID NO: 19786 - DNA, 505 bp, Oryza sativa
gaacctgaactcatcttgggccccatgtttgtggtagaggattatatttcattgcggttttctcccttggccttcagaatttcttcttaaagtcttgaatttcaacggcctttctttgtttcacttgaaccccaattccttagcatttcttagcatcttctctcatcttttagaggcctacattggggtagtgccctttcttgacctcttttgcttctattacgaattgcgtttgatggaatccaacagggtgtctggatgcatcggattccgacttcggaatggcctgaagtcgcgttatatccccttccagtgcccttcttattgtagcaagtggcggacgagatggttctatctctagatagaaaactcggaacccgtccttgttgtccctaaggatcagccagaagaaatcccagagtggaccgcaaaacaagccctgactccctccctccaatctttcatcgacatcattgatgatctccgaaaacggcggttgtcgggg

SEQ ID NO: 19787 - DNA, 630 bp, Oryza sativa
tataggcgaattcgagctcgtacccgttgatccgtatagttgactagttttcactgtgctgattattattaaccgggtggtctgtcttggtatctataggtaagttaggttcttatgtgaagttatcattttgaactgtttactatttttaagatgaaaaatccacagatacatctaggatgttttttttgttagtgtttaactatgtgatttgatcatcaacaccatgagtaaatgttttggcaagattccatttggcatgatggtccatttaccttggcattgacctggcataatctcagggacagaggcctgaacaggattcatcagttaattcacgccccacagtagaccctatggtcatatctaacatgaagaccgtcttaaaactcataagtgagagggtgatggcctcttctgagttcaggcgatctatgggccaaacacttcaagcactcctttcagaaaaaggcacagatcctagcgttcttctatgcatactggacatgataaaagcttggattgaggatgactacagacttgcttcatctactggctctgtcagttcacttaatccaaaggagataatagcttatcttcagaagttatcagttagtttgaccaggaaaa

SEQ ID NO: 19788 - DNA, 718 bp, Oryza sativa
cattcccattgcaatgctaacacgacggctttggctatagtttgtagcaaatctcagaagatggtacatggcttttggatcccttatattcactggagcaaaacaaaaattgtagcgatccttgagggagagaccctggatcctctcaagcatattagcaaccttcttgatactttcctggtgacacatgaagtatgtactgtcgacgcggcaattttcacggaacttatccagcagttcattgaaggtaaggtcaggaaactggatggcaaaactttccacctgctcaaagcaagggaatagaccaactttcttcgcttcctcaaatggctgctgaaggcactggatcaaataatccaaatcatccaacaagaaggtggttgtcagcccatctgggtaaatactgcctctccgaccagctcgcccagcaatctgttttacctgtgaagcagcaacaggtaccatcctgtccccattgtacttggccaaactatagaataccactctcctaatgttgaggttcaatcccataccaacagcatcacttgctacaagcacatcatactcattatcctgctcattaaacagctttgcttgctgccgccgtgtctctggtggaagagctccatatataacgcaacacttgtgcttcgtaaacttctcgattgccagtttcacctcaaatatctctctgcgtgaaaacgcgacaatgcagtca

SEQ ID NO: 19789 - DNA, 618 bp, Oryza sativa
tcttcccatttgggctgaattcaaacatattttacaaaattcagaacttgtcccaaattttggaaataatagtcattcatttttttccaaaaaaatagttgattttttttgtaaatttttttgatttctacaatttgggacagcttttaaaattgtacaaagtgtttaaaatcagccacaagtttttcaaatttaaattcggtaaggttctccaagggtaaaaatcgtctttaatgtcatgaatgaattttgccaactaactttaagcgtgaaccatgtgagttgttgaggggaaaaaaaggtaagttcgatttgctactcttaaccatcgtaaatatctgatttattcccctaaactataataccagtggcggtgacctccttcccacaggttctccacctccaactcggtgtagcccatgccatagattgttgttagcttgatgtcgcaactctcctctctctgccgccatatcggcacaatagttctttactcagcaatacatcctctctctcgaaggtgacggaccaggtggacgatcccaacggcactattccttagcgagctcaatgataggggacctatgtgttcctctgccgcttgattgagagagaaat

SEQ ID NO: 19790 - DNA, 724 bp, Oryza sativa
  unsure (1)..(724): unsure at all n locations
nnnnnnnnnnnnnnnnnnnnnnnnnnnnnnnnnnnnnntgactgctctcgagttgattaatttactgataagttgtgacagataaagagaaatatatatccaagtaataagatatcataaaattcttcagttcagtcagcattgctgaaggtttagaaccatttaaatatcgtgttgagtggttagaacatcgtaatcagtcgggaatcatgtgattgaactcattatctagaaaaccatatgtaattgaatagcgtaaacgtaagtgaagtcgccggctttgactacaccggattgtacgctaccgtacgcgagtgattgggaggatcggaatcgcgctgacctgggaggcggcgaggggggcggtctcgcgggagtcgtacgcgagggcggtgccgtcggcgagccggacgagcatgaaggcgccgccgccgaccccgctggacgccgggctgacgacgccgaggcagagcgacgcggcgaccgcggcgtccacggcgttaccgccgtcgcggagcgcgtcgcgcccgatcctcgagcaccgcccgtcgtccgccgccacggcgccgtgcggcgaggtcaccaccttcctgcgccccgccgtcgccggcgtcgtcgccggaaaagcgggtaagaggaggagcaccagccgcgccgtgggccgccatttgtgaaggcgtcgagctggcggtaacaggggtcacagtgagaaacaaaaagaaga

SEQ ID NO: 19791 - DNA, 759 bp, Oryza sativa
tctatgatttaacgatgtggtgctacagtgaacatgtgctaatgattgattaaataggtttaatgtttgtcccgcggtttactaacggattctgtaattagttttttttattaggatccgaacaccccataagacatcctacatgatacccgatgtgacgcgctgaaactttacaccctagatctaaatacccctaactgatttatttttgaagtgacacgactagtaactgacgagtgacgacttcagcgaccagatagcaggttgcaccaattatttgcatacaggattatatagcccacggtaggcaggcaccaatctatgggattcgatcagtagttaaaccagtttgacccaatgctattggcccaatttgctgtacaatattggtatcggccaaacgattattggctcgatcggtgcttaatttatttctcatttctgatctggacgccgcaggagctgaagctgaggctcgaccgtgtggatcccgaaggttctcttgcccaaacaaaactatttgtgtatttccttttacaaatctggcttctagtggtgatgttttggtgccatttgctactctctctttttaaatacaaacgatcaaagctaagcttctcctgtctgtactcctctaccactagtaaatcctttcgttgtcagcggtgacgcaatccacatggtcccttcaggattttaaacgtgcacgctcacaagttaattaaaaggcgattacatcaccaggcggtgaagaaaatc

SEQ ID NO: 19792 - DNA, 654 bp, Oryza sativa
atcatgctccattctaaccaaccagagttaacgctagaaatgtcaattgtgcattcaggatatgtatggtggcaacgaaacgctgaaagcaaggggagctctatccatagcagttccaggggaaattgcaggtctgtatgaggcatgaaagcgccatggcaagcttccttggaagaggttagtgatgccagcagcaaagcttgcccgtgcattcagagtgtcaccttatctgaggaagcagatggaggcaaccagagatggaattctccaaaataagggaataagtggagtgtacacctcaaatggagatatccttaatgttggagatgtatgccgcaacattaggcttgcaagaacactggtggctgtcgcggagaaagggccggatgtgttctacaaaggcgcagttggtgatcagctggcgaaggatattcaggaagttggagggatcataacaatggaagatctgaagaaataccaagttaagatacgtcggccacttttagagaatgtattgggactgacagtattaagcatgcctcctccttcagctggtggtgctgggctaatgcttgtaagttttctttgtactaaattttgttcactgttctttggtagcttaagtttgttgatttcaggtagcaaatttaatta

SEQ ID NO: 19793 - DNA, 469 bp, Oryza sativa
cccgtacacacagagagcttaggatttcaccctgagcccccggtcgaaccggcaaaggggggcctgcgcggtctcccggtgaggagccccgcgctccgtcagtggcatacctattgacaacgaagtgcccgtgtggtgatcgacaccttcattaatctcaagatatgttggtctaatattttaggggtgttaatagggatagggtgtgcgtgagttttttcgaggtgttcatatggatatataatgtgtatatgtgttcctatagggtgagtgtgtgcgcattgtgagtacttgtatttgtactgtgtttaaaaagaatcatattttagaggtgttcgtaggaataggatgtggtgaatcttttagaggtattcttagccatatggtgtacttgtgtgcccgtggtgatgggcacctttgtcgatctaaagatatattgattcagtctgttggtaaaatgggaactgta

SEQ ID NO: 19794 - DNA, 581 bp, Oryza sativa
cttttccaaccaagccattgtacaacaatcgttttgcaacatatacttatacagaagaaattctccaagaaaatctgttcgagaaaaaagaaaccggaaagagttaaaagcacaaatgttagccctgccccccagcgcatgcagcacgcccaccctgatcaggtgtcctgcacgtctcagccatcacacatatttggtacacacacgaacgtacgcatgcatgaatgtcacctcggatcctctcgtgcaaatctcccatgcacacgtccatgcatcgatcccacccttcacgccatgtagggggctagggtctttagaccttgaagccgaggaagtgcggcgtgccggtgaacttgagccaggtcccgccgtcgacgaacggcccggcggtgaactgctcggcctccttctggccgatgacgcggaaccccttccagttgacgcgcttgctggtgccggcgccggggccgcggttgttgaactcggcgtagtaaagcgtgttgagcgcgaattcgccgttccatggcatgtaaccctccggcttgatgaagtcggcgatggtgctctccatgatgacgagg

SEQ ID NO: 19795 - DNA, 805 bp, Oryza sativa
  unsure (1)..(805): unsure at all n locations
cataaattaattatttcagtttttgagtcgtggtatatgattttgtagagcggcagccaaatgatccgccgcttgaatggcaaacaagaactcggattgcgctgggatctgccagaggattgtcctacttgcacgaccattgtgatcccaagatcattcatcgtgatgtcaaagctgcaaatattctgttggatgaagattttgaggcagtcgtgggtgactttggactggccaaacttatggattacaaggacactcatgtaaccacagctgttcgtgggacgatcggacacattgctcctgagtacctctctactgggaagtcctctgagaagactgatgtttttggctatggaatcatgcttcttgagctcattacaggacaaagggcatttgatcttgctcgtcttgcaaacgatgatgatgtgatgttgctcgattgggtaagtaccaccacatctttatatattggggcaaccatggaagttttggttttgtttttccttgtgcatgctagttgtcctccaggacacatctttcttagctgtgtctcagttctagtccaggaattagaacaaatggttgaaattattggactgttggcagtgataaagcgagctggcagttcagtctccatgtgtcatcaattatggagatgcacgccatgacaaattggcagctagtttttcgccatttctgataccgagacatgatccatctgcacgcatgacttagcaaaattttgtactactacatttggannnnnnnnnnnnnnnnnnnnnnnnnnnnnnnnnnnnnnnnnnnn

SEQ ID NO: 19796 - DNA, 624 bp, Oryza sativa
aaaactttgttttatggagaaataactcgagttcaatagatgatttggttgcatgcgcgatcgaaatgttgcgtgttgtttggaagtgttatttaccttgccgttggattagtgtttataacgctattatatatagagaatgatcaaattaaattttgcagcctctcacgcgccgactgccagagttaattttccagaatacctgaatctgaatggcacacccttgcctttttgctctgttctgagtttccctgcgcggcgtatctggagcattcagtaggttccattccaagctgaacaatgttaccaggaatgccgtgaatcgggatgccgacggatgacgaatcctctccgaaaatactgtttcttctctttccaacaagatgtcatatgattatattatgttaaaagaaaaacatgtgtttcaaattattagaactcaaagtttcatatgtgatagtaatatgtttcaatgcaaatctttagcgtgtttcataaaactatctgccactcctctctctcgtctctcttcacctcatccatatatgcatgtatgtatttagtgaccttcaaaacttttttctcctaaactacttatctaatctacgatccgatcccactgtt

SEQ ID NO: 19797 - DNA, 1387 bp, Oryza sativa
  unsure (1)..(1387): unsure at all n locations
aggcgcacaccacgaggcccaggtagacgaagtaaagcgagtactggaacgagcaaacaaaaggccacgggattaagcgtcaatggcgagagcacggaatggcacaggaggaaagacgagagctatcaagcagcgggacatgggacgcaggatacgtgccttggacacctcgtcggtcatccggcggaggctgtgctggttcttgccgaagccattgatgagctcgccgaagaggaggaagaacaccggcatggcggcgccgtgcaccaccgccccggcgctcccggccgccatgagcagccagtcgagcgggtccgcgaacccgaacagctcatggaacgccacgctctggtccaccctcttcttcaccgcctcgcatccccctccgccaccgccgccgccgccgcagctccctgactcatccgccatcgccgccacgcacgctcacctctttctctcgctctctcttcctctccccctctcccgagccacaggatcacctcacggccttggcattggatctctcagctcacccaaacgcagcctctcccaagccgccgattctctccctctcgcgctccggctgctccctcctcgtcttatactgagagagcggctattccagtgtgcgcaacgcaagcagcgcaactgcggattattttggttgggtgtgcttaaccaaactgcatttctcggggagagggaagcataggagttggagacggagaggatcaggtcaccggatgtgagcctaggctacgccgtgcgccacgccattgacgccgcacgggccgcacggctaagcaggggtccgatgcagttttcagtgcggtgattttcggtgaccgtacgccgcacgggagggctgcgaaggtttttgtatttgtggctgccactggacggtggggctcgcatgtcagaactcctgatcgtatacgttacgcgcgagtgagacgagcgcaacgtacagtacaaccgctggacgtacagtacgtgtgtagggtctagcagccatgtatggtaatggtacgtgtacgactacacgccagcgtattccgtgaatgtacatgacaccgtgacacgggttttgcgatcgattttacttttctcccctttcgattgcagtatactactactggacttgggttgaaaaaaaaaatagttaattgcatattggactggctttctttactatgttcgcagcttggactaggaacaagctattattttcactttaggctagtaatttttacaatatgttacacttaggacctagtgttcttcttccagctctgctttctcactctctctaccttcagtttnnnnnnnnnnnnnnnnnnnnnnnnnnnnnnnnnnnnnnnnnnnnnnnnnnnnnnnnnnnnnnnnn

SEQ ID NO: 19798 - DNA, 1051 bp, Oryza sativa
  unsure (1)..(1051): unsure at all n locations
ctaacttggtcagtttggatctttacctgaacaacttcactggttttattccggaaaccttggggcaactctacaagctgcgtttcctgtaagtgtactccactttttttttattatgaatagaattataaattgtgtatatcattgaaggccttcctgtttgaatgatcataacataattctttatttgcatgtcttcttgtaaggatagtcgtcttaacaacaacagtctttctggttcaattccaaaatccttgaccaatatcactactcttcaagttctgtaagttccctttctgctaattcatatttggtgtctacctgtagaaattattgcttacatggtaatagactttaagatggatacatattaacaaaatgtccaataatttatgcagggatctctcaaataacaatctctcaggagaggttccgtctactggctccttttcactctttacccctataaggtgctttttctagatagaatttaggttcttagtgcttactacatcttgtgaggctgacaaatggttatttcattgtcgcagttttgctaataataaagatctttgtggcccgggtactacaaaaccctgccctggagctccacctttttctccaccacctcctttcaatcccccaacacctactgtgtcacaaggtgattctctatagttttaattctgttacatttgtgatactgcttgggatatgcatatgcataaatgatgcagacaggggatttgacatattcgggtggaattaattctattccatcaggtgactccaaaactggagcaattgctggaggtgttgctgcagctgctgcattgctgtttgcggttccggcaattggatttgcatggtggcggcggcgtaaacctgaagaacacttctttgatgtccctggttggtattatagttgcatactgcagttcatgatacttatgttatccatttaaataatctatattctcctttnnnnnnnnnnnnnnnnnnnnnnnnnnnnnnnnnnnnnnnnnnnnnnnnnnnnnnnnnnnnnnnnnnn

SEQ ID NO: 19799 - DNA, 1135 bp, Oryza sativa
  unsure (1)..(1135): unsure at all n locations
agagaaaaaaaagaaggtacgccggccagaaagcatcaacggaggaaaatttggtggatgagacggagtgacaagtgagctgtgagcaatacatggaatctctcagggttttttaagtgacggctgagtgtggggttgtgggggtggagatgtgcttaccacgtgaacaaccctatatactttgacccaaggctggcaggcatctttctcgttactgtttttcattgtgggagtagaagcacaacttccttttcactgccaactctagattgcacccaagtggatttatcgcagatgcaagctgttgcaaaagcacaactgctttacttttttccccttctataatttgagcaaataatgcagctatccattttcagatatccttctacattagtgtatggctgtatttagttctttaggtgtaaaaactttgaagtatacggacgcacatttgaagtattaaacgtagaataataacaaaacaaattacagattccgtccgtaaactgcgagacaaatttattaaacctaattattccattattagcaaatgtttactgtagcatcatgttgtcaaatcatgacgtaattaggctcaaaagattcatctcgcaatttatgtgcaaactgtgtaattggtttttttccacatttaatgccccatgcatgtatccaaatatttgatgtgacgtttttggcaaaaaaaaaaactttggaatctaaacacggcatatgtctgataatgtctaaaacgtactaggtaccatgcatgtcctgtgttctaaaagtggaacatttggaaacagttaatatgtggcagtatatacaattgattctttttactctctctagggcatgtacaatggtgtttaataacggtctctcttcgttgtcatgcaagtaaatttggtgacgtggaagaaagagaggaaggaatgagaaacatcgttgctacgtatgacaacggctcagagtcgactcttagcatttattaacataaaatttgttgcatgaaagtgcagaaaaggaaagaagtataataaaaattatttagtatattaatggtttagnnnnnnnnnnnnnnnnnnnnnnnnnnnnnnnnnnnnnnnnnnnnnnnnnnnnnnnnnnnnnnnnn

SEQ ID NO: 19800 - DNA, 839 bp, Oryza sativa
  unsure (1)..(839): unsure at all n locations
nnnnnnnnnnnnnnnnnnnnnnnnnnnnnnnnnnnnnntactacttagaaaacaaagcagaaaacaaagcaccaccctaacttttgttaggaaatataagagatatctaggagaacctaatcgtttaaaataaaaaaaaatgttgctctaatttgatccaaagaagactggaaccgaagtggcagaaaattaggagggtatatccacaagcaatcaagtatccatagtaaaaagaattgtcctaattaattttcttttactggtattatcatgctccattctaaacaaacagagttaacgctagaaatgtcaattgtgcattcaggatatgtatggtggcaacgaaacgctgaaagcaaggggagctctatccatagcagttccaggggaaattgcaggtctgtatgaggcatggaagcgccatggcaagcttccttggaagaggttagtgatgccagcagcaaagcttgcccgtgcattcagagtgtcaccttatctgaggaagcagatggaggcaaccagagatggaattctccaaaataagggaataagtggagtgtacacctcaaatggagatatccttaatgttggagatgtatgccgcaacattaggcttgcaagaacactggtggctgtcgcggagaaagggccggatgtgttctacaaaggcgcagttggtgatcagctggcgaaggatattcaggaagttggagggatcataacaatggaagatctgaagaaataccaagttaagatacgtcggccacttttagagaatgtattgggactgannnnnnnnnnnnnnnnnnnnnnnnnnnnnnnnnnnnnnnnnnnnnnnn

SEQ ID NO: 19801 - DNA, 713 bp, Oryza sativa
  unsure (1)..(713): unsure at all n locations
nnnnnnnnnnnnnnnnnnnnnnnnnnnnnnnnnnnnnncgacttcaggtgctccgacgtgtcgtgcaccatcgacgcgtcgctcagcatggtcatgggcgacgacatggtgaaggtcatcgcctggtacgacaacgagtggggatactcgcagagggtcgtcgacctcgccgacatcgtcgccaaccagtggaagtgagaacgtagaagctgctgctgctgctgcctttgtaactccacctcgctccaaaaattttccccagacttcttccttcttcctctcgatcctttgtaatgagaatttcgaagtttcgagcgcccaacacagtttcttgtttctttctttgcttttcttccccacctcatctgacttttcactgtccggcacggattattatcgacttccggcaattggaaatcgcaatgctgtgtaatgttcatgtgtaataccgtatatactaccggacaccggttgccaggttctggtatagaatttcagcatgttgcttgggaccatttttgttaggttttctgtgatgcgtgaatcttaattaacttataacatgaggaaatgtaaatgacttttaaaggtaaaactcacagggaaaataaatacgtaatgaattaggagcgagacccgctttagatacaaatttaacggtgaccagaggatcttaccacgatcgagacgatgccgtaaatgcgcgatgaatg

SEQ ID NO: 19802 - DNA, 776 bp, Oryza sativa
  unsure (1)..(776): unsure at all n locations
ttttacttatgaaactaaaactccaaaagtatcatttttttctttttctgtaacttccactttctactccctttttattttcttagtccatgacatatgccatgtgagataaaaatgagcagatagttaaatccttggctaacgacagaaggatattaatgagagtttgaggcatgtacatgccaggccaccagggagatgaaatgaattgaatgactaatataaaatgttgcacaccgaaatgagatgagagaaacctatggtaaacatagtgatgatagatgacaattctctatagctaatcaaaagacttctcaccttgagaacagcaagatctttagaacggtcagcaccaaccaatttgccttcaaaatttttctgtatcctttcaggtagatataggagagcaccagagcattaacgattagttggcttgcatatacaaggaacattgcaattgtatatacattaaatcatgaaactatcctgtaaaatgcagttttattagaatttacccatcagcagcaagaatgttgacacgcgcaacaacttcgccaggctttggtttttttgaaagggcattgccaaccactgtcattgcaccaacaattaaaatgaataagatgagtgtgcaacagggtgaaagggtcaagcaccataattatgtatgaaggaatttagatctctcacatatgatgggtttttaatttannnnnnnnnnnnnnnnnnnnnnnnnnnnnnnnnnnnnnnnnnnnnnnnnnnnnnnnnnnnnnnnn

SEQ ID NO: 19803 - DNA, 639 bp, Oryza sativa
  unsure (1)..(639): unsure at all n locations
nnnnnnnnnnnnnnnnnnnnnnnnnnnnnnnnnnnnnnagcatcacttgctacaagcacatcatactcattatcctgctcattaaacagctttgcttgctgccgccgtgtctctggtggaagagctccatatataacgcaacacttgtgcttcgtaaacttctcgattgccagtttcacctcaaatatctctctgcgtgaaaacgcgacaatgcagtcaccagagcgcacattcttgaggtctccaagcagtgtctttgcttcaacaacaagcggtttgaagcgctcatattgatgcacctccaaatcatctccagtatctgcgcaaatcttccgaacaatcttcagaacactagggtcaccacagagatgtatctcgtctgccttgagcccaagaacggctcgtgtccacgcatagcccctgacagggtcagccatcatctgtatctcatcaaccactgcaacctcgtagggctcctccgtggagagcatttcgatcgtgcacgcgacgtggttggagaatggcacctccttgatcctcttgtccgtgccgaggctgcagtagacgccccaggcattgaccctgtcgaagacctccatggcgaggagcccgagcgggctgcagtacacccccgacttg

SEQ ID NO: 19804 - DNA, 732 bp, Oryza sativa
  unsure (1)..(732): unsure at all n locations
atgtggtggcggcggcacgagaaagaagagagaaaggtagatttggagagatttggcacgaatcttaaagccatcctatccgtccaaaaatcaattgacattttccaaaatttcagctgcttgtagcaagtccttcaaaccgtttattaagaacacgtccaaaggatggttctgagttctgacttgtgggagatagttttgcatgatgcggcggcggcaggcatcctacggcgcacgtgggtgacaactgacaagttcaaaatcttatcattggcccgtttcagtttctttttttcctttctttttgaagagctgtgcacagtttcaagagtggccacgcacgtactagcacacttgccaacttccccaatgacaaattgtcatcccactcgctcgcgggcggaccaccggattccggccgatcgagcatgcacaacctgcgaccaatgcaagcggaccgtgtacctggctccgtttcgctgcgacttgaggacacaaacggatgaaaggatcagatcaatcaaaaagatcacacgctagcacgcgcgcagcgcaggtgtctgtccgtaaccaggctggtccggtcccgcctcgaacaaactcgtccgagatcgcggccggtatccgcctatatctacatctatatcaggagaccatcgagaatgagtttnnnnnnnnnnnnnnnnnnnnnnnnnnnnnnnnnnnnnnnnnnnnnnnnnnnnnnnnnnnnnn

SEQ ID NO: 19805 - DNA, 744 bp, Oryza sativa
  unsure (1)..(744): unsure at all n locations
nnnnnnnnnnnnnnnnnnnnnnnnnnnnnnnnnnnnnnnnnnnnnnnnnnnnnnnnnnnnnntgatggcattggtggcgacggcggatttgggcaagcgatagcaccggtggtggaagtggatgacgatggctgatggatttgggcgagaaatagatagcgatggtgctgatggtgaatctaaccgagcgatggagatatcgttagctggggattaattgacgtgcatgtttaggagtagtgaccttctccttttttactgccctatgtttggatgggatactaaatggtcacctttcttgagtatacaaaagttacctcttcatcttctctaaggtaacctctttacttttttagagaattcaggggccagctaatatacttgattttcttccctcgtagagcattcacgggatatagtacactgtatctccttggacacgtggcagtttttggagagggctttgcctaatttctaggacgccacgcgacccaacaggatgcaagatcttagtccctgaattaggtctttaagatttccttgttagaaaagagcctgacaatggtcaattgcaaaacaaagataacaatgcattgaccaggccaaagaccagaaatagacactgctcttctgtacgtcaaatgataaccacagaacacgatagaccacaacaacggtcaaaccatccacgcccgtacgtgcgtagccaaactgcatgcacgggcattctcgagtcgaccaccc

SEQ ID NO: 19806 - DNA, 750 bp, Oryza sativa
  unsure (1)..(750): unsure at all n locations
nnnnnnnnnnnnnnnnnnnnnnnnnnnnnnnnnnnnnnnnnnnnnnnnnnnnnnnnnnnnnnnnntttctgtttaatttgttgtgatagaatagaatagaacaggtccagaagcattcgtttttcataaaagagaggaaaagaaaaggaaatcaggaagcaacaagtaccatgtgaatcaaccaactacccactggcttagtggactagtacggatagtggtagcataagcagtaacatttggcatgactaattgttactccatgcattttctacagatcaatcagacgacctggagacctcggccaagtcttgtgctttttaacaaggattggaaaatgactgctctcgagttgattaatttactgataagttgtgacagataaagagaaatatatatccaagtaataagatatcataaaattcttcagttcagtcagcattgctgaaggtttagaaccatttaaatatcgtgttgagtggttagaacatcgtaatcagtcgggaatcatgtgattgaactcattatctagaaaaccatatgtaattgaatagcgtaaacgtaagtgaagtcgccggctttgactacaccggattgtacgctaccgtacgcgagtgattgggaggatcggaatcgcgctgacctgggaggcggcgaggggggcggtctcgcgggagtcgtacgcgagggcggtgccgtccgcgagcccgacgagcatgaaagcgcccgccacgaccccggtggacgccg

SEQ ID NO: 19807 - DNA, 858 bp, Oryza sativa
  unsure (1)..(858): unsure at all n locations
nnnnnnnnnnnnnnnnnnnnnnnnnnnnnnnnnnnnnnnaatgaggcacaatcattttgcgtttttgtgctcgttcagtttctagtgcgatagcacatagcgtatattttttttctactcaagttagattagttgaagtaatgttctttcactttggaacggatgatttttccatactgacgctggaattgaactgttcatatgagaatcctataatattattgtgtgattcctatgctcgaaagggaaactaatatgtataatagtagtgttcttaaccattatatagttccaatcaataggtacttcaattttacacaacatatatggcaacatagcaaatctgaataaaggatacagtaagcagatgccacaaacaactcaaagttacatgggccccaaattttatcacaatctaaatatggtgtgggatttccaagttggtactttgtgatcaataatagagggattttgccatccttgaagagataccaaaagatactccacttaagattgaaaataagctggaccaaattaactgaaaagaagtgaatcatatacgaggatactttccacattgagctttaggccttgttctcctagtagttttttctttaccgcgttttcagcagcagtattgattgcttggtatcttctgaagtgcacttaccacagtttgacccccccatccactgcagagggaggctctggagatactgagaaacaactcccctgaagaggctttcaggattttcacccaggtaataagctgtaatcactcctacacattcgttacttgcagattccagggagcactgtcggcacagaaattctctcgtaacatatcatagcagcaca

SEQ ID NO: 19808 - DNA, 578 bp, Oryza sativa
  unsure (1)..(578): unsure at all n locations
nnnnnnnnnnnnnnnnnnnnnnnnnnnnnnnnnnnnnnnntgcaagccggaagaatcccgggcttttctcttgccgcaacttctctatgagactgaactggctagtgaaaaattctcgtcttttcttcccccatgcgtcttattgcaaatcaacgcatatcatattattgcaccgaccgacaccgacaatgtcacaacttacagcagatgaagcgatcgaccaatgaccacatatgatccatgtatagtcacctaaactagaacgagaacttgtacaccatctcgtgcttgtacacctgtccgggcctcacgatcaccgacgggaagttggggtggttcacggcgtcggggaacccctgcgtctccaggcacagcgcgccgtactgcccgtacgccttcccgcccttccccttcacgtcggccgtgaggaagttgccggtgtagaactgcaccccgggctggttcgcccacagctccagcgaccgcccggacttgccgtcccggacgacggccacccgccgcagcgcgtgcgcgtgcgcgtcgacgtcgtcaccgccgtccacggcgtagttgttgtc

SEQ ID NO: 19809 - DNA, 761 bp, Oryza sativa
  unsure (1)..(761): unsure at all n locations
nnnnnnnnnnnnnnnnnnnnnnnnnnnnnnnnnnnnnnnnnnnnnnnnnnnnnnnnnnnnnnnnnnacggcgcggatgatgctcacgagctcggcagcgccacctctctcctctcctttctagcccttgcccgcccgcccaccttcgtcgctccagccctcgcccgctgccgctgccactctcgtctccggcctcctcggccacggccatggccaccagccaagagacgcgctgccgctccagctctccccacaaatggcaaagggggagagaaagaaaggaaagaatggaaagggagggaggaggaagaagggaaggagaggatggttgtgggccccacgtgtaagtgggtctcacaatattttttttgtgaatgacaaatgagtctcatatgtatatatttaaaattcaaatgctatataaacgccacgtcaatgccacgctggatgaagatcggatcaatatcgtcatgtagacactacgtcagcgaaatcgttccctagaagcaccaagggagtgaaattgcattggttttaatagttagaaagacaatatatttagtattatggtttagaaatacgaatcagattcccgcggcgtttctcaccactcgtgggccgtggtgcgtccgaagaatgaacctgtgcgctgtacgagtgcgagagtttgcggagccgaagaaacacccagcgccccttttgatctaccccacaggccacagcagcagcagccaccctcctcgcaaaaatgaaagaccaaag

SEQ ID NO: 19810 - DNA, 680 bp, Oryza sativa
  unsure (1)..(680): unsure at all n locations
nnnnnnnnnnnnnnnnnnnnnnnnnnnnnnnnnnnnnnnntaaaaatcgtctttaatgtcatgaatgaattttgccaactaactttaagcgtgaaccatgtgagttgttgaggggaaaaaaaggtaagttcgatttgctactcttaaccatcgtaaatatctgatttattcccctaaactataataccagtggcggtgacctccttcccacaggttctccacctccaactcggtgtagcccatgccatagattgttgttagcttgatgtcgcaactctcctctctctgccgccatatcggcacaatagttctttactcagcaatacatcctctctctcgaaggtgacggaccaggtggacgatcccaacggcactattccttagcgagctcaatgataggggacctatgtgttcctctgccgcttgattgagagagaaatacataaagaaacaataaataagggaattccagcggaagaagaaatggcacttgtgtaatttactgactgaattgacacgtgtgtgtcacgtagaataaaaaaccactctcaactaagttgaggtaattccagtggcagagctaggcattttgtgaaccgctaccagacatattaaacagttaaaaaaacaaaaaaaattattatagaagtggactgttagtatgcctggtctcctgcatt

SEQ ID NO: 19811 - DNA, 709 bp, Oryza sativa
  unsure (1)..(709): unsure at all n locations
nnnnnnnnnnnnnnnnnnnnnnnnnnnnnnnnnnnnnnaaattaaaaccgattcaaacacggatgacgtatcaaagtaccgataaaaacatcttaaatttttataatagtagatataagctctctatctagtttgtaagtctaattagctttattgtgtggtgtgatgttaagtgtttctaattcttgttattattgtattacgttgtatatgtatgcaacatccgatatttttgattcgtttataggccgtgttatcttcgactctatatcattttcaacgctacatccacaccaaatcccaatccgctaaaataatttggtatccattcgagtatccgaatccatactgttttcaacccttaggctatattcgattaatccccacaaacccctccaatcctcttcaacactctttaaaccgagcaaggccttaaggggactgagtgcaaatacatggggacctttctgaaaaaaaagtacaaaaataggggctatttggaaagagggggctctgtcaaaaacagcatcgtgtggcctgtttaattgggctgagatggtctgggccgtatgcccgtacacctctcccatccggccatcccccacgataccgtcagtccgtcacgccccagaattgtgtgagggttcaaatcatctcgcttcacggtggtcgctcgcaaagcacacacgcacgcacccccaccacttct

SEQ ID NO: 19812 - DNA, 712 bp, Oryza sativa
  unsure (1)..(712): unsure at all n locations
nnnnnnnnnnnnnnnnnnnnnnnnnnnnnnnnnnnnnnaaatatatatcgatataaggagtatatatcgttaatatctacagccgatcgagtagatttagttctttcttacttattcacgactgccgatcgatacacagatgacatcggctcaaagataaatgatatgtcatcggcatctggccgatcggctatcatttatagatttaaccgcgatttctttgcttttatttcttgttgattacatgatcaaatcaactggcatgctaacacacccgaaggcgagctttgacctgcactggagttaagcagatctcccaggccacgtgttttctgtcaacaaccaggcatgatatttcataagtactataccatgctaacatcataataacgtcagctattttgtttggaacaatataccgttttgtagtatttctatttatagaagtcgtggacttacgtcctgtgttcggatgaatcaataatgaggttgattatgcacttattttcctttctttcgaccttttgcatggttttattttaccatgttgtttagaaaaaagaacgttattgagctataatttactagcatcctggaaggcttcaattattaactattcaaactgcacatttgctattcatctatgcactaaaatttccccaaatttcagacaatcggtgattttttgtggattaagatgcaatggcatgcc

SEQ ID NO: 19813 - DNA, 821 bp, Oryza sativa
  unsure (1)..(821): unsure at all n locations
nnnnnnnnnnnnnnnnnnnnnnnnnnnnnnnnnnnnnnnnnnnnnnnnnnnnnnnnnnnnnnnnnnttgcagaagaagaagatgatgacgatgatgatcgagcagcagcaggtcctagcttggtgagcgatggaccctggtagagagcgaggatcatcgctccgctgaatcctaacactgtgcctcccacttttgctatgccagctcctgtcttcaggtccactttctccagcctgcactagtactagcttagcttacatctttccgaggaagtgatttcatgcatgccacctaaatagttataatttttttaaaaaaattgtcatctatattgctaattttttttaaaaaaattaatatctattttgatgacatgcaaacaacgaaaggatgtctccttgaggaataaaaatccacatcccatctttcaaatatttcttcttctttagtactactcctaagtagttactccctccattccaaaatatcactctgtccaaatttatagtattaggatatgtctcatccggttctagattactatattctaaaacgagggagtagttaggttgttaattgcgtacccataaggcagtgctacaatgaaagtgaagatgggagtcatgttgatgaaggcgcaagcgaatgttgctgtggtgtactgcagccccaagaagaagagccattgggtaagggacgctctgcatgcaccattttattattattaattactatgtaattaatcaattcatttgttagagaaaagaatatatatcgatctttcaattcatcaagttaaaattgctagctactactagata

SEQ ID NO: 19814 - DNA, 739 bp, Oryza sativa
  unsure (1)..(739): unsure at all n locations
nnnnnnnnnnnnnnnnnnnnnnnnnnnnnnnnnnnnnnnnnnnnnnnnnnnnnnnnnnnnnnnnnttttgcactgttataggcaagtactatcattttgtgcatagtagaaaccataaacagtaatacagtatagccatcaagtaactagtgacaaaagtgtttatgcttgtcagtaagtaatatacagatgtaaaccagtacaactaatggtagtttccaggttgggttctgagaccagaaaagggtaatcagttgataaatcattaaagaaacatatctacaaacctgttcccagggttaatagctgcatctgtttgaattccacctccaattgttactccagcttgactgaaaatgtctcgatttaaaccactgatgacaccaacagttagagcatggtcaaagccaaatggatttccaattgctaaacactgttgaccaactcttagagctgaagattgtcccacgttaattggcttcaacagatctgtaggagcatccacctattgcatgtccataatccatatatgaggtactatgtctgacaacatttgagctcaggtgaaaatcacaacaggactttacgcactaacaaaccgtaaaattatctaatacagcccttcaattgtttgccttgaactagattccattgggacaaggcangcataagatgagtanggtaattaaaacatctttggtctaaaaacatacatatactatttncgtaaaagaagaaa

SEQ ID NO: 19815 - DNA, 6648 bp, Oryza sativa
  unsure (1)..(6648): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgtgttatgatcattttagtttattgaggatgaacttttactaattggacatattctcttttgaatgctaagtgcagtgcttgacatctgtagagaaagcatgaacatctactaatgttacctccgcaaatcagcatgaaacaattcagtgctatttgattaatacatttcatgttgagataatctaacctgtctgtgtgaaaattgctgtattaataccaatcatatgccccttcgaatccagcaatggaccaccactgcatggacatacatcagtatacatgcttagtaaaaccctctataatacattttcagaaacataaatatccaacacatattgtataaaccactacttacaacatgatccttaaccctagatgttcattgccccagagtacaggtaatgcatactaaatcacttcaaggacgagggcatacatggtcaagctgattttgaccacaaatatgatcaaattctaccctaatatagtaaactggtagcaacaaatattaccactatgccaactgccagagctgcaatttagccccaatctatgtgtcctgactttagatgcgatgctagaaactcaagaaagtaagaagtaaaatacttcctcttctgtgtcctgagtcaactgttttgcactgttataggcaagtactatcattttgtgcatagtagaaaccataaacagtaatacagtatagccatcaagtaactagtgacaaaagtgtttatgcttgtcagtaagtaatatacagatgtaaaccagtacaactaatggtagtttccaggttgggttctgagaccagaaaagggtaatcagttgataaatcattaaagaaacatatctacaaacctgttcccagggttaatagctgcatctgtttgaattccacctccaattgttactccagcttgactgaaaatgtctcgatttaaaccactgatgacaccaacagttagagcatggtcaaagccaaatggatttccaattgctaaacactgttgaccaactcttagagctgaagattgtcccacgttaattggcttcaacagatctgtaggagcatccacctattgcatgtccataatccatatatgaggtactatgtctgacaacatttgagctcaggtgaaaatcacaacaggactttacgcactaacaaaccgtaaaattatctaatacagcccttccattggttgtccttgaactagattccattgggacaaggcaggcataagatgagtaggtaaataaaaacatcttggtatctaaaaacatacatatactatttccgtaaaagaagaaaggacggggcaaacaaaagtatgtattcttgacctctgaaaggaacctccccccctccccccccccctcagtttcgtaacttaactcttcaaaaaacatttcaatcaaatagcatgggacccctaactcaacagaagaaaatgttgtgttactgtcacaaataaactattataccataacaaaacaaaacaacaaaaagggaaaaactgaagcagttggctaaagagatgaatttttacttatgaaactaaaactccaaaagtatcatttttttctttttctgttacttccactttctactccctttttattttcttagtccatgacatatgccatgtgagataaaaatgagcagatagttaaatccttggctaacgacagaaggatattaatgagagtttgaggcatgtacatgccaggccaccagggagatgaaatgaattgaatgactaatataaaatgttgcacaccgaaatgagatgagagaaacctatggtaaacatagtgatgatagatgacaattctctatagctaatcaaaagacttctcaccttgagaacagcaagatctttagaacggtcagcaccaaccaatttgccttcaaaatttttctgtatcctttcaggtagatataggagagcaccagagcattaacgattagttggcttgcatatacaaggaacattgcaattgtatatacattaaatcatgaaactatcctgtaaaatgcagttttattagaatttacccatcagcagcaagaatgttgacacgcgcaacaacttcgccaggctttggtttttttgaaagggcattgccaaccactgtcattgcaccaacaattaaaatgaataagatgagtgtgcaacagggtgaaagggtcaagcaccataattatgtatgaaggaatttagatctctcacatatgatgggtttttaatttactgactgccataccatggtagtttgtaacaatatggccggaatcatcccaaactacgccagaaccatttccttcgggaatctataatgaatattaagaagtttctttcaaacaagggcttctaaaatttctattaaaagtaacaataagactctacacatgatatctgcgaaagatatacaggacatcaagacaataaatcagcaattccttgtctaactttagcttgatcgaatcaccagttcagaaagaaagaatgccagacttgtcctatcctagtgcttctatggagaatactagtgatgcatttgtcaatttgagcaacaactaacacatactcttgactctactctaacctataacacgaaagcacattttagttttacctcaacaacaccagttacattgagctgagggcgcagagttgcatcaaaaatgttgacaacagagtaagtatttgtttcaaaaagctctgcgatccgtttctgccatgcaagccataaaagaagaaatatccaaagaaatgtaaatatatttttggaagaagtaaaataggataaagtgggttcaactaagtactgacctcagttggaaacagtggaccagatggaaaaatctttggagtgacatcatcaattttaacagatggatcacccaaagcaagtgctgtatttaaggagttgtaagttacaaagcatgaacacttatagagtaaattaaatactacaaaagcaatcatttgggtaggtgacaactgacaaggatcgagttaatttctattaacacctaaattatcatgccacttagtccgaacctgagaagtaccttgaagaatgtaagcaaaagcaaaacgatgataatgcaacaagcttcctccttgacgcaagcaatacaggtttacttgacatttcaccatatgtttccatcattgacctggaatataatttcagataaacataaacagatagagtgaataggaaaacggtcaaccaactatgaatacctaatgcaggtgcacatagtcacagagtgagcgccgtgcaaaagacaaatactactaacagaacatgagaaaatgtggacgctgcttgatggtgagttaactaacacgaatgttctcgcacatcgaattttcccctaaaaattcatcaactactactctactagatatcaaacggaacacaactggaataatcaataatctcccgctagaagcaaccgagattcagcaagcgaaaggtacccaaattgggccatcctacactaactacgcaatacagttatccagaaccaccagattgtaccgatgaaaaccacccggttagaacaaaatttctggcgcaggggcaaggggcgggcatacctcggggccgtttcctcgccgtcgcgggtgaagggggaggaggcggcgcactcgatagccatcctccggcggccgccgccgccgacgcgactgcccggggcgcgcgcggccggagcggcgcaggcgaggcagtgcatcccaggttccgagcaagcaatccagagccccgcggggtctcgaatgggaggagtggtgggggtgcgtgcgtgtgtggcttgcgagcgaccaccgtgaagcgagatgatttgaaacctcacaccaattctggggcgtgacggactgacggtatcgtgggggatggccggatgggagaggtgtacgggcatacggcccagaccatctcagcccaattaaacaggccacacgatgctgtttttgacagagccccctctttccaaatagcccctatttttgtacttttttttcagaaaggtccccatgtatttgcactcagtccccttaaggccttgctcggtttaaagagtgttgaagaggattggaggggtttgtggggattaatcgaatatagcctaagggttgaaaacagtatggattcggatactcgaatggataccaaattattttagcggattgggatttggtgtggatgtagcgttgaaaatgatatagagtcgaagataacacggcctataaacgaatcaaaaatatcggatgttgcatacatatacaacgtaatacaataataacaagaattagaaacacttaacatcacaccacacaataaagctaattagacttacaaactagatagagagcttatatctactattataaaaatttaagatgtttttatcggtactttgatacgtcatccgtgtttgaatcggttttaattttattttcagttttaatctctgtatctctatctctacttaaaaagaataagaaatttccaaagtcggtaaaaaagaaaaagaagtccgactaaaaaggtaaaagaaaagtccgactaaaaaaaggataaaaaagcttctatcgttgtaagaaagaaaatcgtccgactcaaggaaaaaaagggggaaaaagtctcgccagtaaaaaaacaaaaaaaaaagtccgtttgtgtttttttactggcgatttttttttcacgctaaagagtttttttcctgcgcacgcgttattggtttttttttctggttttttcaatcacaccgcgcctcccgggcgcttttgttttttttttgtcaatttttttcaccggttttttatcccatgcgattttggtttttctcatctggttttttttaatccgatctattcgcggcacgtgtaccaagttgaaccctggcgacgcgctagcgccatatcgatcgtgcgttttccctccaatttgattgcaaataaaaaaatcgattcctactcctccctcatcattctctctatgattttcctcgctttattttgtcggatttaatctaacggttgccgatgatgacggcgatctttcccgattatttttatcccgagttttatgctctgattttgggtaaaacggaaaaaggtgagtggccggataaaaaaccctcaaccaattttgggtgattgaggaagattcgtccggatttgatgggtcgaaggaagcaggccaaacgaaggaggtagcggaccgacctagggctaaaaacggcttcactcgtgactgggtcgaaacaagcaagctaaatagagggaggtagcggactggcctagggctgaaaagtaaggaatgctttcgccccaaaacccaagaaagattttcattaactttttttaattataatatatagcgatcccaatattagaattttcattaactttttcaattataatgtatagcgatctcaatatttcaatttgttgctcagctcttaatatatcattgaaaaaacgtatttactcattgcaacgcacaggcattttttctagtaagagaaaaaaacaaacaaatcatttggttgagctatgatagcaatataatcatatggctagttattaaaaattgaattatctggatagcactttgttagataattcgcattaaaaaatcggataatatgcatcattgaattttagcaataccatattctaatcctaatacgccagattttacaaaatattttaccatattattagttctattggattcggaccaaaacagaaaaataaccgatccatttttcatcccttctggtaaaccatggacctcgaagtcttaactccctcaaaggttaagataaaatacggagaaaattctatccgtgatccaaaaatttatcccaaatcaaagaataccacaaaattttcacaataccaatcaataccacataaagaaccaaatgatgcattcatctttctctcctcatcccctctcatctgatctttggagtggattcatcctcttccggagcttgagatagatgccattgtcgtgtctgccattgccaaggacgaggtggtcacaccgaggcttcggctggagctcgatctagatggcgtcatcgctgctattgtcgtagtcttgatgattaatcaattcaatcttggctgtcatgagaggagaggttagatttcgtggtatagatggaaaatttggttattagatttcgtggtatagatggaaaatttggttatctttgtggtattatttggcattcaaaaaattttgtggtattctttgattggagaaaatgtttgttatgggcggattttcttaaggaaaaagtacaccaaaggtccctcaacttgtcatcgagttacaaaatcgtcccccaaccacaaaaccagatatgaaacatccctcatcttgaggaataagaagcaacccataacaaacatttgctccgagaggagagaagtgagagagggagatagaggaggaagggagaggatgg

SEQ ID NO: 19816 - DNA, 10416 bp, Oryza sativa
  unsure (1)..(10416): unsure at all n locations
nnnnnnnnnnnnnnnnnnnnnnnnnnnnnnnnnnnnnnnnnnnnnnnnnnnnnnnnnnnnnnnnnnnnntttgctccgagaggagagaagtgagagagggagatagaggaggaagggagaggatgggatgacgtggcatcctaacatgtggggcccatgtgggtcacatgctgactcggccactacgtgggataaaatcgggctcaagaccactgagggacctaaagtaaacggttttgtaagttgagatggatgtttcatatctggttttgtggttgggggatgattttgtaactcgatgacaagttgagggaccttcggtgtactttttccttttctcaaaggttagctatcaaccccgccgactccgctggaggcccaactcggcccacggccaattactgggccgccgcctgtcgcgcgacgcctctcccttcttccccttgccccatgtcgccggccgcctcctaacccgacctactaccctccatggccgccgccgccgccatcgccgccgcactcctccgccgctccacatcctctcaacaccaccggcgcatcctcctcctcccactcctctcccacctccagcgggccgcgccccgatccccttccccctgggacccaccgccccaccaccgcttcttcttctcctccgacgtgaccgccgagggggacagtaagccgcggccgcctcttgacgggaagcagctatggcgcgaggtgtcgacctcggagcccgccaccggcgcgtcgcgcctcccgaaggccacgtgggacgccgtggtggcgctcctccgccgcttcggcaaggacccggctatgtccgaccaagccctcgcgctctacatccccgcctcggcgttccccacctacgcccgccgcttccgccacttcctccccgcgcgcctctccctggagtccgccgagcacctcctctccctcccggccgacgacgcgcacgccctcctcctcccggccttcgctgagttctgcgtgacccacctcgcggacgagctgaggaagcacgagtctgtcatggccgcggcggacctcacggcgccgcacgcgtggtaccccttcgcccgcgccatgcgccggcgggtggtgtaccactgcgggcccaccaacagcggcaagacgcacaacgcgctcacccgcttcgccgccgccaagtccggcgtgtactgcagcccgctccggctcctcgccatggaggtcttcgacaaggtcaatgccctgggcgtctactgcagcctccgcactggacaggagatcaaggaggtgccattctccaaccacgtcgcgtgcacgatcgaaatgctctccacggaggagccctacgaggttgcagtggttgatgagatacagatgatggctgaccctgtcaggggctatgcgtggacacgagccgttcttgggctcaaggcagacgagatacatctctgtggtgaccctagtgttctgaagattgttcggaagatttgcgcagatactggagatgatttggaggtgcatcaatatgagcgcttcaaaccgcttgttgttgaagcaaagacactgcttggagacctcaagaatgtgcgctctggtgactgcattgtcgcgttttcacgcagagagatatttgaggtgaaactggcaatcgagaagtttacgaagcacaagtgttgcgttatatatggagctcttccaccagagacacggcggcagcaagcaaagctgtttaatgagcaggataatgagtatgatgtgcttgtagcaagtgatgctgttggtatgggattgaacctcaacattaggagagtggtattctatagtttggccaagtacaatggggacaggatggtacctgttgctgcttcacaggtaaaacagattgctgggcgagctggtcggagaggcagtatttacccagatgggctgacaaccaccttcttgttggatgatttggattatttgatccagtgccttcagcagccatttgaggaagcgaagaaagttggtctattcccttgctttgagcaggtggaaagttttgccatccagtttcctgaccttaccttcaatgaactgctggataagttccgtgaaaattgccgcgtcgacagtacatacttcatgtgtcaccaggaaagtatcaagaaggttgctaatatgcttgagaggatccagggtctctccctcaaggatcgctacaatttttgttttgctccagtgaatataagggatccaaaagccatgtaccatcttctgagatttgctacaaactatagccaaagccgtcgtgttagcattgcaatgggaatgccaaagggttctgcaaagaacgacactgagcttctggaccttgagacaaaacatcaggtcctgtcaatgtacttgtggttgtcacaccattttgaggaagatcattttcctcatgtgcagaaagctgaggaaatgtcaataaatattgcagatttacttgctaagtcacttgccaaagcaagctggaagcctacatcaagacaacaagcaaaaccaagacgagaaaatgaagaagacaacgatgtggagcaggcatcagatgataatgcaaagaatgattcagaagatggttatgaaaggtcaatatcacgtataaaaccgttcatgaggtacagcttccaacccatatgtttcacagatatgctgattcagcaaaattacatacattttttttctttcatatagttctcgaacatatggtactttttaaatgcaatagctcaagatatcagatttgtcttcttatatcaacaaaattagtattttaaggagctactgcaatgcatctgtggaagtgttttattggacccaagaacatctcctgtaaacgaccacagctattatatgaatctgtgtgatggcaaaattagagcaaaccttgtctatttcatgagcctataacataaagtgttctctttagtctttacttgttgaggatggtaaattggtaaggagtaaggacaactatattttgtatgaagtcaatgggcatgctggtgctgaaaacaggcacttctttcatgttcaaactaaaaatatcattatatgcccactaaatgtgcttagaattaaatttaaatctgtggaaaggggctgtttgatatattataatcctacataaaggttgctagttgctacaaccagaaaaaaaaaaatctcatttgcatattgtgtctgctgacttaaggccatgaagtgctatgaatgtgtttgcttttttttgctcatgataattgccaggaaagttgtagcggtatgtaactgtttgtcaccagttttcaatgctggcagtaacttttgattaaactagtggaactatatggttatatcattccattggaaactccacagtgtttcttcaagtttcatgacctcattcattttgttttggctaaactaaattgaaaattcttaataatctacaagaattttatcactgacattggtcattgatgtttcactgatttgaatgatcgcaccttgtaatgtaacactagatcagcagggtttttttttttttcatattagttaagttcctctgaagattaagtccagctaagtttcctgataatgcagaaatttgcttttcatttgccttttttcaaaggaaaatattttttccaattattatcatatacgtacattgatatgtttgaacgaggtgaaaaggaacatctgcattcttgttctcaaggtttaaaaataccatgttaaaagaagaaaaagaaaaagatcgcagagttgattgcgtggtggggccagattttgcccaagtaatttcgtaaatttagaatgtataaaacaattttcatttagaatgtatataacaattttcaattagaatgtagtttcagatacagttatgatggtattgtttgtttccttttgcaggaaaaggctggatagacctagtcaggacccttcttccttgaactttgtggcatgaattacttgtggcctgggtgattaaccccgactgattgcttcatgagatcgtgtgtagccaagtcgttgcagccatttcaacctcccagaactggcagttcatctatcagttctggtgtaggatggttggttatgttggctgaagtttggaattgatcttatcctcaaaatgacactgaagccatccagaggtgtaagctagtatgctttagtggcgccacgggatactttaacttcagttttgtagattatttgcacgagaaggatatatcgacatgaattcatcagaattaagttattagtgttttcctgatatgaacaagggagtaagggactgtggtaataagttagctgggggatatacggtttttttattgggtattcacttagccttggatgtaagggactagaaagtaaacttgttttgtttcagttctgtttgaatcaatggcagcggtataaccttctgcaacgttctcacctgagttttccagtgctcataaaaaaattcttgtgctcagtcagcacacaggtgtaactactgtttctaatcagggatgaacgcgtccatgagcactcatcggcacagtgtaacacgagactagaaaataatatcgcactttgcccgttccataaaaaaacgaacttaatttttcatttggtgcaataaaagggcatctgtttcatgtgttttcaattcctataagattaaagatacatgctactctctcggtccctaaatatttgatgctgttgtcttttttaaacatgtttgaccgttcgtcttattaaaaaaaatttaagatttttttcctatcatttgattcattgttaaatatactactaccactactactcaagtagcttaggataggttagctgttggtgtggtgttgtagttatggttttcgctcagtttcctaattaaccgtgcgctgtaaggtttgatcctgttttctccttaaaatggaatatcttcttcttaatataaaaagtcagcaatggcctgatcgtttgaaaaaaaaagatagaaggtgttgagaggattaaattttaatatatatattttttcatcgatttttgtatatatttacatgcctttgaaatatatttacataaatatacactctccgcgggatagaaacgagccaccgcaccgtcgacgtcacgcggcacaaaaggcgcaggatcgatgggaggggcggtggtgcggcacccacacgcgtgaccgcatgtgtgtaacatggatggattaggtattaataatacaatatatttacaacaaactattatataaatagattattagattgattatcgatgatattttaattaaacttcctcttcagagaaagaaactactatttgtttcaaagggacctagcccataagaaaatgaggcccaacccaacccaactcaaaccggcgaatctctgcgcgcggcccgatataaaagggctcgcaacatacagcacccaccatcccctaacccctgaccacccccccgcctccgcacccgcctccggttgcctcctcccctctcggcgggcggcggcagcagcggcggcagagtcagcagacctcgccgggaagctaaagccctaaagctcgcggaagggtttatcgcaacgggcgatggcggcggcggagcagaaggggaagaagccgaggaccgacggcgcggaggccgagcccgtcgacgccgccctgctgcagtccatcgagaagctccaggagatccaggacgagatcgagaaggtgagtcggcgttggatcctctagcacggcgtggttgctgctgctggggcgtttgtatttttttttagggggctggggttttgggggtttatgggttcgcggagcggtcgcggctcagggggcgcgcgggatttaggagaagttcgactcccgattctgattctgttgtgtttatgatatcgtttcactgcggaacgaacggttgatgaatgattggtttactatggctgggtagacatatggtttgggagatcgggttttcaatttttcggttctctctatggctcaagttgggacataagtgctatgttagatgctagatagcttgtccatgttctctctatggcttgacctgtttggaggcctgatattgtggaattgtgaaagttagcagtagatgttgtgcctgttttgttctgtcagatacttaaaatcagttgactgtgaacccatggccattgaactgtagacgtctagaatagattgtgctacagttaaatgctttatgagcactttgagatgcatgtggagctcattggagagtagttagctgcaaaagttttttcacattcaacttagaggttggaggcttcaaaatgtggtcagaaatgctttaggaaactcgtctgtctttgttcaattcctctggcaatttaaattagttctataatgtaatcgcagaactgtacaagctaaattgggtgctctaatgtccagaaactccacatattctcagacaaagctaataggtgcaaattctcggtttctctggaatgagaaaaattcttgcatgacttggttcatgattacctgatctgcacaacattgcattccagactcccttgtctaccagatattgtgcatcatggattcagcttcgtttcaggctttttatttgacttcataattactccattctattagttttagtatcaggattagtgatttaattgaactaagtgaaaattatcataatcaatgatgcaatctctaaaattgtactgctaacaaagtgttcctttccagaattattgtttgagtacctacaattccaatttcatatgttgattggacctgatacaatcagctggaatgtttagtgggttttgaatgttaggctcttagttcattgcattaactgagttcaggttaatgaggaagcatgtgataaagttctggagttggaacagaaatacaacgaggttcgcagaccagtttatgttcgacggaataaaattatcaagcaaattcctgacttctggctgacagcggtctgtaatatgtttctacaatgatttttatttcatgctctttcggattgaattgttgattgattaaaacctttcatctacttattaattatgctatctactgttcatcttgcagtttcttagccatcctatgcttggtgaactattaactgaagatgatcaaaaggtacctttcttttgtggactactaacattaactttgatatacttttaaatcaaaagtagtatgaggcgtactaaagcaaggaaatattgattttctcagtagtcctatgggaacaatcgacgcacaatgaacacaatgaaatatattactagaactacgtcatgagctttcttattttttattatagattttcaaacacttggagtctatcgacgtggatgactcagaagatatcaaatcaggctactccattactctcgtgagcttctttgcacttgcaagatattatttccttatttcttttaccgtgattacaattgcttgtcattgaactgtagacattctcccccaatccatattttgaagatacaaagcttacaaaaacatattcctttagtgacgatgaagcagtcaaagtaaaggctacctccatcaggtggaagaaaggaatggtatggtacccttttgatcgatctaagtgtttctgttgctatgcttgtgcaaagagaacctattaacctaataacatttttaacatttaaggatattgccaatgatcgtgcgtacacgaagaaaggggacaagcgaatcttaattgatgaaaggttgttatttctatctgtttcacaattttggtcttctcttttctacttggaagttggaagaaatagtagggaccttctataaagtaatcttagcatgctagctttattccttgtttcattcctggtaaacctgctggttatgttgcttgatataattcgataaccgactagcaactgccaaaggcacatgatagcattcttttcactattttgttagctatcatttatatgaactatctgttttttgggtgcggtggaggctttctgccatgtctatatccatttcttacttttatataatattgtgttctttgtttgtcacaactgggttcttggcagttaagttgttaacacgtcttcattttcctttgcagtttctttacttggttcaatagtgaaaagaacagaagttttgctcatggagctatggatgaggtataatcgtcccactggctcgtgctaaaccatgattgtttgaaactttgtttagttgtaaattattcgaagttctatcacaagagttttggaatatcctatgctctgtgaagatgttctctgagaactttatttgcacaggtggcagatgtcatcaaggaagatctgtggcctaatcctttgaagtacttcaacaatgttagtctttctaccgtaataagtggtttgttttatttctgttattcctaaatcctaatatcttgtcctatccgacatctcatttgcaggaatttgaagaagaattagagctactggatgacgatgacgaggtaatcctacctcacatttgtaaatatataaagcgtgatagcttatcagtgtgctcataatggttactcccagtacaacattgcatgtcatcctttcttatgctggtgatattttaacttttcagtaaggttattttagcaatatttttttgcgcttgactggtaggtgaattattactgttgaactttaaccattgtatatctgtatttatcctccactcgcaacatttttaggtatctgatgatgacgatgaggaggaggatgatgaagaccaaggtgaaggagaggaggatggagaggagaactgagctctctgtcatgtcagattcttttggcctggacaacttatgtctgcagaaagcggagaccgggcctcctggagggctgaaacagcagggcgtccccttttgcggcgttgtggtgctcgacttagctggcagtgtagggacttgctccgaaaaactttgttctatggagaaataactcgagttcaatagatgattttgttgcatgcgcgatcgaaatgttgcgtgttgtttggaagtgttatttaccttgccgttggattagtgtttataacgctattatatatagagaatgatcaaattaaattttgcagcctctcacgcgccgactgccagagttaattttccagaatacctgaatctgaatggcacacccttgcctttttgctctgttctgagtttccctgcgcggcgtatctggagcattcagtaggttccattccaagctgaacaatgttaccaggaatgccgtgaatcgggatgccgacggatgacgaatcctctccgaaaatactgtttcttctctttccaacaagatgtcatatgattatattatgttaaaagaaaaacatgtgtttcaaattattagaactcaaagtttcatatgtgatagtaatatgtttcaatgcaaatctttagcgtgtttcataaaactatctgccactcctctctctcgtctctcttcacctcatccatatatgcatgtatgtatttagtgaccttcaaaacttttttctcctaaactacttatctaatctacgatccgatcccactgttatattcgttgcaattaaatctttagaacaagttatcgtatgattatattctgataaaagaaaaacatatgtttcagtctgttaatacgtaatgtttcatacgtgataagtacatgtttttaacatgtgtctccactgtgtttcagtgattaaagttttttgtttcgtttcactagtgatcaactacaacatttaaccgaccgatatttttttaaaagaagatagggcgccccattcaaggaattcttcccaacgctacgtgagaatgtgagatgggcggttttgtccctaaattttttgctggaagcagttgaattcaggcggccgcgtgagatgggccgctcgcttcgccggcccgtccgggcctccgagcgtccccgctcgtcgcctcgtcccctgcctgcgccgcagtggagcaaccggcactaccgaaccgctcggcgtagcatccacgcagcgcaggggaaggaaagccgaagcgcggccgccgcgcgtgagatcgacgcgcggcgacttcgccaaccttccctataaagcgctgccccaatcgccaagcccaccgacctcctcctcctctccagtctccaccaccgacttcttcgtttgatctcgggctccggaggaccggaggatgtccggcgagagatgcgccgggcggccgctgttcggcggcgccatctccagtaccttccccgtccggttccaggtactccctcgcctcccccaccatcctccttgcgaggcggcggcttctcgttccttcacgctgtactgcgcttaccccccccccccccc

SEQ ID NO: 19817 - DNA, 7632 bp, Oryza sativa
ggggggggggtggcgaagtttctgcgggtggctgatgcgtatactttgattgggttggggtttgctgcgcaggaggtgttcgttgacccggcccgcgacgagagcctcatcttcgagctgctcgacctcaagggcgaggtagaggacggcggcagcgcgctctggttcctgcgcgacatcgccaacgagcaggacgcgggggacaacttggtgaggataacctgttagtgcttcagcatactacttcgtcaaacattagagttaggagtcgatgtaacgtaatcaggagttcctgactgtttgtgttaagattcgagggctcatgcctttaaactgagttaaattcatgtttgttggctaggtagttgagcattctgggacgatcgagctaggtggtctgcgatttggagatgctcctgcagtggctggaactgcggttggtcagctggtaagattatttcctctttgtgttgtgctttgccaactccagattattctgcaccttgcgataaatcaatatccagcacattagattttcaccttctttttcaacaatacaaatatatgatggcacaatattgctggagttgtataggtttaggtgatcacacttcatacttgaacagctgcacattacagagaatggaaacagattttggtagcaattggcatgcctaagaaaaataacaatgatgtatggataaatactagggattactggacgttttgttggttgaactgtaggtgggctgaaccattctcatataattgatgacccctttaaatcatagtgttggaggtatatgtttctaggttctacatccttctctttccagataagtagtaatgcagatgtctaagtggaaaataaagtttgggagaaattaatgatcaagaatcctccataacataaatagatccatgaaacattatgatttgtgcaaaattatcgaactactgtgtatcatgatttcattaactctggtagttcagttcattgatgcacattgatacttgatagcttggatatgctgtataatcaacactggatggtgaattgaccaggaaagtgcaaaatcttgtgcttaattttcttcctttttgtaggctatctcaaaaggaaggcaaggcagagaagcacagaacattgttcgagtgagtgcatccattccttcattagtatgtacaacaggaaaattgtgaaatcttggttcttcaaactgagttcttggattacctattgcagctttacttggccaatatacgcctcaagaatgcagctactgatgtagttattactgcatatgagccactgttgataaagtaagcgcagtatatcactaattacgtatactttctgttagacaggtcatttctattagtttgtacttaagcagggtgaaaagctcatttggacttcccatcacagaaactaccattcagtgtcatctgttggtcatagcttggctaatatttgattatgcattctaagaactacggattgtctgtatcagtctttcctttttaaagtctggtcgcatcttgacatgtttgtggtgagtgttgataatcttgtttggtgaaacatgcttactgtttaggaacacacctgtgcttacaaaatgaaacagccctattgtgttcagcctgatgtttgaattttcttgtcatactgattgctagtgcactggtggatagttaaacaagacgaaactagatttgtagttaaattctgataaacagcattaggtggtaatgttagattgttagaggttattgaagactttattacagcttttctgcccttctatatcaaagtttacagcataatccttcagatattgtttttgtaaattgagaatttgatgttgtttctgttgctattcattcagccccttgagtgaaagcgccagtgcagttgcagccggtccagcagtaccagcagaacaagcaggatgcttagcaatgtctgagatcttcaagctcgccgtgatgaacttcaatgtccatgactggaatcttttcaatggcagcagttgaaacagggtggatagtttatcatagtaccactactgagcatcgcatgaacttttccttggtctagtatctgaacattattttagatcggcaacattcgttttgttaatgtagtgtcatcagcagacccctgttgaacttgagtatcatgttagcttcaggaatttactcatttggcccatgatagttaatagtaagcactaaatcagtaaagaagaattatgtgtatctatcaagttagctatgagttctggacttctagttagctagagttctggacttcttcatttttgagtccacaggttcgaaaagttcgttctgaaatcaattggatttccgaaggaaaatgtcgtcctccctacattgtatggactggaatatttgtcctacacagtaccatatattcttgatccttgctcattgcaacaggcaccaaggatcaggatgacgaacatgtgaactatgagttaccaaatgaacacgccccacgttgaccaggtcatgatccatttggattggggcaatttgtttcaaccattcatcgcgcatttgacgcatcgtctcgatcgtggtaagatcctctggtcaccgttaaattttgtatctaaaggcggtctcgctcctaattcattacgtatttaatttccctgtgagttttacctttaaaagtcatttacatttcctcatgttataagttaattaagattcacgcatcacagaaaaactaacaaaaatggtcccaagcaacatgctgaaattctataccagaacctggcaaccggtgtccggtagtatatacggtattacacatgaacattacacagcattgcgatttccaattgccggaagtcgataataatccgtgccggacagtgaaaagtcagatgaggtggggaagaaaagcaaagaaagaaacaagaaactgtgttgggcgctcgaaacttcgaaattctcattacaaaggatcgagaggaagaaggaagaagtctggggaaaatttttggagcgaggtggagttacaaaggcagcagcagcagcagcttctacgttctcacttccactggttggcgacgatgtcggcgaggtcgacgaccctctgcgagtatccccactcgttgtcgtaccaggcgatgaccttcaccatgtcgtcgcccatgaccatgctgagcgacgcgtcgatggtgcacgacacgtcggagcacctgaagtcgacggacacgagcggcacgtcgcagacctcgaggatgcccttgagctcgttggcggcgctgtcgcggaacgcctggttcacctcctcggcgagggtcttcttggacacctgcaccacgaggtcgaccacggacacgttcggcgtcggcacccggagcgcgatcccgttgagcttccccttgaggttcgggagcaccagcgccacggccttggccgcgccggtggacgtcggcacgatgttcagcgccgccgcacgcgcgcgccggaggtcacggtggctcgcgtcgagcagcctctggtcgccggtgtaggagtgggtggtggtcatcgtccccttgatgatgcctgcgccattgattggttaagcatcagagagagagagagagagtaaaattggtcgaggatcgctgatgcgcgcgtgtgcgcacgtaccgaacttctggtcgaggatcttcacgaagggggcgaggcagttggtggtgcaggaggcgttgctgatgatgggctcgtcggggctgtactggtcggcattgacgccgacgacgtaggtggggatgtcacccttgccgggggcggtgatgagcaccttcttggcgccggcctggatgtgcttgcccgcgccgtcgcggtcgacgaacacaccggtgccctcgatgacgaggtcgatgccgagctcgccccacggcaggttggacgggttgcggtcggagacgaccttgatcaccttgccgtcgacggagatggcgttgtcgcccacgggcttgacgtcggcgtcgaagatgccgagcgtggagtcgtacttgaggaggtgcgacgcctgcttcacgcctccggtgtcgttgatggcgatgacgtcgaggggcgagctgtcgccgcgcccgtgccagcaccgcaggaagttgcgcccgatgcggccgaacccgttgatcgccaccttcagcttcgcctccgtcggcgcccgccgcgccccgccgctcgtgccaacctgcgcccgccgcaacacaaacttcaacaccccgcgtcacgcacacgccgcctcgacgacgcaacaaaagttttccggtgcattgcttcacgcacgtaccgcgtgggtcctgaaggagaccgcgttcatgaagtcgtcggaggtggcattccgccgcagcggcagcgacgacgagctcctcaggccggagaactccgacaagccgcctccctgcacacataaccacacacacagacaccaaacacaatctttcagagcgattcttgcaaccaggagagacgagcagtaagcaactaaccaaacttacctggagtggcacggtggcggcggagagcatgggcgacgccatgtccgacgatcagatcaagaagaatgcagcagcagcaagctaggacggcgaggccgggaagtgtgtatatatgagtgtgggattgggcgcgccaggggtttgtggtgcgcggtgcagcgaggtgtcatcgtgaggcccggattgggcgagagatgagatttcggatagcccaacgtatggctcccagcgttctcgcacagccatcgcgtcacccacacaaacacatgtgtgtcacacacatctcaaagttcagctgctccatccattatgtgtccgccgttttttctttttcccctcggtgattcttgtcgcggtgaagaactgagcgttccagcctttcaggtagtacgtgatattgtacgcggtactgcatgggaggccctctctgcgacgcaggcggtgatggctacgcagctgatggatattcggcgttcgattctgtcattcttgaggaggtcgagctcgctttcggaggtaaaaatgccaaggttggctgctcgtggaccgagcggtacagctcttgcgaatgcgagattggcagattgcgtcggtaaacgatgggcgagggggaggggaagcgaggatttgcgagatgtggccatgcgggctcgcgcctgctgcaatgcatcttgcggtggccctcgcccccggtccatcatcagttcagtctcccggatcctcttgtttttctgaggcctggagtaagcttaacatccacgtcgctctccggtctcggccaacgtagcgctgttcttacgttccgggatgttcagaaattcagatttcgttgggcgcccacgttgccgctgccgttctttttctttcttttttccccctgttacacagaaaacacacgtgcactgtgcattgtgcacatacactatagttacacatttgcgggtagatctctaacacacgtttaagaaaaagaaagatagatgataaatcctctcaacattactaaattcctattaaaaacacacccgcacatgtggtgtgggatatgcgctagccatgcactgaactcatgactagcggttaaaaaaaaagccgatggtttcgaacggcttgaactcatagccatagtatattgagtcgagctaggtttttagctcattagcttaataagatataccgttagctacttgtgtagcttgctaggccatgaggtcaatatatatttttatacattttatacataagtacattagtccattaattgcttataaattatttggattcaatgagttatttatcatttggtgtttattcattatattaatatatgataaattggtaaatcaattcaaagatgcaaatgtgatattaatgagagaactcgttaacgagtcaagttgtgagtcgagccaagctgagttatgcttttagatcgttaaggttaccaaaccgagttaagataacaaacccaaacgcactaagctagctcaatatcctcccttcccacgactccaccatcgcatactgctccaccattctcttccggacgacttcaatgttcacgacttaaccatcacacgccctgctactgtcattctcttccggacagtttttaatcttcaattctataaaaatagtgaaataggacctacttggtaaaatttctatcttataaactgaactttaaaaacagatcgatatagtttgcgtctaaattgttcactttatgttttaattagcacaaaattgcaacggtttttattcattgtggcaattcacacgctgagtggtatagtgaagttaaaattttaactgtcattcacagttaaaatttaagttttaaaacttaattttagttccaggttgatttggggtttcttattcatagtctatctttcaaccttaacttttaaatcacaaactttgctggtttcttcatttatatttttttatagcctgtcactcgtggctgaaccaatcagagctatgattgtattaggtaccacggcaatacttgtgacaattgtatgttttcttggcaccttcctcacaacaatgatacaagaggaaatgtgacggttttgtcccttacttattgctagctaaagtttggctctgattttcctagccaaaccttatactaggacttcatgttagcttaaagagattattgtgggctcctccatctaaacgggctcttatctccttcctagcaatacaaagcccatctagatgacccacacaatccaaactgagacgagccggacataggtttgtccagggaaataagttcacttaggctcccttaactagtggtcgaatctaattcatatccctgaaccacgataccggatatctcgacccccaactattaaaaccagtgcaatttgactccctcagcggttttgaagggcagtttcgttgacgtggcgcctacgtggcggcattgaacagcggcgggtcgctgctgaccaaagaggggatcatcgacaccgccatggtcaccctcttcgccggccacgacacctcctccatctccggaggggtgagggccggagagatggtgtcgccgctccggctctcgcccgctcgctgccgaaggggagaggaagagaaacagagagggagggagaaggaaggatgagagaggggggatgacatgtcggccccacatgtcagtgagcctaaattttttgttgtgtgaatgacgaacgagtccacatatatgtttttcactagttaagcggctgaatctaattcgtatatctaaccacaataccagatttctcaaccatccaactattaaaaccggtataatttgacttcctcgatagtttggatgacagtttcagctgatgtgaaggtgttgacctggtcttcgttcaatatggtattgatatggtattagaatttaaaagtcatatgtgacctatttatcattaaaaaaattattatggggcccacaatcatcctctccttcccataaagctgaggttgagcggtggcaataagagatggagcggcgacgacggcatcaaagagctgggcggcggattcaagcggtgccgcgacgaggagagcaggagcggcagca

SEQ ID NO: 19818 - DNA, 4171 bp, Oryza sativa
cgttccctagaagcaccaagggagtgaaattgcattggttttaatagttagaaagacaatatatttagtattatggtttagaaatacgaatcagattcccgcggcgtttctcaccactcgtgggccgtggtgcgtccgaagaatgaacctgtgcgctgtacgagtgcgagagtttgcggagccgaagaaacacccagcgccccttttgatctaccccacaggccacagcagcagcagccaccctcctcgcaaaaatgaaagaccaaagaaagcggccactcgttcgaagttctcgtaagcattggttaactaatcacaagcttggtttccttatcaaaaaaccacaagcgtatggttcacccagtaaccatgcatgtatatcgagagcttcacggtcgcatgtgcccttggaattctttatccaaacttggcagcacggaatctttctggaactgcgccaacgaccaagctagtgccaaaacgttccgcacaaaattctgtcacacgctcacaccacctcagctccaaaccacacgcacatatgcccccgcgcctcctccgcccaaccgtgccgccgtgtgtgaaccgaacaggctcgcggcggcgcctttgcgtcccggcggccgcgcagcgcacagcgctccaggccagcgcacgccgaacacggggcggattcccccgcctcctgcctgcagctgcaggctgccgttcaggtggttcggttcggagctagcagcagcagctgctgctgctgctgctgcctgacgcctgccacggcacgcgcggctgccggccggagcggggcgcggtacacgggcagagtccatctgcgccgagcccatctgcgctccacgtgacggcgtgcagaactactcctaaaaaccggcacatgcgagggcctgcccttctagctttgggctgggtcggatgatcgtgttcgcgtcggacgcgacgcacctcggtcggtcgggccctaccgtggactacttggtcacatcactgactctcactgacccagtcgctccctccccagctcgtgccagccagccaccatcattcgaccatgcgagtgcgttgcatttgcacatatactatgctccaccctgatgtgcccaggacatggcccttcctgtcacacaccggcctgatcaccgggcacgggcagcctttcgttcgtgggtcactcacaggctcgactgttcaagcaggatcggccaggcccatgcatcccggagaaattttaaaaggaaccactggtggtctctctgcctacgtacaccggtacacgaccttttgttctgctgcggagtgagtgaccctacacagtggtacttggattcgtacgtgacaatagatgagtagaagtaactcgatcggtattcaatccgatatctcttcacgtagtgtaggatactggaagatgtggggcacatgaccggcccagggagtagttatgatatcgtacgttgtgtttaacgttactcgcaaaataatgatcgagcattcgagctgcccgttatggtgctggggcaatcagcctatgtacacggaccgttttataaaattgttgccttgtagtctgaataatccgtatctcccacctccacggttcgttctcatgcatgttgccattcagcggcatacggcggcattattcgttcgctggaaaatcattcgatcgagcggcatctcctccttggaggtcatgggcgacatgcatggtcctggtcgacaagctaggtagccagattatggtttgtgagggatggccatggtggaggcaggaggcagctcgatggtaccagtaagtgcctcttgataagcctttttttaaaaaaaaaataaaatcaggaaattataaacatattaaaaaaaatgtttgtacagtgaaagagaagatatctttccttctgttgggcttaaacgtgcttcatgacttttttttttcatttttgtcatttccacttcggtttggctaaaaaaaagttaacttaatttgtatttttcacataaggtttccactatagagcactagactttatgcactacttctatgattttttttttcaaatttgaaacaaaacaatttttaccaaaccataattatagtttacccaccccacggtaacaacatttaccgcggttgatgtggcgggaaccgttgctatactgtcaaccctatcatagagccattcgaaaggaatatcatatggtccaaaaaaaaaaagtacaagcctttgttccatagggccgtctaggaaaaattctatggaagcaaggagccctctcggacctctcgagttaaaggcaaaaggtaaacactagacatacaaaacgaaaacttccatctttgaagccatgccgaaatcctcaaaggcttctagaaggcttgaagatcactcgaggcagattgtaaaggcgcctcaaaggctcaaaggtgctagaagagactttcttatcaatggaggtttgccctggaccatgggatgatggaagaaaatgatgttgaatgtctcatatgcaaattgaagcacttcaaaacattccttgttggtatccaaggaccacagctagctagttggcgtcgtgattcgtgaaaatggcttgatccatgggccaaaccaaatggagatttaccacgatatcattaggttatacccccatgcaagggcaagcttgtacttcctctagtcataaatatttgaggaattaacttttgaaatgatgtttgacaattcatctcatcttattcaaaaatttacttcaaattgcaaaatgtaagtaaaggatagagtaacattagtaaaaacacaacttacaatagaataaagagtaatttcatattattatatgttattttttaataagatggatagtcaaaagttatatccaaaatcaattgcgagaaatatttatgaccaggtagagtaacttccctacatgcatcatttaggcttcgttcggattagcggttcgattgagatatttagcagcatgcgaaatgagacaagttattagcttataattaattgattattaattatacaaacttaaaaaatggattttataaaaaaaaacttctatgtatagtttgataaacgtgcttatagtctcacgtggaataaggaagttgccatttcgaatagctatttagagcgcattattaatcttaatatatcatattttatccattgtattagccctatacatataagcggacccgagaaatatttaataaacaaagataattttctcacactataagaggagttttagtcttcgaatactccttgtatcactactacgaaaaccatttttcgtggcggccattttagggtttttgctggcgaaatttagagccgccacaaagcaaaggccagtcaagatcttcgaccgctagcgaaaatgaatttttgctagcggtcgtcttaagccagccgccagcaaagatccatttttgctggctgttgtcttccaccaaccgccagcaaaaattcattttcgctgacggctgtgttaaatcgaccgccagcaaaaatcaaaaccatgcagctgccctagccgccagcgaagaggcggaaatttaaaaagcaaaaatatattttaaaaaaaacactgctccgtccacctccgtctgcgctccatccacacataaatttacatgtacaatttacagctaaaaatttccattctcccaagcattcaagcatcaaaaatatccacacatttaacaaaaaatttgaacaccaagcatcaatccaaatacaatgcttcacaaatatcatcacaaatattacaagcatcacaaatacagagaaccgctgtcgccggcgtcgtcgtccttgaagtcccctgcaccatcaccgttgccactaccgagccccgtcggcctcaaccgcctccgcctcgacgacgctgctgccgagccccggcgacctccaccgcctcgacgaccctgctgccgagccccggcgacctccaccgcctccgcctcgccaccaccgctgcaaagccacgcaacgctagatttgagagagggagagggggtggtggcggcgggggaagaggaggagtgaggagtgggggagagagaactgtggatccgccgccttgcgccttcccgtcgccggatccgccacctggcaccttcccatcgccggatccgccacct

SEQ ID NO: 19819 - DNA, 822 bp, Oryza sativa
aacaacttcgccagcaaaaataggctattttgcgggcggttttcttaacctaacaccagcgaaaataccaatttttgctggcgtcaagttaagagggccgccagcgaaaataacatatcttcgatggcggtcggcttaaggcgaccgctagcgaagatgtgtttccgctggcggcccgtgacccccgacccccgccattttctgcgctggcggttttttcacttagcctccatgaaaaatattttccaaatgccataaaaaatcgtttttctagtagggtattcctcatagaggagccttcgcttctctcgtatatagcccattctatccattgtatcatataggatacaaatccctataaaacactatatgttcctgttgtccaaaggaggattaacgcgagttcgagcactacaatgctatattttcctgttgtccaaaggaggattaatgtaagttcgagcactacaatatggaggcttaacgcaagttcgagcactacaaagataattttctcatgccataagaggagttttagtcttcgaatactccttgtattcctggagagaggagccttcgcttctctcgtatatatcccattttatccattgtatcatataggatacaaatccctacaaaacactatatattcttgttgtccaaaggaggattaacgcaagttcgagcactacaatgctatatgttcctgttgtccaaaggaggcctaacgcaagttcgagcactacaatatgacatgtgtttagaccatattgagggatcatgaatgagtcaacctgcaggtattctaataactacagtatt

SEQ ID NO: 19820 - DNA, 732 bp, Oryza sativa
  unsure (1)..(732): unsure at all n locations
nnnnnnnnnnnnnnnnnnnnnnnnnnnnnnnnnnnnnnnnnnnnnnnnnnnnnnncccgatctgtgtgtattgcttgattttagtttgtatactttaaccatattctcactatacttagatttctagaaagaattggtcagaaaaatttatatgtatgtggcaaaatatgtatttggtagcattacagttgtttgtcatttgtagataacattgcaactatatttattttttttcgggggtaggaaatgactgtataagaattcaatggtatgattcatatagtgtatgaatgagagttttattttttgggtttctaaaccaggcagtaagtatttcaaaattatgtgttaaattggaaaacaaatgtgccaaaatagttgttctaaatcattttacaatgacattgtgcaggacataccaggctgcaccaaatttattaagactggcttgcaaaatgaagagctacttgagaagatgtttgaagatatccgcaataccggtgctaaccattggtctttggggcaaggcaccataccaacagccatggatgcaattcgtgattacctagccggtcgtattgcaggttgatggacatatatagtattttgtgatgatttgcggtattatgctctatctttcgatgataatggaattagatattattactaaatatatgtcatgccacaactttaatttttactttattgtggagtcccactcatataatgatt

SEQ ID NO: 19821 - DNA, 677 bp, Oryza sativa
ggattgcgtggtgcatgaacgaaccccattctctctgtcacttggccatgggctgcaagcctgcaaggtcttccgaaaactgtaactgccatcactggcgactttaactcgttgcaataggtcacgtgtatttacgctttgcactgtgaaatgatgggtacgtgaggtaggagtctgtctctctgtgcatgacgaacgagactggccgatactgtgatgactgatgactgcttgtgtggttgcagcaactgtccatgaagggcttcgccggcgacacggccaaggcgcacgccaagacgagcatgatcgccggggagggcgtcagcaacatccgcaccgtggctgcgttcaacgcgcaggacaaggtcctgtccctcttctgcaccgagctgcgcgtcccgcagatgcacagcctccgccggagccagatctccggcgcgctcttcggcctgtcgcagctgtcgctgtacgcctccgaggcgctcatcctctggtacggcgcgcacctcgtccgacaccacgtgtccaccttctccaaggtcatcaaggtcttcgtcgtgctcgtcatcacggcgaacaccgtcgccgagaccgtcagcctcgctccggagatcgtgcgtggcggcgagtccatccggtccgtctttgccatcctcaactacaggacgcgcattgac

SEQ ID NO: 19822 - DNA, 658 bp, Oryza sativa
ccgttaggccctgtttggcacagctccagctcctaactccaccttacctagagctggagttatgccaaacggttcggattcatccaaaagaggaacggagcagtgcagatcgctccaaaaaattacactagcgtggtggagcggggaaaacacaactccacagctccactcccagcctgattacagcgctacccattacttttcgcaaaaattataagcagaatgccaccgcccctaccccttcgttccccaccgcaccgagccagactagcgcacatcgcgtttctcctcgaggccgcgaagagagaagggggagggaggactgaggcagcggcggcggtagcagtgaaggcacacggcgcatggtggcggtggtggcggctgcctcctctcgcacagcaagggcgccgggcggaggtctgggcggcgctgggcggaggtcagggcagcgcacggcggttggatttggcgctgagacctcatggcggcggcacttggcggcgggagcggctccccacagcgaggaggcgcacggcatgagctgggcgacgccggtggcatagcagatctggtgcaaggagcaaggtaaccctaaaccctggactagctccctaaaccctagactctctctcccccaaatttctccccgatctgtgtg

SEQ ID NO: 19823 - DNA, 759 bp, Oryza sativa
  unsure (1)..(759): unsure at all n locations
nnnnnnnnnnnnnnnnnnnnnnnnnnnnnnnnnnnnnnnattcttgtgaacatctaaaattgccagagccggcattagtgccaaaacacatccggcataatcctgatcggttacaggaagaagaaaacagttgtacccaagcacatcatctgaccacccgcacagcaccatgacgattactggcctcgcccacttctgtacacccggaacctaggccctgaactgatacgatcagccgtggtgtagctgcagctgcagcagccgcgagtaggcgccgtcgggccgcgacacgagctcgccgtggctgccctgctcgacgacgcgcccgtcctgcaccacggcgatcgagtcgacgccgcggatggtcgacagccggtgcgccaccagcaccgcggtccggcccttcatgatccgctcgagcgcctcctgcagcacgcactcggactccgcgtccagcgcgctcgtcgcctcgtcgaggaggagcacggcggggtccttgagcacggcgcgcgcgatggcgatccgctgcttctgcccgcccgagagctgcaccccgcgctcgccgacgggggtcttgtagccctccgggagcgcgctgacgaagccgtgcatgttggccaccttggcgggctcgatcacctacttctccgtcgcgccgtccttgccgtaggcgatgttctcaaagatgctggtggcgaacagcacgggctcctgctgcaccaggccgatcttgagacgcagcgacctcacgttcagccg

SEQ ID NO: 19824 - DNA, 1424 bp, Oryza sativa
  unsure (1)..(1424): unsure at all n locations
atttgtactacttaaagaccgatattttggttagcagtacaattttcttctggtttggctaactattgcattactatattgatcttgcaactttgcatatacaaatttgctccatccaatgattaatccactatatttataacacaggtcggggagagaggacttcaactctctggcggtcagaagcaacgtattgccattgctcgtgcaatgctaaagaacccgaagatccttctcttagatgaggcgactagtgcacttgatgctggttcggagaatattgttcaagaagcccttgaccgcctgatggtcggtaggacaactgtcgtggtcgcgcataggctgtcaactatacggtgcgttgacatgattgctgtgatccagcaagggcaggttgttgagaccggtacccatgacgagctccttgcgaaaggaagctcaggagcttatgctgctctcattagattccaggagatggccagaaaccgtgacttccgtggcccatccacccgcaagtcccggtcatcccgcttgagcaattcgctgtccactcggtcattgagccttaggtcggggagcttgaggaacttgagctactcatacagcactggtgcagatggccgtattgaaatggtttccaatgccgacaatgaccggaagtacccagcacctaaggggtattttttcaacctccttaagctaaatgcacccgagtggccctataccatactgggagccatcgggtccatcctatctggcttcatcggccctacatttgctattgtgatgagcaacatgattgaagtgttctatttccgggacccgaatgcaatggagaggaagactagggagtatgtgtttatctacattggaactgggttatatgcggttgtcgcgtacctcgttcaacattacttcttcagcatcatgggcgaaaatctgaccaccagggtgcggaggatgatgcttgctggtatgaatcgataggttgctcttaaactgttcaaatttcaccagttgcattgtttgatcagagactattttcagctatcttgaggaatgatgtggggtggtttgatcaagaggagaacaattcaagcctcgtggcggcacgcctttccacagacgcagccgatgtgaagtcggccatagcggaacggatatcagtcatcctgcagaacatgacctcacttctcgtgtccttcgttgtgggcttcatcatcgaatggcgggtggccgtcctcattcttgtcaccttccctctccttgtccttgccaactttgcccaggtaaaacaactctcaactcacaatattttcgttaacatggaggtgtcattctattatgtgccttttacgttctaannnnnnnnnnnnnnnnnnnnnnnnnnnnnnnnnnnnnnnnnnnnnnnnnnnnnnnnnnnn

SEQ ID NO: 19825 - DNA, 14845 bp, Oryza sativa
  unsure (1)..(14845): unsure at all n locations
nnnnnnnnnnnnnnnnnnnnnnnnnnnnnnnnnnnnnnnnnnnnnnnnnnnnnnnnnnnnnnnnnnnncttaatccctagagctgttgaaggctcgattcactactcgctctacttagtctacctgggcctcgtggtgtgcgcctcgtcttaccttggtgggtttcccctgctgctcgcgcgttcttgccggtgatgtcgttaatgtggccggcctcactcaccgcgtgtgtccttgtgtgcagagatcgcttgctggatgtacaccggggagcgccaggtgggcgcgctgcggcggcgatacctggaggccgtgctgcggcaggacgtggggttcttcgacaccgacgcgcgcaccggcgacgtcgtcttcagcgtctccacggacaccctccttgtccaggacgccatcggcgagaaggtgaccagcttcttaaactcgtcgctctcttgggctccggccacctcccgggcgtggccaatgacctgattgggacggttcgtcggtgcaggtcggcaacttcatccactacctatcgacgttcctggcgggtctcgtcgtcgggttcgtctccgcctggcggctcgcgctgctcagcatcgccgtcatcccgggcatcgccttcgccggcgggctgtacgcctacacgctcaccggcctcacgtccaagagccgggactcctacgccaacgccggaatcatagccgagcaggtagcatcactctcatcctactgtttctggatacccattttcattcagggaaaccaagatgcctcacaaggcgtggggaagaggagcagtgggctctagcggtctagccccgtagcccgtgccggtcaaagtgtagcacatgctatcaaaatgatgccattttgtattccttttagcttcttattagatccaatcaaccttttggataagatgatttcttgtttgatgtcgttttgcccttttcttgatgagtgattaacatggtacctcctcaagaacaggaaaaatagaggtttcttgatagataggtctcgttacccatgtacttttttcaatgtcaaccataaatgtaggataaaatgatatctttctcctttattgtgcaaatatgcgagtaattttgatgatcaagtgtgactgttgaacaggcgattgcccaagtcaggacagtgtattcctatgtgggggagtccaaggccctcaactcgtactcggaggcgattcagaacacattgaagctggggtacaaagcagggatggccaagggtcttggcattggctgcacttacggtatcgcctgcatgtcctgggcgctggtgttctggtacgcaggagtgttcatccggaatggccagaccgatggtggaaaggcattcaccgcgattttctctgcaattgtcggcggcctgtgagtactgaactttcattttctgtacaattctgtacctttaatgtttccgataaaaatatatgattgatatgtgtatgtggatctgatgatttcaggagtttgggacaatcgttctcgaatctaggcgctttcagtaaaggaaagattgccggatacaagctgttggaggtgataaggcagaggccgacaattgttcaggacccagcagatggaaggtgcctggatgaagtccatggcaacatagagtttaaggaagtggcctttagttatccgtcccgtccggatgtcatgatattccgtgacttttccctcttctttcctgccggtaaaactgcagctgttgttggaggtagtgggtctggaaagagtacagttgtggctctgattgaaagattttacgatcctaatcagggtaagcagatgaaatccacacggcacacctgatgttgattgttatcccaaccatttggttaattgctgattgctattttttgcaggtcaagttttgctggacaatgtggacatcaagacactacaattgaagtggctgagagatcagattggtttggtgaatcaagaacctgcactctttgctaccaccattcttgaaaatattctttacggcaagcctgatgccacaatggctgaggttgaggctgcggctacatctgccaatgcccatagcttcattgctcttcttcctaatggctataacactcaggtgggttctttgtctgttggtatgccaatgatatttgtactacttaaagaccgatattttggttagcagtacaattttcttctggtttggctaactattgcattactatattgatcttgcaactttgcatatacaaatttgctccatccaatgattaatccactatatttataacacaggtcggggagagaggacttcaactctctggcggtcagaagcaacgtattgccattgctcgtgcaatgctaaagaacccgaagatccttctcttagatgaggcgactagtgcacttgatgctggttcggagaatattgttcaagaagcccttgaccgcctgatggtcggtaggacaactgtcgtggtcgcgcataggctgtcaactatacggtgcgttgacatgattgctgtgatccagcaagggcaggttgttgagaccggtacccatgacgagctccttgcgaaaggaagctcaggagcttatgctgctctcattagattccaggagatggccagaaaccgtgacttccgtggcccatccacccgcaagtcccggtcatcccgcttgagcaattcgctgtccactcggtcattgagccttaggtcggggagcttgaggaacttgagctactcatacagcactggtgcagatggccgtattgaaatggtttccaatgccgacaatgaccggaagtacccagcacctaagggttattttttcaaactccttaagctaaatgcacccgagtggccctataccatactgggagccatcgggtccatcctatctggcttcatcggccctacatttgctattgtgatgagcaacatgattgaagtgttctatttccgggacccgaatgcaatggagaggaagactagggagtatgtgtttatctacattggaactgggttatatgcggttgtcgcgtacctcgttcaacattacttcttcagcatcatgggcgaaaatctgaccaccagggtgcggaggatgatgcttgctggtatgaatcgataggttgctcttaaactgttcaaatttcaccagttgcattgtttgatcagagactattttcagctatcttgaggaatgatgtggggtggtttgatcaagaggagaacaattcaagcctcgtggcggcacgcctttccacagacgcagccgatgtgaagtcggccatagcggaacggatatcagtcatcctgcagaacatgacctcacttctcgtgtccttcgttgtgggcttcatcatcgaatggcgggtggccgtcctcattcttgtcaccttccctctccttgtccttgccaactttgcccaggtaaaacaactctcaactcacaatattttcgttaacatggaggtgtcattctattatgtgccttttacgttctaacctggattagacaacgtgctaggaatctttggtggaataggagaattaccctttcacattaaaccgaatagtactttgcacgacgaactcactgagctcactgcaccgttgcgacgccgttttcggcgcagacaaccgtttgctgctcaattactccctccggagataggatgccagattaaatccatcagcattgctatggtaggatccgtggcccatgccactgccactgcttctgccgccgcagctgccataaattactgtgcgcggcatgtgcaaccctgccaagatgctccttggcctcctctctgcaaaggcaaagcggccgtgctaatcatagaactcggcgttaacaacggcaagtaaagctccaggacgtgcgctatttatcgcaacagatgcttgcttcctccgttcctctgatgcctaatggctttcgtgtttctgagactgggaggaagcaaagcaatagcatggccaactgccccaatctgtcgtctttctttcctgctgctcattagctgcccccagtggtagggttgtttttggtttcttgccgctcgtccccctggtggtcccgttgttcgcgacactgtctgcattgcacggccgccttgtgcacgggaatctggggcttcgcaatccgcagtgccgcacatggcgatcttgcagttgcagggcaggcaggcagtgtcgtgttgccgtggtcgcatggcgtggcgtacgttccgcgaggacagtgtcgccccagaatgccatgccaagccatatattttttgatcgtgttccagctgcattgcagagcccctcatgattccttgcgtgcaatgatgtccctctggcgattcgtaaaggattgcgtggtgcatgaacgaaccccattctctctgtcacttggccatgggctgcaagcctgcaaggtcttccgaaaactgtaactgccatcactggcgactttaactcgttgcaataggtcacgtgtatttacgctttgcactgtgaaatgatgggtacgtgaggtaggagtctgtctctctgtgcatgacgaacgagactggccgatactgtgatgactgatgactgcttgtgtggttgcagcaactgtccatgaagggcttcgccggcgacacggccaaggcgcacgccaagacgagcatgatcgccggggagggcgtcagcaacatccgcaccgtggctgcgttcaacgcgcaggacaaggtcctgtccctcttctgcaccgagctgcgcgtcccgcagatgcacagcctccgccggagccagatctccggcgcgctcttcggcctgtcgcagctgtcgctgtacgcctccgaggcgctcatcctctggtacggcgcgcacctcgtccgacaccacgtgtccaccttctccaaggtcatcaaggtcttcgtcgtgctcgtcatcacggcgaacaccgtcgccgagaccgtcagcctcgctccggagatcgtgcgtggcggcgagtccatccggtccgtctttgccatcctcaactacaggacgcgcattgacccggatgaaccggaaaccgagcccgtcgagtccgtccgtggcgacatcgacttccggcacgtagacttcgcctacccgtcgcgccctgacgtcatggtcttcaaggatttcagcctcaggatccgagctgggcagagtcaggcgctcgttggagcgagcgggtcaggaaagagcaccgtcatcgctctcatcgagcgtttctacgaccctctcgccgggaaggtcatgatcgacggcaaggacatccggcggctgaacgtgaggtcgctgcgtctcaagatcggcctggtgcagcaggagcccgtgctgttcgccaccagcatctttgagaacatcgcctacggcaaggacggcgcgacggaggaggaggtgatcgaggccgccaaggtggccaacatgcacggcttcgtcagcgcgctcccggagggctacaagacccccgtcggcgagcgcggggtgcagctctcgggcgggcagaagcagcggatcgccatcgcgcgcgccgtgctcaaggaccccgccgtgctcctcctcgacgaggcgacgagcgcgctggacgcggagtccgagtgcgtgctgcaggaggcgctcgagcggatcatgaagggccggaccgcggtgctggtggcgcaccggctgtcgaccatccgcggcgtcgactcgatcgccgtggtgcaggacgggcgcgtcgtcgagcagggcagccacggcgagctcgtgtcgcggcccgacggcgcctactcgcggctgctgcagctgcagctacaccacggctgatcgtatcagttcagggcctaggttccgggtgtacagaagtgggcgaggccagtaatcgtcatggtgctgtgcgggtggtcagatgatgtgcttgggtacaactgttttcttcttcctgtaaccgatcaggattatgccggatgtgttttggcactaatggcggctctggcaattttagatgttcacaagaatcccggtttttttcccatgtttgatttcctcgccactacaaactgacgagaattggcaacaacgctttgcgtcgatccgtccacggatcagagacgaactacactagatgaagctaaaacatgaaatcaagaaggataagcttcacctccaaatacggggcagttgaggaggagcggcaccgaggcctcgcgccctcgccgatgattgggaccctgtcagatctgcggccaccggtcgccggctcgccgccgccatctctctctgatctccaattgagcaaggcaagttcaaggcttcgagaggctgtgggcccgcggccgaggatgaggacgtgaggtgatacctgggccttcatagatagtacagcccatatgatgtggcctgcacctgtaattccatgactagacaatcctgggcaaaatcttttaaaaagggaataagtccacattgactcccttaaaagtgacccgaatctaatacatgaccctcaaccgcaaaactgaataggacgactcaccgaactattgaaaccaatgcaatttaactccctatgaagggtcgttttgaccaatatatacacacttgacacccgcccagagaccactccttcacaagaacattggattttcacaagggtgttgtaccaagatcttgggacgtcaatttatattcctatttagttgatttccatcgttgcattgccctggtataaatgatgcatattatatcctagttgattgtagtgtatcatatataaatacacaacgcacccagcataacataattattggtgattagtactccctccattccaaaatataaggcacaaccaccttagacccaaagaccaagaaataattattatcacctctttgtttgaataatcccaactaatactatacatgcacccaatagaattaagcatcttgatttaaaaattaataatctaggtgagagaatttgctattaattgtcatgcatacatgcacgctttatattatgaaacacctttaaaaagtagttgcgccctatattttgaaacggagggagtaaatgcattgtatatttataagtaataattttacatattatttattaatggcatttaacttccttaaattggccttattgttttgatgtttcctttatactattttccattgtcttcccaccttcctgtttaccaataaataattcttgtatgttgatttactaaaaaagctataggaagttgtgaattttaaattatgaatcatatatgctatatgctcaaaatgattatctaaagagaccgcacttatttactatgaatattcacatttgacaactcacatactttttaaagaaatccatccaaatgattaagtagcttaacaaaatagaggattagaaggggaacgattttcactattacgtgagaagagaacggaagaggagagaagagtttggatctgagagaattgaggaaaaatgaacctatcttgctttgcccatctgaaaattcaggacttgaggacaactacggtgggcaccagcactggtgcggcgacacgatggaggaaggcgcgagctgctggtggagttggcggtggattagagcagcagtggtggtagatgacaacgatggcattggtggcgacggcggatttgggcaagcgatagcaccggtggtggaagtggatgacgatggctgatggatttgggcgagaaatagatagcgatggtgctgatggtgaatctaaccgagcgatggagatatcgttagctggggattaattgacgtgcatgtttaggagtagtgaccttctccttttttactgccctatgtttggatgggatactaaatggtcacctttcttgagtatacaaaagttacctcttcatcttctctaaggtaacctctttacttttttagagaattcaggggccagctaatatacttgattttcttccctcgtagagcattcacgggatatagtacactgtatctccttggacacgtggcagtttttggagagggctttgcctaatttctaggacgccacgcgacccaacaggatgcaagatcttagtccctgaattaggtctttaagatttccttgttagaaaagagcctgacaatggtcaattgcaaaacaaagataacaatgcattgaccaggccaaagaccagaaatagacactgctcttctgtacgtcaaatgataaccacagaacacgatagaccacaacaacggtcaaaccatccacgcccgtacgtgcgtagccaaactgcatgcacggccattctcgagtcgaccaccctataaattgagcgtccctgcggttccactccaaccttgcgggccaagatggcgcagaagtttctcctcgggggcgtgggcgcgatcctcgtcgtcgcggtcgtcgtcggcgtggtcgccaccgtcacccgctccggcaacaaggccggggacaacttcaccgtcccgggggaggccaacctcgccacctccggcaagtccgtcgagtccctgtgcgcgcccacgctgtacaaggagtcgtgcgagaagacgctcaccacggccaccagtggcaccgagaaccccaaggaggtgttctctaccgtcgccaagtcggcgctcgagtcgatcaagtcggcggtggagaagtcgaaggcgatcggcgaagccaagacgagcgacagcatgacggagagcgcgcgcgaggactgcaaggccctcctggaggactccgtggacgacctcaggggcatggtcgagatggccggcggcgacgtcaaggtgctgttcagccgctccgacgacctcgagcactggctcaccggcgtcatgacattcatggacacctgcgccgacgggttcgccgacgagaagctcaaggccgacatgcacagtgtgctgcgcaacgccagcgagctcagcagcaacgcgctcgccatcaccaacaccctcggcgccatcttcaagaagctcgacctcgacatgttcaagggtgagaatcccattcaccggagcctcatcgcggagcaggaaacggtgggcggcttcccgtcgtggatgaaggcgcccgacaggaagctgctcgcctccggcgaccgcaaccggccgcagcccaacgcggtggtggcccaggacggcagcggccagttcaagaccatccaggaggccgtgaacagcatgcccaagggccaccagggccggtacgtcatctacgtgaaggccggcctgtacgacgagatcgtcatggtccccaaggacaaggtgaacatcttcatgtacggcgacgggcccaagcgcagccgcgtcaccggccgcaagagcttcgccgacggcatcaccaccatgaagaccgccaccttctccgtcgaggcggccgggttcatctgcaagaacatggggttccacaacaccgccggcgcggagcggcaccaggcggtggcgctgcgcatcaacggcgacctcggggccttctacaactgccggttcgacgcgttccaggacaccctgtacgtgcacgcccggcgccagttcttccgcaactgcgtcatctccggcaccatcgacttcatcttcggcaactccgccgccgtcttccagaactgcctcatcatcacccgccgccccatggacaaccagcagaactcggtgacggcgcacggccgcaccgaccccaacatgaagtccggcctcgtcatccagaactgccgcctcgtgcccgaccagaagctcttcccggacaggttcaagatcccctcctacctcggccgcccatggaaggagtactcccgcctcgtcatcatggagagcaccatcgccgacttcatcaagccggagggctacatgccatggaacggcgaattcgcgctcaacacgctctactacgccgagttcaacaaccgcggccccggcgccggcaccagcaagcgcgtcaactggaaggggttccgcgtcatcggccagaaggaggccgagcagttcaccgccgggccgttcgtcgacggcgggacctggctcaagttcaccggcacgccgcacttcctcggcttcaaggtctaaagaccctagccccctacatggcgtgaagggtgggatcgatgcatggacgtgtgcatgggagatttgcacgagaggatccgaggtgacattcatgcatgcgtacgttcgtgtgtgtaccaaatatgtgtgatggctgagacgtgcaggacacctgatcagggtgggcgtgctgcatgcgctggggggcagggctaacatttgtgcttttaactctttccggtttcttttttctcgaacagattttcttggagaatttcttctgtataagtatatgttgcaaaacgattgttgtacaatggcttggttggaaaagcgctgttcaaatgtcccgtttgttgctggcaatcttcacccatccgttcatcagaaacagtcaaaactcaaaacaagcttccaaagcaggctagctagcagttagcatttacacctcacccaagtggctaagtatcatgtgctctggcattcaactatcctctaatgcgtgacgacgccctggatgcaagaaaattacaaacggctatgaacaccagtagaaatttcggccaactcacacgacaagtgtcacacttcccaggatgcatcatctccttgcaccgtcttgcatcctcctacaaaaggaggggcctccacctcagtgtccctcaccgtgtgctcagtgttcatcttctccaaaacttcaatcaggttgtccctctgatctcctgaagaagaatggattcaatccagaggcaggactcctttgatgacttgattaacctcgccgacgatgtggttgtggaggcgcctactctctccagcgaggagatggaccgtgcaagggtatatctatgctctgttttagtatgtactacctgtaatttgtagtttttgtgccgtgcttctaggttcagatttagcatctacatatggtttgtgtttgttccaccatgtcgatttcgcgccttttttcaaacaagttttcgcgccttttctttgtttgaaccctttttttttaaaaaaaaaatgaggcacaatcattttgcgtttttgtgctcgttcagtttctagtgcgatagcacatagcgtatattttttttctactcaagttagattagttgaagtaatgttctttcactttggaacggatgatttttccatactgacgctggaattgaactgttcatatgagaatcctataatattattgtgtgattcctatgctcgaaagggaaactaatatgtataatagtagtgttcttaaccattatatagttccaatcaataggtacttcaattttacacaacatatatggcaacatagcaaatctgaataaaggatacagtaagcagatgccacaaacaactcaaagttacatgggccccaaattttatcacaatctaaatatggtgtgggatttccaagttggtactttgtgatcaataatagagggattttgccatccttgaagagataccaaaagatactccacttaagattgaaaataagctggaccaaattaactgaaaagaagtgaatcatatacgaggatactttccacattgagctttaggccttgttctcctagtagttttttctttaccgcgttttcagcagcagtattgattgcttggtatcttctgaagtgcacttaccacagtttgacccccccatccactgcagagggaggctctggagatactgagaaacaactcccctgaagaggctttcaggattttcacccaggtaataagctgtaatcactcctacacatccgttacttgcagattccagggagcactgtcggcacagaaattctctcgtaacatatcatagcagcacagcttctgactgctacctatctgatgttgcactgtaccagggtttaatagggcaggtggttcagagccctgtggtgggcaatgctactactcctcctactaccaatcaggccgtgaccgtgagcgtccctcccaaggccggcgacggcgagcccaagaccgcaccccgtcctccgaacaactgaccgagatcgactcgcggccggtcgggtcgagaagcctacctgctcctgcggtgcgtgcgccgtccagctcctctacccgctctgtgcctgagaataatcgtgtctagtgtgctgaacaccagccgtttcctttagagaagttaaaccatgtttgcttgttttggccgcccgtattccggtctcgtgttcgtcgtgcctctcatctgcctcctgcgtatgtgcggtcacggagataggtgtacgttgcgacattgcttcgtgcgttgtgcggagagttcacgcgcggtgcggcgcggcggacggaccacgtacgcgtgcaacgcctgcgcctaggcgtccggacgtgagcggcgcagcggcggtagcggaggaaggcctcggcgcccgcttggctcgtcgcgtgacgcgcgtttttcttttctttcttcggcttcggttttccgttcgccggttgccgatcaaccgcgcgctgccaaattcgtgacgaggctgggtctgttgccgccttgtccctgtctgagtgacggcctcttcatcgacaattttggccgatcgaccgaagtctgggaggttgagaaggtaagagcagtcatcacaattgttctcacgtttttaagtccacataaacttttgtacggaatttctccacttcatttaccgatctcctagaattttctcggaattctagcgtcgttttgatcgtgaaacggatgggatcaaggaatagtgcggcatacccccggaacggtactgccgctagcgtgccgcatcccctcatccgtcgtgatttgggaagaattcggggttacatgggccggttaatggcccaataacgtacagacattgggagaggagccgcgcgagaaggctattgcgcggtcagtcgcgcgcccccctttccccacgcgcggactggacacgtgtcgcgcgcggagagagggcggcggacgcgccaggcggcagagcgagttttccgttttttttcgtgtttttcgtttctgttcggtttgctttttttttttttagtttttacggtactgttcagtttggttttccttttttttcgttttctcttctgttttctttcggttttttttaaagatgtatgaatacaaagtttgtatttgtatgtatatcaagctagtttatattcgtatgtatgtaaagtttgtatacgcgtatacaaagattatatacgcgtatgcaaactttgtatacgtgttgtaatttcttttttatatattttttaatacatatatatatataaagtttgtatacatcgtatacaaagtttatatatatcctacataaactttgtatatattgtatataaactttgtatatgtgtaatattttttatgcattaaaaatatattccaaaatatatacatacacgtatatacatatgtatatacatgtgtatatgtaatatatacataagtatagtattagtaggtacatataagagactagaggggggacgactgaaccgcgcgccccgcgcggtcaaagttatagttgggcttgggccggtggtatcaacgagtcgatcccctcacctcgatcgtgtcgcccgccgcttgatcgatcgcgcggtgcaagagcgttttttatgctcctctgtgacgacgacgggcgcagcgcggtagcgtcatgcacgcctacgcagctagtacgcttttgtcctggccctccctgcgcgcgtgcgtggtcatggagttagatagatgtagtatatcacagtatatgtcacttttttttttccatgtcactatggcgcagcccgcaatgtggaggtgtccatactccatcgtccttgcttggccgtttgccggtgccaccaccgcgcgcagccaaactttctgatgtgaggtattggttgccgcgttgtcctctgtctctacacggacacaatgtacaagcagagtcgagtcgactgtgcgattacacagacaaacggactgcgtgttcgatctagccatcgtactaacaaaaagttataacttgtgtttttttgttccaaaaaaaaagttacattttcgtcatgatttctatcataattttttttcgtagtgcttagaatagtttcccgatgtgggatactgcagcacaccctgaaacggtaatgccgttgatgtgctgaggcttttgttcgcaaaagatttctcgtttttatttttcacatataccaggcctaaaatttaggttaattggatccataccattataaatgtgataaatcagaaaaatgtcactacctttcatgaaatcgggtagatgccattgtaattttttaaaattacaaccatgccacaacttcacgatttccgtcctccctgtcacatttttcgtcgtctccatcttcatcttcttgtcgtcttcgtctcgacagacaaaccagcgccggaggaggagggcacggcggcggatggggaaggggtggggcaggacaggaggagagctcctcggcgaggatggcggagagcgagacgtgcattccaccgctcatcggtgcgggggtgttcttgtcgtcttcgtctcaacggacaaactggcggcgagcgacgagaggacagggagaaggcgaggcggcgctggcgagcggtgaaaggatggggagaaggtgaggcggccatggcatcttcttccgccatcgtcgatgagctcttccaccagatctgcgcccctccacgcccatgctcgccggcgacgnnnnnnnnnnnnnnnnnnnnnnnnnnnnnnnnnnnnnnnnnnnnnnnnnnnnnn

SEQ ID NO: 19826 - DNA, 2043 bp, Oryza sativa
  unsure (1)..(2043): unsure at all n locations
nnnnnnnnnnnnnnnnnnnnnnnnnnnnnnnnnnnnnnnnnnnnnnnnnnnnnnnnnnnnnnnnncttcttccgccatcgtcgatgagctcttccaccagatctgcgcccctccacgaccatgctcgccggcgacggccacacctgctcccgtgcccctccacaacctccctgcgaccatcctcgccgacagccgcctcgtcctctcgccgctcgccaacgcctcctcgtcctcgccgctcgccctctccccgtcctctcgtctcctcgcgcttgtcggcgccgcctcgccttctccccgtgccaacatgagagaggaggacgaaaatagtgatgggagtggcatggttctaattttaaaagttttcattgacacccagctaataacgcgaatagtagttttatttttctgatttgtcacatttgcaatggcatgtatccaattaatcctaaaaattatgcacgtaattcattcactctctacgaataccacgaatggatttctgataatgtgacgtgtacatatctgctcatgaacatgatagcttgccgcaaacataattgttcatggagcgcatgcttgagaacgaccccattcttcaattatttcaacaacacgccaataattattcgcacaatcttgaaaaatggtatactacaaccacacgatcatcctgactgatcagctagagagctagaaggagaacttgaaggccatgtcgtgcctgtacacctggccgggcctgaccgtcatggaggggaactccgggtggttcacggcgtccacgtacccctgcgtctccaggcagaacccgccgtactgctggtacaccttgccgcccttgcccttgatgttgttcagccagttgccggtgtacagctgcatggccggctggttcgcccacagctccagcgcgcggcccgacgcgccgtcccgcgccgcggccaccttccgcatgccctcgccgtcgatcacgtagttgatgtcgtacccggcgatgcgcccgcccatcacctgccggatgcgcgcgccgatcggggtggggtgccggaagtcgtagggcgtgccggcgacgggcgcgacgacgcccgacgacgggaggagctcctcgtccagcggggtgtaccgcgacgccgacagctgcagcgtgtgccccagcacgtcgccgcggccctgcccgccgaggttccagtacgtgtgctgcaggaagttcaccggcgtcgccttgttcagcgccgtcgcgttcatgcgcagcgccagcacgtacgggctcgacagctggtacgtcacgtacgcgtccaggtccccggggaaacctgatcgatagccattcacaaattaatttacgactccaaatttcataaaagagaaactcgatctttcatctggaatttcgttgcacaccttgctctccgtcgaagctgcggtagtacaaggtgatgtacggcgagtcgccgccgccgacgtactccttcaccgtccatatgactttgctgaaccctctgtgtccacctgaatgtgagttcagtgaatttaataatctgttggccaggctgatctgaggtctgaaggcatgcgtccatgcaccaatgcataccgtgaatcgcgttcctgccgtcgttgatgtacgtgtgatacaccttcccgtcgagaacgaaccgccccctggctatcctctgcccgacccgtccggtaaccggcccgaagtaattagtgtcgttctggttggcatgagcaagaagatcattacagataaaaacaacttgaattattttgccatattttcgacagtgataacgcaaatgttaatgtctattgattcagaccgttcttcggtatggtaaacaaaagctgcttgtgtgtttgaatgatattccagatgatgagaagaaaatggataagggtagaacggaacagtgatttggagatgcggaccatcgttttctggcaagctcaaggtttttagataagcattctgaaannnnnnnnnnnnnnnnnnnnnnnnnnnnnnnnnnnnnnnnnnnnnnnnnnnnnnnnnnnnnn

SEQ ID NO: 19827 - DNA, 6280 bp, Oryza sativa
catctggaatttcgttgcacaccttgctctccgtcgaagctgcggtagtacaaggtgatgtacggcgagtcgccgccgccgacgtactccttcaccgtccatatgactttgctgaaccctctgtgtccacctgaatgtgagttcagtgaatttaataatctgttggccaggctgatctgaggtctgaaggcatgcgtccatgcaccaatgcataccgtgaatcgcgttcctgccgtcgttgatgtacgtgtgatacaccttcccgtcgagaacgaaccgccccctggctatcctctgcccgacccgtccggtaaccggcccgaagtaattagtgtcgttctggttggcatgagcaagaagatcattacagataaaaacaacttgaattattttgccatattttcgacagtgataacgcaaatgttaatgtctattgattcagaccgttcttcggtatggtaaacaaaagctgcttgtgtgtttgaatgatattccagatgatgagaagaaaatggataagggtagaacggaacagtgatttggagatgcggaccatcgttttctggcaagctcaaggtttttagataagcattctgaaatttttgctggctggctgaacctctgaagattagctatttattttttgcttagactcgattctattgaagggatgatactctgaccacgtcatagttggactaagtgacagtgtgaaacatatggaaaatgacaataataaaagggatttacatcagctttgcatgttgacagatgacaagggaagagtactgccaaggcgatccccccggtcaaacgattgttttcagaggaaattacgtcatatggtatttgttgttttgcctgtgctgatgagcattgtttatcttctagtagtaacttggtcacttgcagacaaagaatcataatttattgcatactgtttgatacggagtatgtttgtcagggtttgttccaatcgtatttcatttgtgatttaaaattttctaaagagtaaatttcacaaaactacatatactatgatcaaactatcacaaaactatatatttaactcggtgtatcacaaaactacacattcaacaccaaatttatcacaaaacaacatatttaaaatgaactattataaaactacatgttaagtaactaaattattataaaactacagttttagaactaatttagtcacagaacaataatatttatagctccagcataataatggtgctagggatttaaactctaaaagctgtagtttcgtgacaacttcaatattaaatatgtagttttgtgatacttaaccttaaatctatagttttgtgataaatatggtgctaaatctgtagttttgtggtataacgccttaaatctatagttttacgatagtttaatcaaaatatttgtagttttgtgaaaattactcttttcaaaattccaccatctttttgtcagttatacatcctttttacacctttctcatcactgtatctggaataagttccaaatgagtgcagggcaagcaatttcttgatcagacaagtacttttatcttgtgtatagtgtacaggggaaaaaaaaggaaatttaaagaatataagattcattcatccattcattaatagctgaggccttaactgtcgagaacaagtttgggtttcaatggactatgagaagaaggcaaaagaagaagctgaatgatattgccatttcctgcccaaaacattaaattttggaaggggtttggtgttcttaccacgtactcagcaatggtgtctaggccaagcacaacatcagccaaattccctgcagaaacacaagcactgcaaattcagaccaacacacgcaagtacacaaacgccataaagaaaaaaagctcaacagaggggacatgacggtacctttggaatcagggaggacgaccgacatcatggttgctccccagttggtgatcttcacggagaagtcccccttcctgagcacgtactcgccgaccgtcttcctcgcaccggcgccgccggcgagcgcggaggccaccaccaccaccacaaagcacaggaacgcgagagacaaccgagctccagccattgtgagcaaagcgattcgtcttgggcaactcacaggacgagaggagagggatgcatgcaactcattctcgatggtctcctgatatagatgtagatataggcggataccggccgcgatctcggacgagtttgttcgaggcgggaccggaccagcctggttacggacagacacctgcgctgcgcgcgtgctagcgtgtgatctttttgattgatctgatcctttcatccgtttgtgtcctcaagtcgcagcgaaacggagccaggtacacggtccgcttgcattggtcgcaggttgtgcatgctcgatcggccggaatccggtggtccgcccgcgagcgagtgggatgacaatttgtcattggggaagttggcaagtgtgctagtacgtgcgtggccactcttgaaactgtgcacagctcttcaaaaagaaaggaaaaaaagaaactgaaacgggccaatgataagattttgaacttgtcagttgtcacccacgtgcgccgtaggatgcctgccgccgccgcatcatgcaaaactatctcccacaagtcagaactcagaaccatcctttggacgtgttcttaataaacggtttgaaggacttgctacaagcagctgaaattttggaaaatgtcaattgatttttggacggataggatggctttaagattcgtgccaaatctctccaaatctacctttctctcttctttctcgtgccgccgccaccacattcctcttcccctttctcattgtctctcattctcttgttccctatggcatgtccacatgtgtattgatttaccttatgtttttgtgatatgtttccactttgtacacatgttgtgttgatcgttgtgttaggcttcatgttattttcattttttcctgctatgaggtgcttgtgagagcgactcacaacgacctggaagttccgagtggctgtcttggcttggttgagaaagctgctaggaagtttcgccctattaaatttaaccgttgcgatcggagaattttaagaaacacctattcgaccactcccgccaagtgacatctatgggctttcaacgctcgcctcaatagatctaacgcccgtcaacatactgtccatgcagttttggtgacacctcgtcgcccgcctttgtgttccgtccacaatcaggttcccctccaccccggccatccctctaaaaccgcccttacccccccccacccccacccccgcattgcctcgaactttgaaaacctagtacgtcggttctctgctggagttcaaaggtcaccaccatcgaggctcgccatcactgttgctggtaaatccatcttttacctcccattcctcttctcccacctcccccggtctaaaaggtggaagacgataggcatgccattgcatcttaatccacaaaaaatcaacgattgtctgaaatttggggaaattttagtgcatagatgaatagcaaatgtgcagtttgaatagttaataattgaagccttccaggatgctagtaaattatagctcaataacgttcttttttctaaacaacatggtaaaataaaaccatgcaaaaggtcgaaagaaaggaaaataagtgcataatcaacctcattattgattcatccgaacacaggacgtaagtccacgacttctataaatagaaatactacaaaacggtatattgttccaaacaaaatagctgacgttattatgatgttagcatggtatagtacttatgaaatatcatgcctggttgttgacagaaaacacgtggcctgggagatctgcttaactccagtgcaggtcaaagctcgccttcgggtgtgttagcatgccagttgatttgatcatgtaatcaacaagaaataaaagcaaagaaatcgcggttaaatctataaatgatagccgatcggccagatgccgatgacatatcatttatctttgagccgatgtcatctgtgtatcgatcggcagtcgtgaataagtaagaaagaactaaatctactcgatcggctgtagatattaacgatatatactccttatatcgatatatatttaaatcaagtgattgggatagatcggtcgccatgccgagacagtataaatcacttagattgaaacatatatcaataacaagactatatatctttatagcatagccgatcaaatagatctagcatgtatcggctaatactccgatacttccctatatcaggatattaaagcaggtataatatatcgaacagaggcctaacatgcttagatatagcaatatcttgatataaagggcagatttaacatattaatgaagcatatagaacaaatatagttaaattagatacgatcggctgaaactccgatactattctaatcggcaactagaaggtaggctagagatcgatattctaagcacgacttaatatatcaaactcaactgatacatcattaagtatgaaaagaagaacgacatctagacaatcaagccgctagaagtttcatagaatggtggatatcttatataatctagatcaacgtcaaaatctaacctaatcagttgccctctgctaacagatgttagccgataataggttagatggtgatattgctagagattatgtaagatatatgataactcgacgaattacataaataagattagagtatcataaagatggaagcactaatcctaagaacacaatccgtcataacaagttttacctcttgttgaagatcgaaaccgatgcagctcaacccgaaagcaagaactcgtcgaaacaaaactaaagcaaaagggtggcgatgcgccgaaattgtattgaacgtgtgtgttgtaaattacatagggctcggggtctatttatacccgagaattacaagacatgcccataccggacacgactgttatctctaacaaactctaagataccataagtctttgcggcaaacttttgccctaaacatatctctaaggaaattacataaaacatcctaattaatagatacaattgccttctcaggactctatccatgcgtggcaaccatcttgaagcacatcttctcaacccgatgttgtacaccaagtcgtattgttggaatcggctgtatcggcttatctagcccgactcagacccagccgatactaatcatagccgatccagactccagccgattcttgctctgtttccgaactcgatctccgcctctgactttgctttgatccaatcttctttcctgacacagatgttaccaaatttggttgttaacactggtatctacggttccaaatctggtacctacgtgagatcgagcatttgtttggatggttagcgacgccggtgggcacattgcccacgagcgttcgaaccccaagttcgacgctcgtgctcacccgggttttttccccctcttttcccgggactgactttggttggtcccggttaggtataatggtacacacgcgcgtgcgcattcagtggttgcatatttcccgtgcactgaggcctagtgccttcaatctcaatcctagtatgtgttagggacgcgcacacgtgtgtatgcgtgtgttgtggtgtgtgttcgtgtgtgtcctgatttgtaccctcccaaaaaaaaatctggtacctacgttaccatgctaaaacatcgatgtcattatgatatgtaagtatcaaagtctgatatctataagtattgtgtctggtataacggttcatatctgataccaataataccatatctgttatctacgataccatactaacattgtgttgaagtcagcacacataacctattacgttggaatggtaagtagctagccctcttccgtaaaactttgggtatgagagaagtggctctcgtatggaaaaacttttataagtccgcaactaacccaccacattatggtgcaagccggaagaatcccgggcttttctcttgccgcaacttctctatgagactgaactggctagtgaaaaattctcgtcttttcttcccccatgcgtcttattgcaaatcaacgcatatcatattattgcaccgaccgacaccgacaatgtcacaacttacagcagatgaagcgatcgaccaatgaccacatatgatccatgtatagtcacctaaactagaacgagaacttgtacaccatctcgtgcttgtacacctgtccgggccttacgatcaccgacgggaa

SEQ ID NO: 19828 - DNA, 20183 bp, Oryza sativa
  unsure (1)..(20183): unsure at all n locations
ccatactaacattgtgttgaagtcagcacacataacctattacgttggaatggtaagtagctagccctcttccgtaaaactttgggtatgagagaagtggctctcgtatggaaaaacttttataagtccgcaactaacccaccacattatggtgcaagccggaagaatcccgggcttttctcttgccgcaacttctctatgagactgaactggctagtgaaaaattctcgtcttttcttcccccatgcgtcttattgcaaatcaacgcatatcatattattgcaccgaccgacaccgacaatgtcacaacttacagcagatgaagcgatcgaccaatgaccacatatgatccatgtatagtcacctaaactagaacgagaacttgtacaccatctcgtgcttgtacacctgtccgggcctcacgatcaccgacgggaagttggggtggttcacggcgtcggggaacccctgcgtctccaggcacagcgcgccgtactgcccgtacgccttcccgcccttccccttcacgtcggccgtgaggaagttgccggtgtagaactgcaccccgggctggttcgcccacagctccagcgaccgcccggacttgccgtcccggacgacggccacccgccgcagcgcgtgcgcgtgcgcgtcgacgtcgtcaccgccgtccacggcgtagttggtgtcgaagccgtagatggtggcgcccgtcttgctgaggccgcccgtcaccaggtggacgcgcgcgcccacgggcgtcggcgcgcggaggtcgtagggcgtgccggtgacgggcgcgacctggcccgtcgggatgagctcggcgtccacgggggtgtaccgcgacgcgaacagctgcaccgtgttaccccggatgtcgccgctgcccgtgccaccgaggttccagtacgagtgctgcgccaggttcaccggcgtcgccttgcccgccgccgtcgcgttcatgtgcacgctcagcacgtacgggccggacagctggtacgtcacgtacacgtctagggcgcctgggaatcctgttcgacagaggcataattttgaccgttaggccctgtttggcacagctccagctcctaactccaccttacctagagctggagttatgccaaacggttcggattcatccaaaagaggaacggagcagtgcagatcgctccaaaaaattacactagcgtggtggagcggggaaaacacaactccacagctccactcccagcctgattacagcgctacccattacttttcgcaaaaattataagcagaatgccaccgcccctaccccttcgttccccaccgcaccgagccagactagcgcacatcgcgtttctcctcgaggccgcgaagagagaagggggagggaggactgaggcagcggcggcggtagcagtgaaggcacacggcgcatggtggcggtggtggcggctgcctcctctcgcacagcaagggcgccgggcggaggtctgggcggcgctgggcggaggtcagggcagcgcacgggcggtggatttggcgctgagacctcatggcggcggcacttggcggcgggagcggctccccacagcgaggaggcgcacggcaggagctgggcgacgccggtggcatagcagatctggtgcaaggagcaaggtaaccctaaaccctggactagctccctcaaaccctagactctctctcccccaaatttctcccgatctgtgtgtattgcttgattttagtttgtatactttaaccatattctcactatacttagatttctagaaagaattggtcagaaaaatttatatgtatgtggcaaaatatgtatttggtagcattacagttgtttgtcatttgtagataacattgcaactatatttattttttttcgggggtaggaaatgactgtataagaattcaatggtatgattcatatagtgtatgaatgagagttttattttttgggtttctaaaccaggcggtgggtatttcaaaattatgtgttaaattggaaaacaaatgtgccaaaatagttgttctaaatcattttacaatgacattgtgcaggacataccaggctgcaccaaatttattaagactggcttgcaaaatgaagagctacttgagaagatgtttgaagatatccgcaataccggtgctaaccattggtctttggggcaaggcaccataccaacagccatggatgcatttcgtgattacctagccggtcgtattgcaggttgatggacatatatcgtattttgtgttgttttgcggtcttatgctctatctttcgatgataatggtactagttattattactaaatatatgtcatgcaacaactttaatttttactttattttggagtaccaatcatataatgattgattgaatgtgttcccccctccctggcaatgaatggcagtgggtagctagctcgtttcttgttgtcttttaaaaacaaccaagacaaacaagggccgggcagggcagtcagtcccaatcaatcgatggtcaaaatggaaaagaaattaataatcaccgtgctgaaattattaaggaaatgaaaaagaaattaataatcaccgtgctgaacttattaaggaaatgaaaaataaattaatattcaccgtgctgaacttattaaggaaaagtatctattattaatcctaagtcagcaatgaaaaaacacaagggtagtattgtctatctaccctctatcctctctttcaggatttttggagctgagcaagcaagttagccaaacactttcagaccacctacagctcctagtggagctagctcccactggagttggagtttggagttaggagttgagagctgtagctctaccaaacagggccttagtttgactcagtaaatactacggaaatggattaaaggggtttcaacaaaattgcatttcaggtcttttgaagttatcttgtttgatccaatccaaatccaaggtcaagttcattgaattgtcatgtaaaaaagtcaaaagcatattgcatgaaagtgcaaagatagttcctctattttaaaatatagcgatatctaaataagacacgatcttatactgcgaatttggataatatgttcgtgcttgtaaaaattatattgtgtctaatccaatactaaattgttgtattttggaaaggtgaaagtagatgatacttctgctgatttgcattgaccataccttgttctccgtcaaagctatggtagtacagtgtgatgtatggtgcgtcacctccaccaacatgctccttcactgtccatgtaacattgctgaaacccctgtgaccaccttcagaaaaatgagataaaattagcttactgttcgtagagatgaaccatgcaccatggatttcttgcacctcgggaaatttctcaagaataccgtgaagtgtgtttttgccatcatttggatacagatgataagcttttccatcgagcacgaaccgcgccttggcaattctgttggctacccgtccgacgagcgctccaaagtaagtagaagaattctgaacagcagaattcagaaggcaaactgaagtgaggtaatttagcatttaccctttaaggtacttgaatacagtgaactcagagctgtcattttctttgatgggttacccagcttgcaattttttttttgaacggaaagcttgcaaatgaactactatgtaaaaaagattagttagaaacttttttgcccttctgaaagtaggtagactttgtcaaaaactcaattggtctgcataagattttgctcgtgcttgtgctgctctgttcatgtgattggattgtgatttgggatagtattatatgtagagagaagtgaaggttcagaaagaagaacagaacaaagaaaaaaaaagtatttatatggctattgcaaaagtgcgggacaagtaataactaggcaacacaccggcatcacatggtgaggttgtcagctgtctctctctttcgtgagactgatatactatttcttgggtaacaaactaacatggccactggcttaaagaaaactgcatccatctaatccttttgtcgatcatatgtttcttgctatttcttttcctcttctctatgcttatgcaactacgccataatattgaattttcctagacgtggcaacagcatctctatttgtgtcaattgtttttttttatctatcttggacctccatgtttgaaaactgaccccaaactgaaggcgacaacaaaggtctcgtgagagttttttaaaacgttcaaataattgagagcatttttatgggatagtcaatggccaattaagttgatcatccctgcttctcgggtccagaaatgtagcaggtgattaggtgaaattgaaactgggtgatgagcaacagaaaactaatttgagtaaactggatgcagacagaagtgcaaaaaaaaaaaactcaaacacacaaactatcgctatgtaatgctgttctacaatccatatcaaacgacaatgaggacagggaactatcgctatgtaatgaggtttcacaagttgtgtgtagaaacaggtaagtaaacagtgaaaatatgagcatatgcactgccttaaaagaagaacagggacaatgaggtcagcaaatcttacaacatattcagcaatggtgtcatatccaagaacaacatcgtccaatttccctggcagaaaacaagtctccaaagtttcagctcgaaacccccatgaaacgagcagagaaatcacgaggcaaatgaagctctggtgtccttgacggagagagagagaggctcacctctggagtcaggaagcacgacggacatgatgaccgctccccaattggtgaccctgatggagaaatctcccttcctgagctcatagacgccgaccgtcgtcgccttcctctccgccgcatcggcaccgccggcggaggcggcggccactaggcacaccgccgcgagaagaagcagcagcggagctggtctagccatcgcccaacactgctctctctctctctctctctctctctctctctctctctctctctctctctctctctctctctatctatctatctatctgcgagtgaggaagacggagacagaagggacgcgacaagctctgcccgggatggttgctggccttggccggatggacggatatgtaatgtagtcaaaagcgtagtagtagtagcaactagcaacttggggatgcgataagatggtgacaaagttgaagtgttcgtgtgtgctcccaaggcgtctccgagaaaatgtcgcgcgcgagccgagcgcgcggggccagcgcgagcgatttgtccttgactcccgcgcagcgtgcgctagtgtttttgcacagcgatccggggtccagcgatcgattttgtcctggctctcactgcgatgcgatgcgatccgtgcccacgcggccggcgtcttccgcggcgaatggatcgtgcacgatcgatggtacatggacggcgacggcgtggtgcacggcgaatattcgctcgcttgccctgtgatcttagatgatgagctgaatgattgatgagtttgatgactcgctcgctggttcagcatctggatggcttttgtgtcgatgtgccatgtagtatcatgacctcgtgtctacttttgcccacacggcatggtgcacgtgcaactggtacacactttgccaccgtttgatggaatggaatggaagggagaaaaaagtgtagccgtatcgtcctagctgcaaagggaacgcctgggcaccaccaaatgggcatgggggcaatggcctttttgttggagcaacgtggctgtgtagagaaatgcagcggaagcaccgagcaccgtagtgaggagaaaggtgcggaccacaactccacaaaggcaggcccaaacaaatggcacgcggccctggcccatcatcgacaatgcgacagacaaaaaaatacaagcaggcacgcagacccttcaagacttttaactcgccgttcatcatccggacctgcttgacaaggtaggagaacttgaatatcttaaactaacccaaattaatctgtaaaaatccctacatgcaatgcccgctattctcttcttttcgagattaacaaaggtcttaaagagtaaggaaccacaagcaagtaataacacaaacaggtaaaccaatacacaaattttattgccagttcctccgactgactaaactgacatgagaaggtgttcaggacaattgccacggacatgaatgtacaaatgactggactaaagcaaccacggaccatttatctagacaaaggaaaaaaagccaaagaagttcaaatcggcaaaataaattgccttgtttatgtacacaaccaaactaacagaattcggcagccggagaagcaaattcagagcttatccatgtcggcgttcctgaagctgccaccgaggagtgacaagaggccgccaccgtgcacccttccctccggaacggcacagcctccctctctgcccccatgcacggtaggttcggacgacgatgagggcatcatagagcgaggcaccagcacctggggaggtatcatcatcgcctggctcctcaccgtgccgtcgcagtccgacgcggtgctgatgcccgacgacgagtactcgttcgtcatgctgctcgtggcagcgacggtcactatgccgctgaaaaggcctggcgggatcatgcccgcgccgttgttcgccgcgtcgcgctcttgctgcttggccgccaaggtcccatgcgcggcgcacaggccgttcctgccgcgggcgaacttttcgcagcccgttccccaagtgcaccgcttgccgccgccgtgggctttgcagaagtccgtgctcccctgggcgctcttgctggagctgtcgaccttgcacctcttgccaccaccgtgcttcacgcaacagtccgtgcgggcacgggcactcttggtgcagccagccaccgaacagcgcttccctcctccgtgcgccacgcagtactcagtgccaccatggacgctctttgggcagacgccgccaccttcgaacatgcatcgcttcccgccaccgtgtgctttgcacagaggcgtgctcccctcagcacctttgctgcagccgtcaaagatacaccgcttgccaccgccatgccctttgcagtacaatgtgctgccttgagcccccttactgcagtccgggaactggcaccggcggccaccaccatgagaaatgcagagcccggccttaccctcagcgctccggatgcaaccttgcaccgtgcatctcttaccaccaccgtgcttgatgcaccgcccagacttaccccgtgcagctttaggacagccatcatgttcacaacgacgacctccaccgtgagcgatacaataatctgtcttcccttcagcactcttggtgcaaccaagctcctcgcaccgccgaccaccgccatgggccttgcaataggcagtgctgctctctgcacctttatggcacccaggcttatggcatctctgcccacctccatgggcaatacacagccctgatgcgcctctcgcacctttcgagcatcccttgaacctgcacttcttgggatgccggggatgattcctttgttctgatgtggttgttgccgtgacaacgtcggagctcacaccaaatgaagtatctgtcatggcagaaggctcagggctcagctgaaggtgatgttgaacgtgctgagtgttatcattgtcgctgtgcgtcaggtctagtgaatcctgggtttctgcttcgtgggtctcattgacagcagaagaaccggagcgtggagcaaagagtagggatggcatgtagccaccgatgctccttacagaaggagatgctgaggcttcatcaacaacagtaaaagaatgaactgttccatctggtgcttgcaaaggttgaattgtttgagaaacatccatttgaaggccaagcctcaatgtcccaggatcggtgatagtcaaaccctgtccagataacgaaggagcttctttaagcttgtctactccagtgggctgacactctgcagagtaaaaattcggcgttggacccaacccaaggactaacctgcaaccatcatctctagttgtgatgctatcaatgcactgtatattttgattaccatggccataattagccattgcagatcccaggcagtccatgtggggtgtgcttttgccaaggttcaccatgtagctctgagctgagggttccattaacacaaacgggttattcattggaggttgatttgggatatccacaaagctgttatccatcacagcttgacaatatgacaacggggtgagagcaaatgacaactgaatcactgaatagctgaagaacagggaactgatgatctttcaaacacagatcacagaatagacaaaatggaagaatatcagcaggagtgtagtactgaagcaaccaccactgacaaagcctgaggtgtctgcacggtccatgcctgtcttgttttggttgaatttatgatccaatgctacttgacctccacagcactaaacaacatctttgatagttgacatcaagcataggcaggagcctcgaaatgcttactggttgggaggtcctcaactgacaaaagcaaaacaaaatattaaccaaaattcagatgtcaaatatatgtttggcgtgaccttattaaaactattataataccatagacaggtcaccaagccagtaaagcaaaccacaattagtgttgtgcaaagattaaataatcagaagtgaatacattttattccatccattcaagtatacatggcgtgctttattcacacacatgttcaactatatagggtaacacagttttcgaagtgattttgcacatatttgcccatacaaactccttttagcagcacagcattgaacactccattggttcctaagcaactctcattaatcaagtagttgatggcaacttagtcatttgtgctggattcggtctacaagtgaaaaggaaaacacaccatatatactagaactgagagagtacaaggaaactgcaattatgaagtggtttcaagcaagcaaaaatagtagccgagatcaatgcaaaacaaactccaaacatgtttgattggtaaagctacatgttaaattattattaagattatccttttgggggcataaatcatttaataatacctttaggtaaagaagattgaagggtcaaagtgagtaactaacacgacaaaagtctttctccagaaaggaggcaaaaatgtggagtctatttaatttgagcaacagcatgcacaagcaactcccgtagcaagaatttgcacagtagaaatctcaaaatattgacagaacctatctgccctttattatactcgtaataccagccaaccaggtgctacctttgccgccttgagtgaaataaatggtttaaccaaggccaagcagtgtcaataactcaaaatgaggtgatcgataaaccaggaaatcaaccacattgcaatgcgcaatctacaaaggggaatagtatgaagtaatgaaccctcatcagtttacctaatgagtacaataaccaagatcagcagtcataaatacatgttattctccatgaaaaggtaaccaaaagattggatagaaaacaagtaacaaatgtctctgttttttctttcttaaccaaaaacgactgtcatacatttttggtcttctgcatacgactgcaagacctgtgcctcttattacatatctaaataccataacaattcaactttcctaaaatcatccacacattctataacattcccaacagtaaaaaatattggattacactgaacatatcattcctaatacaggtgcatttctgactgactagaagggttcagacttaagcagtatcaatttaaaaatagatgcctaacaagtactgctcaacaaagagcatcccgaatctccctttggaatattgtatcacggattgctgagaagtgcacaagatcactacacgcaaaatttctaatatccaagaattccagtccagaacagttagttcattcttgtcctaatattttttttttctgaacttcgcctgattctctcctagtcctaggtacggagtactattatttagggtctcgtgtactagctaaccaggaagataagtccatatactgcaacaatctatctatgtacttaactagttagattgagagtaaatagtaaaagaaaagaagacagggaagagaaaacaggaagaaatggaagaggacaggattatagcgctaattatctaagaatacagggttaagacttaagagactcagagcctcagaccatcacaattgcagaacatcccaaaacaacaagaactaagtatcccaaaatcaggaaccttctactccatcctgaaccttcacagaaccccacaaaatcctgcaattctcctacgacaacaaactagaataccatggcacagaacagatctgattgtttcctgaaaaaaaaaaacttccaccaaaccgaacatggcacacatgaaattccccaatcgggacaccacgaggggcgacctaaaagggggactgggaccaacaaacccatccccgcaaaacccctgcagccatgacatgcgaagagaaagggaaggcaaggacgtaaacacataatcgcggtgagatggagcaggcttgagtcaccttagcgcgcgagagcggaggaggagagggaggaggggtctcgctacggagcggggcgaggagggcggggagtcgatcgctgcgggcggaggcggaggcggaggcgggggcggaggaggcggtgtgttttgctgcctttctggtggcttccctagtgcgcgagaaggggagaagtactggcctccgtgtggagtatgtatggaatgcgggtgtgcggagcgagggggaaaaatcggtaggagggctcgtcgcgtgtgcaggtggggcgggacaggacgggacgggacggcggggtggggtggatggatgacggcgggattacctggcgagcctggctggctggcaggctccgctcggcggctgcgcgagccagccacgcgaccgaccggcagcgacccagctgtttctttgcccttctttttcttaatgtttttatgtgttgccttgcgttctcttttttcctttttggttttggtttgttttgtatctggccggatatcatgtggtgacgaactaacgataggctttagcctgtgggttggattcatccactcgccatgataaggtgcgtcatcactcatcatttgcatatggattaggatgcgtttgagagttgtttttcgcgtacacgcttccaaactgttaaacggtgtttaaaaaaaattaatagaaaaattactttaaaaatcacattaatctattttcaagtttaaaataattaatacttaattaaatacatactaatagtttacctctttttttatcttcttaatattttttatttctctctttcttaaacaggaatgattacatgggatctcatcatggactaccttttacggaggttgaaatcatcccacatctttgcctcctcctcgtgagtccgtcactgtcctatccttatgccatgcgctcgcgtcccgtgccttgagcagaggcgcgggcatcagttggtaggaaagaatggcaacaatgctagtaggaggtagtggcatcaacatcggtattagcgaatgtgacactagaaggcaacgacataggcaatgaagttggccacagtagtagcaacaggaagccgaggagaaagggagaagacgaaaggaggtgctagcagcatgcggctcgttggtccaccaagtcgaggcaatatgtgtcccctcttgcaccttaatactagataatatatcgaatttgttactccatgggtactgtgggtaccaactggtacctcagaggtaccaaatctgatacttgttgatacctaggatagtactatgtccgataaccgtaggtattagctatgataccacaagtactactcgagaatgatgtgtcgcatgatgtacttaccacaacaccgacgatgagcatgacggcttcactgccacgtagcccgctaatcaaagctccagatccagccgcttcgttgccctccccctctatcaccatcgacaaagcttgggaggaggtgcttgtgctggccttcttgacaacctccctttccccctggttgtccccttccgccatgggagtcagatattgtggatgtcgccatgcctcaagcatgagacagaggagaaggccatggaccgtcgtagtccactgccctcgtcaccgacgtatacttgggtcagatccggcatcaaggaggcctagacctccagatccggcgtttgtcgatggcccagaatgcctccatacctaaccatagattggtggaggaaggagaagagggggagcacgggaggggaacgataggaagagagtggaggagaaaaaagaggccaaggaagatgagagggcaacgcaccgtggtggtgggcgttaagtatccgcacccggatggaacatcgttctatagattatctaaagtgaagggagaacttgcttgtgatttggatttgagaaaattccttgtatgcccctagaaagttacctaatcccttgtatgcctctgaaacttacttgatccctttcatacctttgaaattttgatttgatcccttacacgtctctaccgttaggtttacttcattccactcgttaatttggttgaaaatgtccataatacccttcaagttgtaggagctggaaattgagcgcatgtttggctgtcaacttgataaaagactgtaatattcatgagtgcacactgtgtgttttagagactaaataattagtacatacaatttttaacataaatttggaagaagaaatttaatgtgtttaccttatagcattcagcataaattaaacataaaattggtggaagaaatttaatagtgttttatgagactaaataattatgacatacaatttttaacatgaatttggaagaagaaatttaatgtgtttatcttttgttatagcactcaacagaaatttaacataaatttggaagaagaaatttaatagatctttttggtgatacgagaaataccataaggagcatacaaaattatcaggagcatcaattgacgggaaggaaaaaaaacatctgaagcatccatacaccatcagggatacacaattaacaatttgattaattatggtgcatccatacaccatcagcattaagcaaccacagatccattgatttatacatcatgagcatgacggcgcgagagggtggtgggacgtcgagagctcgtgtatccaggtgccgaggacggaattcgagcactgacgggatgccgaaccgccgctacgacgggatgcgaagccactgccgcgcgcgggatgcagagccgatattgagccaccatcgccgactggatgcaggagccgttgcatgacgggatgtggagcaacgacgatttggagattggaggtgataacctgtggcatttttgtctttcttaaaaaaaactgataagctaacacacgccttcactcgtatatcttacggaaatctaatggtaagggtatgtaaatgattaaatcaaaattttagaggcatacaggggattgagtaactcttcaggacacagaaggaattttctctttgaatctactgacactttgattggctataacaaaagatagaagatacttaatttgttaattatgccagcatagtcggttttgtttttcaaaatatcaatcatttccttatcttcgacctcagtttagctcattggtgccatccaaacaaggaggcaaatgctaaacataaaagatggtgtgccgcgcggccggccggccggggaagggggggacgctagatttggcaacgatgaacatggttcaagtgggaagactcgcataaaagttcaattttagtcttgattgtagcataaacatgataaaggaaatcgaattatggatcgttggttgtcatgcacgatctaaaacattgtagcttggcctaatcgaaaactgtgtgtgttcaatggtagtaaaaggaatagaacagagcagagtaaggaagtgttttacattgatttcgttcataagtggatccaatggcaagcaacatccaaaaccaaaatcgaactgctcatatttttttatgacgtggccactataactttgcgaaaaaaaaagtttacttctttcatacccccttgtcctcttgcacccctataattttttttcatccgaaacttattttttagaactttccatccgaaactctcctgattaatccaacctaaggttccgttcatttctccaataagaattagataaagataaagattttcatctcatattttttaaactgctaaacggtgtgtttttgtgcgaaaactttatatataaaagttactctaaaatatcatattaatctatttttaagttaaaacttaatcaatcatacattaataccatatagttatacgtaaaaaaaaacttaatcttttatcttgagaacctaagtgcatgactcaaatgatctaaatacgacaaacaggctagagcagatctcagatctgcagcggcagtttggagcagtgaccccccatttcatttggccatttcctcccatcgctttcaccgaaaagcagggggccccacgtagagcgacgcatggccaagcgatccgggagagccgtttacgtgcacaagttgcgcccgttttgggccccggccacgttggaccattgcacgctcgcaacatccctcgtggagcccagaacttgtttggtagcacagtgcctacaaatcctggagccgtgggccacccactgttactcctcctgattgctaccacaagccgagccactgaagccagcactgttcatacgcagcctcggctcggctcggctcatcggcgcgattcgctctccaccgtccgtcccgcgaaccgcacccgattcgccgtgtcctccacttgtcgacatcccacaggccgcctcccattctctagtggcgttcacgcgcccgagacgcctcccctaggaaaaaaaagtaatatctccgtcccaaaatataagatgattggacacggttatttaaaaaaaatagatagaagtaagtggtggaagattgtgattggatgaatagtgagggtaggtgagaaaagtagatggtggagggttgtaatgggaagagaatgttgatggagaaattgttatattttaagataaatcctaagggctaacagttgttatattttgggacggagggagtagcaggggacacactcgcttacataaaaaaacaaaagaaaaacactcttacccacgacacgacagcgcccacgctaaccgccatgtgggccccgcaacctttccctgccccacccgtcatccgccccaccagcggaatctcgcctgtacgctcggctctcggggcccacgccccccgcgcgtcccgccggccggccacgcgtcgcgcctccgattcgctcgtcccctctgccaggtgggccccgccgtcctccgcccgttttgggcctgggcccagtactagcgtaacctagagcctttgccaccgcatctgctgtgcgcgacgacgcgagggcggtggcgtctggtggcggcgcgcggcggccgcactgtcgcggtggtgacgccagccgacgcgagggccgcgtgtttctcttctctcgcttggcggtggggaccagcagagagacgcgacgctttttttactaagagcaagtttaatagtatagccaactattagctctaaattatctatagctaatgtaatagccaattcatacaatagttgcttattatactattaatatctggtcctacctgtcatacacacattacgttttagaatccgtgctacagctggctacaaatctgtagcccgctgctttttttctctctatttagctctttaaaatatgtttatagcatgtttatagctgacttataacttactattgtacatgctctaaaggctaaaggacgctgctgacgtctcctcctccgttggcttggctccgtgcgtgtactggcgatcgaccacgagaacgacgacgacgagtttggtgggggctcgtcacgccgagacaatcagattttcttcaccgcctggtgatgtaatcgccttttaattaacttgtgagcgtgcacgtttaaaatcctgaagggaccatgtggattgcgtcaccgctgacaacgaaaggatttactagtggtagaggagtacagacaggagaagcttagctttgatcgtttgtatttaaaaagagagagtagcaaatggcaccaaaacatcaccactagaagccagatttgtaaaaggaaatacacaaatagttttgtttgggcaagagaaccttcgggatccacacggtcgagcctcagcttcagctcctgcggcgtccagatcagaaatgagaaataaattaagcaccgatcgagccaataatcgtttggccgataccaatattgtacagcaaattgggccaatagcattgggtcaaactggtttaactactgatcgaatcccatagattggtgcctgcctaccgtgggctatataatcctgtatgcaaataattggtgcaacctgctatctggtcgctgaagtcgtcactcgtcagttactagtcgtgtcacttcaaaaataaatcagttaggggtatttagatctagggtgtaaagtttcagcgcgtcacatcgggtatcatgtaggatgtcttatggggtgttcggatactaataaaaaaaactaattacagaatccgttagtaaaccgcgggacaaacattaaacctaattaatctatcattagcacatgttcactgtagcaccacattgttaaatcatagagcaattaggcttaaaagatttgtctcacaaattagtcataatctgtgcaattagttattttttaacttatagtatttaatacttcacgcatgtgttaaaacattcgatatgataggatataaaattttaaggtggaatctaaacagcgcctcactttaccgtttcaagcaatgacaaatggcaccatcgtttacatgtcacagattcaccattactgtaacgaggttgcatcaatccctcggtccttcactaagcttgaatcctttatttacatttctgaaaacaaatgaaaatctccgggccaatttgtctccaaaaacgagccagaatatatgaatatactccctctgtttcgttttatttgtcgctatcagtccaaaccgaaaacatcctttttattatttgacgctctagttcatctctacctgctatcctacgcgaaattccatccttacccctcgcgccctctccatcccgcaaggccacaacccagtctccagtagcgctggcgcgcagcatggcgacctcggtctcgcgtgctcggcaggcgtggcgatggcgaacatgaggagcagcagcaggacgtcgtcgtcgtcgccggcggcggcgttgctgcggtggggggcgctgacatctgcgccgcggtgcatggcgtgcggcgggacgaggcgggaggagtgccgcctgtgcacgcggtagtccgactcccggggtgacctccgggtgccgggcgtgcgccagcacgcggcgggcgccctgccggagctgcggcaggtcgggcaccggacgtcacgcccccgtccacgcctcctccgcgccgccacggtgaccgggtcgatcagaagctgtcgctgtcgcctccgcgccgatggattaatcaaacccccaggctctcgatcgccgccatccgccgacatcgaactccgagctgcgaatttattttgttggcaggttcagtgtccatggaagaccaaacagctggccaatgaagcttgctcagttggctaagaagttgcagcagaggatggtgtcagtcagtgctagtggacagaaggcggtcaccgccgatgattgctgctcagcggcggcggtggaggcgggctcgcgaagagacgggagggaggtgagagaaggtgtaggaagaggggaatgagaaaagggagtatgtgcatacgtgtgtgtgctcaccggcggggggaagcaggatgccggcgccgctacctgtgggaaggggaagccgcagcaagggaggtggggaagagcgccgccgtccccgccgtcggccctgccgtggcgctggggattgggatggggcgccgccgccgcaacgtgtggaagaggaacgaatcggggaagaggaagggcaaaagggtaaattcgcgtgaaccttaatttcgccgaagttgtcggaaacgacaaataaaaagaaacggagggagtataatgcagtatgccctgctggaacttttttcatacagggaccataaaattatgtagcaggaccacattgcaaaggaaggtagctacaatgggccatatatgggctaaagatgtatggttgaaatttgggccgagatagaccctcaacgtagtggacttaaaacggcccaattaccaattactcgtgttgctcctgaaagaattgagaggagtgcctctcgtacctacattctgctctgctgctaatattttttatttttgtgctctcttttagattacatgacactgacacgactgaatgggcccatatgccccagcagaaggtaggctaaaggtgattctgtgaaacatgaaacaaactccgggtaaagcttacgcagataaatgtgaacagcacgagcactgaagtcacgcccattgctcaaccaccgtagcgacgaaggtgcttttcctgatttctttgtcattgcttatttgcatttgacaatggccgcaaggttttttcatgcttaaaaagcttttaaaaacctttctttggcacaagggctcgagtcatatgtataatctactttacaaagcttaattagcctaacatgatcaccctcattttaacatggaattcgctattgaccgccgaaatgaccgggatagttacttctatagatgacatcttctcttctcttcgctgcttctgcttctgaagtcggtgtagcaccacaggtcggggtagaggtagcaggcagctgcatcgagtcatggatcaccagattgatgccgaaaccgttgccagtgatctcatcagcgcgtctctccgcctctccaggcgcaacctgctctgtcgtactccctgtctcctgtaataagccatttttagttattttcatttatctcggaataagtttattttcaaataatcattgtatcggagttcatgaaagtatggagtggttgtattgggagtagctaaattaaagagtaattgcataataatttgataaaataggggtattttaatctttttattttatatggatatgtgtgggatgtgtgaaaaataaatttattttgggacggagggagtataatgcagctgtgtttcctcttcaacgcctcttctagataaattaaggtcccgtttggtaacttgaaagcctgttaatctgttataaccatgggccaacttcaaagcctgttataactgagaggaatatatatttcaaagataacctaatccgaagattgctagatataccaaagctatggcatcacgcccttttcttgcagattcttgcagcagataagaagagaaaaaaaagaaggtacgccggccagaaagcatcaacggaggaaaatttggtggatgagacggagtgacaagtgagctgtgagcaatacatggaatctctcagggttttttaagtgacggctgagtgtggggttgtgggggtggagatgtgcttaccacgtgaacaaccctatatactttgacccaaggctggcaggcatctttctcgttactgtttttcattgtgggagtagaagcacaacttccttttcactgccaactctagattgcacccaagtggatttatcgcagatgcaagctgttgcaaaagcacaactgctttacttttttccccttctataatttgagcaaataatgcagctatccattttcagatatccttctacattagtgtatggctgtatttagttctttaggtgtaaaaactttgaagtatacggacgcacatttgaagtattaaacgtagaataataacaaaacaaattannnnnnnnnnnnnnnnnnnnnnnnnnnnnnnnnnnnnnnnnnnnnnnnnnnnnnnnn

SEQ ID NO: 19829 - DNA, 27253 bp, Oryza sativa
atgacgtaattaggctcaaaagattcatctcgcaatttatgtgcaaactgtgtaattggtttttttccacatttaatgccccatgcatgtatccaaatatttgatgtgacgtttttggcaaaaaaaaaaactttggaatctaaacacggcatatgtctgataatgtctaaaacgtactaggtaccatgcatgtcctgtgttctaaaagtggaacatttggaaacagttaatatgtggcagtatatacaattgattctttttactctctctagggcatgtacaatggtgtttaataacggtctctcttcgttgtcatgcaagtaaatttggtgacgtggaagaaagagaggaaggaatgagaaacatcgttgctacgtatgacaacggctcagagtcgactcttagcatttattaacataaaatttgttgcatgaaagtgcagaaaaggaaagaagtataataaaaattatttagtatattaatggtttagaaatctcattgtctctactattgtaggaggatagtctctagtgatattaattagtatagagagatcatattagactctatatttgtacatgcctttataggctggcctgctaaattttattaaggttgtgttctaaagaaaggttggcctggactaatcattcatttatcgtaagcatgctttgcaaactattaaacaatgtgtttcatttaaaatctttctatataaaaatttcttttaaaaaaatcaaataaactatttttacgctgatggctcgtctcattttctatgtcaccaactaactatccccaacagacagcagctgtatcgaactcagcctaagacacgaagaatataaagtacaatgtgcagtccctatagtaagttgctaatagaacactgttgtcccctctttgttaggagtacatggtattttggcttatcccttaaaatgaaaagtgatacagtactattctatatattcatggaatatttgtaagcaacagaatcaccaaatgctaagcatttctatataacctttattagggggttatcacaccgaagctagaggattgtacgtagtggtctgtgaagtcgtgtgtgtgataactgatactacctccgtcccatataaattgtatttataggttgtttagtatatactaaggtttgagaagaaatactatgatgctccttattaaatgatgtataggtaagagaggaagggtagttgagggtaaaataaagagaaatttgaatgagaaatgattaatgagaccattagtactctattgtgataattattttaagataaatttaaattttcgaaatacaattattatgggacaaatgtagtacgaggtaagatgttttccactgggataacaggtgacttatcagttgctaattttaaaaaagattttactacaatactcctatcttttaaaaagttttgcatttcctaacataacgattaccagtactccctagagatgatagatttatggaatagagattctacaaagattaaatggacaaaatttaaaattcagacaaatactactacctctatactaaaatattactacaacataggccatgtttagttcctcctcttttttttttatgtatacggacgcacatgcacattttaagtattaagcgtagactaataagaaaacaaattgcagattccgcctataaactgtgacacgaatttattaagcctaattaatccatcattagcaaatgtttaatgtagcacaacattgtcaaatcatggcgtaattaggctcaaaagattcatatcgcaatttacatgcaaactgtgtaattggtttttttcggtccacatttaatgctcaatgcatgtgttcaaacatttgatgtgatggaatttttgaaagtttgaagggaactaaacacaaccatagaataaaattttgacaataaatccgcagattgcaatgttttgagtctggaaaaaatacttttctcactaactaatacagcagatatttcgggtgaagtgccgcatgtcagcttagggtgtgtttagttcatataaaattggaagttttgttgaaattagaacgatgtgacgaaaaaattgaaagtttgtgtgtgtagaaaaaatttgatgtgataaaaaagttaaaagtataaagaaaaagtttagaaataaactcggccctattgtcatcccatccctctttttctgcatccctctccatttctaggcgtactactacatttttctttgtggaaaagacatgaagcttttcgaatccacagccacagtgatgctatctcaaagctcaccggggggcggggccgcgggggccatagccacgggcttggtatagtacatttctgatccgaaactctgaactcgaggcggtgtttagttcttcaaacttccaacttttttatcacattaaaactttcctacacacataaactttcaactttttcatcacatcgttctaatttcaaccaaactttcaattttaacgtgaactaaacacagtctgagtgaaccacatcaacaagtacggaacacttagaccgagtttagatctaaactttttcttaaaactttcaactttttcatcacatcaaaactttcctacacacataggctgtgtttagatttaaactttggatccaaacttctaactttttccatcacatcaacctgtcatacacatacaacttttcagtcatatcgtaccaatttcaacccaaactttcaattttggaaggaactaaacacagccataaatttccaacttttccatcacatcgttttaatttcaaccaaatgttcaattttagcgtgaactagacccacccttactacagctctaatggcgctggagacatacgtcacgactgatcctaaaacaaaccatcacatcgacgtgccatttcgatggcacccagcaccgttgccaatttgtcattttcacgaggtcctcgacgacgcgttgaatcttccactgtctttgttagggctagtagtatcagatctttttatattatcaaaaaaatcaagtctttgtttcgttcttgtaccaaatctctcagcctaagaaatataaggttcactgaaagtgacataatgagcaaatgcaaagaaggtaaatttgttccgtagtatttccgtcagacttgcggctgccgacttttctctcttaacagaataaaaatccgcaaagagatacctatgggtaacacacaattgatcctcttttttcatagacaattcacagtctacagttgaattgtgcgtccccccccctctcttacatgcatatgtattatgagctggcagttgaaagtcaatgcatggttgtgatgataaattctagaaatctttttagattaaactacatggatgttagatgcttcctaaactttgaagttcgtaaactgtttcatagatagcccccgtggaaactctgtttcaaagtctcctttggagcacaaaaaaaaattgtacagcttttatagagtatattttttaacatactcttttatttagagtgttgacaaaaactttcaaattctctacgctcacacgagtctcgattaagaatgagtatttcttattacaaggaatgtaactagcttttctaacttctaaatgatattgggctatgttcagcaacactgctctgcagctataaccggttgtgctatacagtcagtgtatatattttctttaccatgcactatagcgctgttgtgcagctgcagtttagctacaccgaacaaacccgcgatttcgagaaaattatatataaaaaaatcattatcaaaccattttaaatacacttttaacttcataagattttgatcattcgactattcagccaagaaaaaacacatatcctaaaatacttctcgggagcgtaattaataaactctagggcctattcactttaatgccattttcaaccttaccaaattttagtaaaattactaaaaaaatagctacatttagtttgttgctaaattttagtaactatataagaaatcctattaaaattttagcaaattactaaaattttagtatttagcatcaaagtaaacaggcgtatagtcttctgagtacaacgcataagcattgaagcaaaagcaagtactactatcaccaccatccgatgggtgggtctcaactctgtcttaaccacaacgcccaaagaggcgtagaccgtggacgtagaccagcacggtccaccgttttgaccggaatccgagctggcacatcacgggccccaccgctcgtagaaaaaacagaaaaaaaaaacggacgggacgggatcctctctctcatcgttcgtcgtccatccatccatccatccatccatccatcccctgcgccccgccagagcagcgcacaggcatctcaaccccacccccagcgcgtgcgtgacgacccgccactggctccccgcctccgcccccccccccccagtgggcccgtccccctgacaaggtggggcccacgtggcgcagcaggtgcggcagggtacggatgccgcaccggatcccgtcatcacgaggggactttttgactgcgggattagctggcctcctgacgcgtgggcccggggacagtgaaggcgagggtaaggtacgtggctagtacgtgaacctgccgtactgcaccgcgagtttttgggatggccgtgccgctgtgcgtgtaccggtttttgggatacttctacaaacagggcacaaaaatgactggactggggggaagtaagtacaacccgtacgaggtgtgtgcgagcgcatgaccactgctgtgaactggagtggcaacgtactggagtactatcaccgtaggaacgaccatggtattgtgtattagatttttaatatttagccattcgtgagatggaacaaacagaaatactgaagtagtagagcatttgattgaaaatagagtttggcacatcgtggtaacgctgttttgctctcgttttaattatcagctcttgaaaacttgtgagctagaaagttttttttttaactcaggtagatctttatatgtcaattacttgtttaaaaaatatatacttcagttagtaaagtaacatagaaaatattatgcgttttcattgcttggggttgttagacagtggccccaccatatgaaaacatgttaaatatggcttgtttcaaggtgagctgcatttactcactccatcccctaagcataaaattaagagttaatgctctattaatagctaataattaagattgactcttaggtaccatggaaccatgaacctaatttgtatacctatgtaaaataaaaaagcttatatataatactactatacatatactaaaataaaaagatagtattatgcacacgaaacttttaaccctagcaaaattatggtaaatatcatttaattcacaataattttttaataaaaagcgctttaccagagaatcttttaaacttacacccatgatacattacaagtttggttttctaagagaacaatataaattgttggtgagaaatttgaaaaaacaacaacagaaacccctggattctttccatgaattacagcatagaagaaaaggcctaataattcatggaccgaaaaataataccagcgactcggcgagaagtcggtaaaaaagacaaacaaaacgtgaaatttgacaagcgagggacagtccgagttctgacgaaacggctgcattcctcgagaggccggagaataattgggacgggcgtacgaggaccgtgtccaccaaaaaaaacccctccgcatcacgcccaagccagcggcttccccatccctcctctcctccagtcctcctgctacacttcgatctcccactaaccccatcacctcgcccagcccgaaccattcccacccctccaaacagacgatctcccgctgacgcgtgggccccacctctcctcgcccccacctgtcagtaaaagttacgcgggcgacgcgcggtaactctcgccgccaccccccgaacaggtctcctttaccaatggaacaatttaggttggaacacacactgggtctcggccaaaattttaaaagtctcgagctgaataaaaacactggtaaaaaaaaaaggagagagagaggagagacaggtcgcttcctgcttccattggagaagaggagaggagaggagaggagaccgagccggcggcggcggcgacgaggagagggagctgatcgggcggtccccccctttgccgaggggacgccggcggcctccgggttgggtccacttggcagcggtgagcggcggcgggggatggcggaggcgcggctgctgcggcggcggcggctgtgcttggcggtggcggtcgtgtgggtggtggcggtggccgtgagccgggtcggcgccaacacggagggttagtgtgatttttcatcgaattcagctccgtttttcggcggattacgcccacccctatttttggacttgctttcggattcgatgaatctattggtcatcgggtgattccgtttgggtactagtacatgttacctgcttctcggtacatatgggcgtggatggattgactcatttaaggggatggagcatacgcccaccgaccttccttttgtagactcgatggattatctaggctatagctctttgttttgctgcctctcatggtgtgttgtgaatttgctcccagcagggagatttgtccgaggtaggaaacgtttcttgagtaagtttggtaggtgtgatttgtatgtgcacagaaatgggatagcttttttttttagataatggaataaatcctgacagaaatgggattgctaatatctgggatgagtttggtgtgctattttggccactctgaatgaagaaaatggaactggcttcctcattaggttcgagtatggaaagaatattgcttgtgagttgtgaatcttctcttgtgaaaagagattttttttttaaaaaaaatctgaattactgactagtatagctaattggtttcttacggtaggagtatgtgttatagattgctcttcaataggtaagggccatcgttagtatcaagtttaagcttttcccgaacaggaaaaagggtcatcatcttttgttatcacctaaccaatttcacctctttaaaatgcccctcaacatgcttttcctgatatatccttggtagtaaccatgttctaagaaaatttggtgattttggcgttgtgatgtttatgacactagattgcaaaaggtgccttagctattgtaagttctagttagtgattatgactaagataagtgttctttctagttgtttcttatgcaattatttcagtctttttaagcaactttatgtgctatccttttccacatttaggtcttgttaatcgcaagtacctctgtagcatagatactaactaatgttcaaacactaatcttgagaaagattgggagttatgcagatagtattgtaagaaatgaaagtactgtatcttataccttcttgtactcaatatatgcttgcatactttagcctgaaaaggcgattgaatttgccaaaattttgacgagaagctactgtcactattgtctacttccttaaatactatgttgctgatgttgagggtatgttcgatgtcaggtgatgccctatatagtctgcgccaaagtctgaaagatgctaacaatgtgctgcagagttgggatcccactctggtcaatccatgcacatggttccatgtaacttgtaaccctgacaacagcgtgatcagagtgtaagtttttgacagaattatcatttttaggcttgtcaaaagtaagaaatgtgatcattttgtgtgttgactgatctattttcctttcgcagtgatcttggaaatgcacaactgtcaggtgcattggttccccagcttgggcagttgaaaaatctgcaatatctgtaagtttacacttccagtctttggagaattatgtttttagttacaccatgcagtagcgtatctattcaagttgtcataatatactgcattgaagcttggttttcaaaactcttggaatatggcttatccttgtggtaaagatggttgtgttgccaccttctttcttgcatttttattgtgaaatttaattatgttgtgactaattacagggagctttacagcaacaacataagtgggacaatacctaatgaactgggaaacttaactaacttggtcagtttggatctttacctgaacaacttcactggttttattccggaaaccttggggcaactctacaagctgcgtttcctgtaagtgtactccactttttttttattatgaatagaattataaattgtgtatatcattgaaggccttcctgtttgaatgatcataacataattctttatttgcatgtcttcttgtaaggatagtcgtcttaacaacaacagtctttctggttcaattccaaaatccttgaccaatatcactactcttcaagttctgtaagttccctttctgctaattcatatttggtgtctacctgtagaaattattgcttacatggtaatagactttaagatggatacatattaacaaaatgtccaataatttatgcagggatctctcaaataacaatctctcaggagaggttccgtctactggctccttttcactctttacccctataaggtgctttttctagatagaatttaggttcttagtgcttactacatcttgtgaggctgacaaatggttatttcattgtcgcagttttgctaataataaagatctttgtggcccgggtactacaaaaccctgccctggagctccacctttttctccaccacctcctttcaatcccccaacacctactgtgtcacaaggtgattctctatagttttaattctgttacatttgtgatactgcttgggatatgcatatgcataaatgatgcagacaggggatttgacatattcgggtggaattaattctattccatcaggtgactccaaaactggagcaattgctggaggtgttgctgcagctgctgcattgctgtttgcggttccggcaattggatttgcatggtggcggcggcgtaaacctgaagaacacttctttgatgtccctggttggtattatagttgcatactgcagttcatgatacttatgttatccatttaaataatctatattctcctttaaattcagctgaggaggatccggaagtgcaccttggccaacttaagagattctcactccgggagcttcaagttgctactgataactttagcaataagaatattctgggaagaggtggctttggaaaggtgtacaaaggtagactggcagatggctcgttggtagcagtgaaaagattaaaagaagaacgtacccctggtggtgagctccagttccaaacagaagttgaaatgattagcatggcggtgcataggaacctgcttcggctccgtggattttgcatgacgcctacagaacggttacttgtctatccctacatggctaatgggagtgtcgcatcacgattgcgaggtgccttaatcttccttactttttcttagagtaaatccattaatagtttcttacacgtttgtttgcatgcttaaacataaatggcacagctattatggttattgaaatcacttaagcactctttttaatttcatctactcacagcatatacctagttgtttcagttgacatatcacattgttcatttaaggttatgactaagactgtaataatgaatggttgagtgcatgccttctgcagagtccggaataaatatattccttcatctaaaaatgcacgcccataaattaattatttcagtttttgagtcgtggtatatgattttgtagagcggcagccaaatgatccgccgcttgaatggcaaacaagaactcggattgcgctgggatctgccagaggattgtcctacttgcacgaccattgtgatcccaagatcattcatcgtgatgtcaaagctgcaaatattctgttggatgaagattttgaggcagtcgtgggtgactttggactggccaaacttatggattacaaggacactcatgtaaccacagctgttcgtgggacgatcggacacattgctcctgagtacctctctactgggaagtcctctgagaagactgatgtttttggctatggaatcatgcttcttgagctcattacaggacaaagggcatttgatcttgctcgtcttgcaaacgatgatgatgtgatgttgctcgattgggtaagtaccaccacatctttatatattggggcaaccatggaagttttggttttgtttttccttgtgcatgctagttgtcctccaggacacatctttcttagctgtgtctcagttctagtccaggaattagaacaaatggttgaactattggcatgttggcagtgataaagcgagctggcagttcagtctccatgtgtcatcaattatggagatgcacgccatgacaaattggcagctagtttttcgccatttctgataccgagacatgatccatctgcacgcatgacttagcaaaattttgtactactacatttggaaactgacaggcaagtaactaaactggtttttgtcttttcaggtgaaagggctcctgaaagagaagaaggtggagatgctggtggacccggacctccagagcggcttcgtggagcatgaggtggagtcactcatccaggtggctctgctctgcacgcagggctccccgatggaccggcccaagatgtcggaggtggtgaggatgctggagggcgatggcctcgcggagcggtgggaggagtggcagaaggtggaggtggtccggcaggaggcggagctggccccccgccacaacgactggatcgtcgactcgacctacaatctccgggcaatggagctgtccggcccgaggtaaaagaaacgaaagacaaaatcacaaagcatccaacctttgctcgacggcttcctcgcccttgtttgtgtatatgacagacagatcgatagctggcaaatctggagggaaaaatggtttacttgtaaccctccctggtgcctcggtaattttcaagtaggctctgcacttggttgtcgttagaaatgcatggccgggcggaattgcaacacattgttgtggcggctctgcgtctgtaatggctgaacaactgatgcctctctctctgctgtattgtacgtacaactctctcttttgacggtgctaaacatcctaggcaatcttttttggtctcccgggtcacaccgtgtccgcctgtactttgttactcttcgttgaaaaactatactggtagcaaactcaactctttatctgaaaaaaacaaggtccatggcatatgcaacggctgatacggacgagctggtgtattgaggttgcaggctggatcaatgatcatgcagccgtgcaggttgcctgtgtgcgctctctcatggtgtcatgcatgcgagtgccagagtgccagaccatcaccagaaccgctacacataaacaaatccactgctgcctgacacggtgttcagccagcgtcccgttttttcggcattttctgcctcccgattagccatacaaaccgttagtgttctgcatcagagaacgccagaacggcctaaatattaggccataccaacaaaggaacaaaatgatcgacaaaagttcacgcccaggttaattacgtactctaccaaggacagccaaaagtgcaaaactataactagccaaaacaaaagtgcaaaagaaagggacgagagctagtgcagcaagcgtgctcgcgtagatgctggccggcagcctacctgcccacacgcgtgctagggcctaggagtacaaaatacaacgcggcattagaaaatcctctctctacctatccacccatcaacgtgtcggcgtcgcacgcacgggcgcacggccgcgcgacgcgaactcggctggctagagggtgggcacgcggaagaacctgccgcggcacatgcagcggtacgcgacggggcacgactccgcggcctcggcgcaccggaggctcaccatcacgcgccggcacggggagcacggcccgcacgcgtgcgtgcagtccggcagccgcgatcccgtcgccgcctccgccgcgttgcccatctccgtcgtcgtctcttcctccggctgtgcgccctgctgcacctggaacgtcgccgtctggccgccggtgcctctgtcgtcgtaggcggtggtggtgctcccgttcgcagcagcagcagatggagccgtgccgccgttgtgtaggccaccggctgaaccttgcacacctgctgcattacgtatacataaaaacgtagtacgtacataatgaacgaaatgtgggcacaagttaaatgcaggtgattcaggccgtgaagggacatgccacatgatgcatccgccgtacgacgtgccatctttactagtagtgcacactacacaggagtagcactaaaagcttactacatgaacacgtgtattcctagtcagattagtacgtactccagtgggaagctctggtgaattacctggtatcgtcctgacgccatcagcaacgcacgagctcatcacgaccactgcaaacgctagcgccatggcactaaacctcctcattgccgccggtgaatccgtcactaaagcaccaacgcgaagttggagcagctagctgatcagcacaagcacaagatcgatcgacacgccaagcagagagagcagtcagcgacagtgagcacgcaagcaaggagaggctcagcgcgaggcgaacgtatatatggccggctgccgacccgcgagcgctcgccgcgtgcgtgcgagaacgagcgcgcgatcataaataaaccccactgcggcggcatgcacgcgctggctcacaggatcctcgacgttggtggatccaccacacgcagcccgtgcgcggctgcgcgcgcgcgaggcccaaagagcggacacgaagaagacgacgagggaaggaggtagcgatgcgtgtgacgggcagcaatggcgaagccccgctgcggcgcccggtgcattatttatgcagcggcgcagggagacgctgttgttataattgcggcacctcggagaggagcaccgcaccggcgagagatcagctactacgcactatacgtcagaagaggccgacgtgggggttcccgtggagatgcattactgtacctgccgctgctactgtttctgaagaactgaaattctgatcgcgagctcaaaaaagttttgctgcctcgtgctttcgacgatgtgcaaaactgcaagtctgtagctctagtcagactgccccgtcaccgttctcatcaatgcgcgcctgcaaatccgttgttgcagttaagagatgtactccaataaatgaagctccaaggtttttgcccatggatatcagaattggattgattgttcgtgctttgcttcttcagtcagaagtattagcttcttcagtttagaatatgggatatgaactgaaactgaaactttctttgcttctaaaagaacagagcctaggagtattagctttcatgacctgatctgacctctttgtgtgatcttgtcatatgttttgggcctttggctttggtacaatctataggtagactggagttttgtactccatccggactgcgttttggagaagcagaggtactatcgtcatcatcctttgcatgagatttgggtcatggatgcatggagggtgagtttttgaatgaagaggcaggcatttctggcattgcctcctcttcaataatggggttcactgaaaggccgaggggaggcttgaatgcctctgctatctggacaattgtgctgctgaatccttattatgctgctttttgcagacctgaaatctgcactttcatgtaaaggaggacggaagaacagtatacagttctctgaactttgttggcccaaaggtgcaaaatcaggaagatttcaccccctcggtgtgatagcatgtaacggttcacccaatgaaatatatgtaagtatgtttttccagcgaagaaagtttaatagaggaagaggacgaaatcatgcggttttcctaaactttcagttgatgaaggattcctgtgttctgttttcattgattataaaacttttgcgtaatatgtcaagccggatccgtggcgcaatggtagcgcgtctgactccagatcagaaggttgcgtgttcgattcacgtcggtttcaataccccgaaccaagccgggattatttttttcacctgtgtacatttatatttaggctacccataatttgttgatgcctttccatgatagcagtttgtttgatcttttttttccctgtacaaaccccaatccaaatttgaattatgttttgcccagcacaatttatttagtctatccacaatttgttgttatcttttcatgacaacaatttgtcgatcatgttttgccgctgtacaatttatttaatgtatccacagtctgttgttgattattttttgccctgtacaatatatttaggtatccacagtttttgttgatatccggattatgttttgccctatacaatttatttaggatatccacaaatgttgatgtcttttcatgataacaacttttcatgacaacaatttgtcaatcatgttttgccgctgtacagtgtatttagtgtatccacaatctggtgttaattattttttgtccctgtacaatatattcagggtgttgacgtctttttatgatagcagtttgttgatcattttattttgcccatgtacaaacccctatccaaatccggattatgttttgccctgtacaatttatttaggatatccacaaatgttgatgtcctttcatgatatatataacttttcatgcatgacaacaatttcttgattattttttgccgctgtaaaatttatttagtgtatccacaatatgttgtttattatttttttgctcctatacaatctacgtaaggatttgttgaagtcttttcgactcatcatcctcaatttgttgatgtgtatgatcgtggtcaaaacaacctttcttttgttgttgcttatagggtgtgtttagttcacgctaaaattagaagtttggttgaaattgaaacgatgtgacgaaaaagttagaagtttgtgtgtgcagaaaaattttgatgtgatgaaaaagttggaagtttgaagaaaaagtttgtaactaaacttggccatagtcatttttgtctctatccttgttcatgaaagatgacatagatctgatgtgatacgtccaatctcttcccatcaactcttcccattttggctgaattcaaacatattttacaaaattcagaacttgtcccaaattttggaaataatagtcattcatttttttccaaaaaaatagttgattttttttgtaaatttttttgatttctacaatttgggacagcttttaaaattgtacaaagtgtttaaaatcagccacaagtttttcaaatttaaattcggtaaggttctccaagggtaaaaatcgtctttaatgtcatgaatgaattttgccaactaactttaagcgtgaaccatgtgagttgttgaggggaaaaaaaggtaagttcgatttgctactcttaaccatcgtaaatatctgatttattcccctaaactataataccagtggcggtgacctccttcccacaggttctccacctccaactcggtgtagcccatgccatagattgttgttagcttgatgtcgcaactctcctctctctgccgccatatcggcacaatagttctttactcagcaatacatcctctctctcgaaggtgacggaccaggtggacgatcccaacggcactattccttagcgagctcaatgataggggacctatgtgttcctctgccgcttgattgagagagaaatacataaagaaacaataaataagggaattccagcggaagaagaaatggcacttgtgtaatttactgactgaattgacacgtgtgtgtcacgtagaataaaaaaccactctcaactaagttgaggtaattccagtggcagagctaggcattttgtgaaccgctaccagacatattaaacagttaaaaaaacaaaaaaaattattatagaagtggactgttagtatgcctggtctcctgcattgatgcttaaacgctgcttaattcacataactaatttttccggcataaagtgcatgcacaaatagacgatatccaccgaacttgcatgcacgcaccagcaagaatcaagaacccatcttgctccactgaaatacattactagatgaggtgattaactgacactttgccaaaaaagcagcaaatcaacacacataaatcactcgaatctcaatggatcgcacgctgagcctaggcaactgcccacctagccgggcggtgaattcatcgctgggtaattcattcggtgtaagagcttagagggtgtaaaatatttggtattggagttgagagaggtaattcatccttttacgaaactagtgttgatgtttgctaagactactagactacgctagttttttctaaggaaaattaatggtaaaatacattgtgtttgactttttaaatcttggaggtgttactttaatcaataatttatggctaattttgctacaggacacttaaattttgtgtaatttgctaggatacatcgtaaaaatatttcatggctgaaagacatcaagtctagtaatttgctgaaggacagtttcaactcaattgaagtgagaaattcttcaaaaggacaagaatgccctagagagtcaaaaccttttgagctgaggctggagtgaagatgaaatacgatgtatgctagtgatgtacttgggatgatgacaaatttagagttgcataatttctaaattttcactctaacgtcatgtttaaagcatgtggtcttatatacattctcgtctttcttaagaatttatctctttaattgagccaaaaatggcctctagcaaaacaccagttttttaaggtgtctcttagacatgacacatttttcgatgtctatcagcaaattgcacgaattttaggtattctgtagcaaagtttgccataatttatactctctttatctcaaaacaagtctacgttcgtatatgaatctgaatatagcacatgtccagatttatatataaaagtgaacttatctcatatatgtagtattaaaataactttataaaatacaatacggttagatatttggtaaaatattagtacattcttaagtacaatattacatacgcctgagtatatactccctctgtccaattttaagtgtaaccatgagttttcgtgttcatctttaatcgtgtgtcttatttaaaaattttttataattagtattttttgttgttacgagaggataaaacatgaacagtactgtacttgtgacttatgtttttaaatgttttttaaaaatttttaaataagacagacgattaaaattggacgcgaaaaaacattgatgcactagaaaataggacggatggagtagtgccgtagagatttgccgttgcttctaatctctttcgcaacgtgttagtggtcgtacttaaggggggtgtgtgtggtttgcgagttgtataggtcttccatctaatcggagaaaaaagaaatgtgccttttttactatacaacgtccaatggtctgacactcttgactgtgtgacagtgtgtgcggcttccagctctcttggcaaatccttccaccattccacgcgattttctcggctcggcagtcggcacccgccatctcccgcgcggcagcgccccgcccgcccatgaacggtagtatatgctccgtgttctcctctccttccctcactctcactctcgatcgctagcccccgcgcgcgcgcgcgcgcgggagcaacggataccaattcgccaagctttttgctcttctttttgtttctcactgtgaccactgttaccgccagctcgacgccttcacaaatgggcggccaccgcgcggctggtgctcctcctcttagccgctgctgcggcggcggcggcggcggcggcggggcgcagggaggtggtgacctcgccgcacggcgccgtggcggcggacgacgggcggtgctcgaggatcgggcgcgacgcgctccgcgacggcggtaacgccgtggacgccgccgtcgccgcgtcgctctgcctcggcgtcgtcagcccggcgtccagcggggtcggcggcggcgccttcatgctcgtccggctcgccgacggcaccgccctcgcgtacgactcccgcgagaccgcccccctcgccgcctcccaggtcagcgcgattccgatcctcccaatcactcgcgtacggtagcgtacaatccggtgtagtcaaagccggcgacttcacttacgtttacgctattcaattacatatggttttctagataatgagttcaatcacatgattcccgactgattacgatgttctaaccactcaacacgatatttaaatggttctaaaccttcagcaatgctgactgaactgaagaattttatgatatcttattacttggatatatatttctctttatctgtcacaacttatcagtaaattaatcaactcgagagcagtcattttccaatccttgttaaaaagcacaagacttggccgaggtctccaggtcgtctgattgatctgtagaaaatgcatggagtaacaattagtcatgccaaatgttactgcttatgctaccactatccgtactagtccactaagccagtgggtagttggttgattcacatggtacttgttgcttcctgatttccttttcttttcctctcttttatgaaaaacgaatgcttctggacctgttctattctattctatcacaacaaattaaacagaaaacacagaaaagggcatgagttaattgacttagatgcacccccccccccctgatagctagcataattggggatttattagtcatgttgcttcagtggcggatgtgccatggagtgacgggaagaacaatgagcataacgagccatgtggctggaaacatatccttgtaggtgaagtctgtacatgccctagtggtgccatctactatgccggtccttgtcttggttcgcctctcatcctgttgaatgtgtctcacgctatcgtccactagccgtctgccccctacatttcgcaccattcatggctggtccagcccgaattctgggaaagccaaatggaatccgagttagggatagcgcctcatgcagcgatacaatcacgtcaatatcagttcgtgttgcttttgcgagggcatgtgcagcattgtagaagcgagaaatctgcctgccagtcgttgatcagtgagagaaaatacacaccaagctgttaactgatcaaacacatgccacgtattgccatgtatttttcagaaaacataattagaaaacgaaattgctaaatggcatttgacggaaaatcaaggggaatttcttacagattttgaaccacctgatttgcttgaagattcgtgcacccaaatccttctccagctccgatgaatccatccccagtatcagggaaactattttaacagctcgagtggatgtccacccgtttattgcatgtcatctaaatggttatgaaaaaaattaaaaaaatatgaataagatagatcaatatgtaatgtatcaatccacaaacatgcaagttaaaattcaacttttacagattgtaataaaaataacaaacaaaactcaaattactatatgtatatttacaattaaatttgttgtttttgttacaacttgtagaagttgaattttaacttgcatgtttgtggagtgatatattacatattgatctatcttgccaatttttttaaaaaattttcgtagccatttagttgacatgcaataaacgggtggacgtccactcgagctattagaatccatccccccagtatcagcgatgacccgcgacaagttagggttggatcctaggttgggatgggggtgggaaggggtatggggatgggaggcagcggcctgcggcttggcggttggtggtggacatgtgagggtggcgaggcaccaccggcggcggcaccgaagccgtggggatggaggaaggcgatgggccagctttggtgacggggcaaagcaaagtgaatgcttaggagagtggtaggtggtggcagattcggtggcagggagtcacgagagacaggaaagatggcggatgaggacacacctcatcactactggcttgaggaggagatcgtttggggaggcctcaccgaagccttctgggcttccagctaggtggcgatggcaacgaagggggtggggtggagttctagtcatgtgcgatggtggtggattgggaagagggagggttagggttggggagaacgacacgaatcttaaagtaattcaatggcctacaattcgaaagatttaggagagtgttggtcgcatggtttaagttaatctaaatgggttttaatggtaagcagaagaaaaaatgttttatatactcgccaagccttgaactaagtgtgtcaatttgagtattgaagtactacttagaaaacaaagcagaaaacaaagcaccaccctaacttttgttaggaaatataagagatatctaggagaacctaatcgtttaaaataaaaaaaaatgttgctctaatttgatccaaagaagactggaaccgaagtggcagaaaattaggagggtatatccacaagcaatcaagtatccatagtaaaaagaattgtcctaattaattttcttttactggtattatcatgctccattctaaacaaacagagttaacgctagaaatgtcaattgtgcattcaggatatgtatggtggcaacgaaacgctgaaagcaaggggagctctatccatagcagttccaggggaaattgcaggtctgtatgaggcatggaagcgccatggcaagcttccttggaagaggttagtgatgccagcagcaaagcttgcccgtgcattcagagtgtcaccttatctgaggaagcagatggaggcaaccagagatggaattctccaaaataagggaataagtggagtgtacacctcaaatggagatatccttaatgttggagatgtatgccgcaacattaggcttgcaagaacactggtggctgtcgcggagaaagggccggatgtgttctacaaaggcgcagttggtgatcagctggcgaaggatattcaggaagttggagggatcataacaatggaagatctgaagaaataccaagttaagatacgtcggccacttttagagaatgtattgggactgacagtattaagcatgcctcctccttcagctggtggtgctgggctaatgcttgtaagttttctttgtactaaattttgttcactgttctttggtagcttaagtttgttgatttcaggtagcaaatttaattagtagaatcaactctatcggataatagaacctttaaaaaaatcttaatcttttctgcactagtattatcattttatcttgatacccttgctcaacaaacaggttctgaatatccttactcagtatggcctccctgctggtttttctggctcacttgggatccatcgtctaattgagtccttgaagcattactttgcaataaggatgaaccttggcgaccctgagtttgtaaatgttaacgaagtcgtctctgatatgatgtcccctaaatttgctgctgacctgaagaaaaccatctatgataacatgacatttgaccctaaacactatggtggcaggtaaagcttctcttttgtgcacaaatatgtcttccttttcaagtagaactgtcagcaaagtcctattaaattcctgcatatactagtatactactattactggtgaactaatttagtaatctgcattattacaggtggaacatccttcaggaccatggaacaagccacctgtccatcgtcgacagcgagaggaacgccgtttcgatgaccaccactgtcaacgcgtactttggatccctgatcctgtctccgagcacaggcattttgctcaacaacgagatggacgacttctccatgccggcgaacacgtcggccaactctccgccgcctgcccccgccaatttcgttaggcctctgaaacggcctctctcctcgatgactccgacgataatactcaaggtgaccaccacctcgcgcaatggaaaataacacgaactctcaactctgaagaaagttcatttgaaatgtctgaaaagttcagtcttctgaagatggttttttttgttctgattggtttgtgctttatctgtcgtaggatggcaatctgaaggctgcggttggagctagtggtgggagcatgatccctgctggaaccatggaagtgctcctcaaccatttcgtcaagaacatggacccgttgtcctctgtcatggcgccaagagtgtatcaccaggtgatctgggcttaacgtctgccttttcttctcttcgtagaaattcttctttctgatgagctttggtttgattcttgccatggctgtttgccctctctggctggctgcagctgatcccgaacgtggtccagtacgagaactggacgacggtgaccggcgaccacttcgagctggacgccgcgacgagagccgacctgcggaggaaaggccacgtcttggagccgctcgccggagggaccatcagccagctcgtcgtggacgacgtcgagcgccacggcggtctgaccgccgtcagcgaccccaggaaaggcggcttcccggccggctattagaccggagtggctgagctatagctgcctagctttgatgcagcgatgattgcttgctgcgccattcatggacatatttgtacacgtcgttctgttctatgattctatcgaataaataatactccctcagcttataaaatgttttaactttgatcaaacttaaactgcttcaaatttaactactccatccgttttacaatgtaagtcattctattatttcctatattcatattgatgctaatgaatctagacatatatacctatctagattcattagtatcaatatgaatgtgaaaaatgctagaatgacttacattgtgaaacggaaaaaatagtttatagacaaatatagaaatatttataaacttggtcaaacttgaagcagtttgattttgattaaattcagaatattttataacttaaaacggatggagtaataactgcagtgaattttaaatttttgtttgaaattgttagcgatcatccgtgcaaaataagctactccagtactgttttgtggacacgtttgtcacgtgacacgtcacggtgcgtttgggatattgagatggcccagatatcccatgactactaaggcctggactggacgtggctaagtggttgctcctagtccgtggcctgtgggtttacggcccacttgaatcagaattggcctgcgccggatttggggtttggcacgtactgtttttttttcttttttttagacacactacaaacgcaacaaacgcagacactcaacttaaaaaaaataataataagcagtaaatacaagtattggtgttaagtctaagacttaaacctaggtgaactgatttccccataagaaacttaatcacttgagttatgttaaatttacaaacctcatgctcatagcaggaggaaggaaaaaaaatagcgaatcgtaggagataccacgcgtacatgcatgtgtgcggctgtcgtctgtgagactgtgacccgtgttgatcatggtcggcggcggcggcggcggcgtgccggcactggcaacgtcgagagccactgtgtcactggtcgccgatcgatggaaacgcatggctaggactcatgagaaaatcaagttatctcctgtgttatctaaaaaaaaaagagaaattcaagtttcaaatcctgcgtagaaggagcaaggaggagggcacggacgagacgagagtgagtgaccggagagcgccggcaggcgatcgatcggtgtggagcgttacttccgaagagtggcagctgctatcacaatccgtcgatggtggctcagttaggtacacaaggaagcactgatttgaacatttcatatacgcattgtttcgatccatgtcgactcacaccccactaattaatctattgctagtacaagctagtacttgacttcaacagctaccaaacatgccagttaatttacttgtgacgtatcgctgggaagttaatttttcatcagttctcacgccgggtcaaggctctccctatcggtctcagcgtgcctgtgttgtgtacgtgtcatggcaacgggcaatggaattcatgcaccaacccaaaatcgagagagcaagagagttacacgccgtttacctgctagctaaccaagactccgactcttctattagtacctacacatatggcagtgagactctctctagtaattacagtaagacacacttctcagaaaagaagtacagagcttgcccagagagaaagagagaggtgaagatggaatccatggtagcaggagacctcgtacaggcctacgtgttgaagaaagcctgcaaggagaagatgagggccgaaacaaacgccggcgaggcagcggcggcggcgatgacaggaaagaagacggcggtgggcggtggatcgtccgaaaagaagacggcgcctgaggttagcaagggagaacgccggggattctctgggctgatgatgatgaagaagaaggtgcacccgaagtaagctagcagatcgaactagctagctatcttcaaaccaccactgattgcagatttgcagggcttggtcatcactcgtcagtggcacatagttgttgctaggttgtttttgctctaaattaagcctgtaaaactgttctcgtgtttccttgtttcgctcttaaggagtgcaagtgtataattatggcaatacatgaaggcatgaaccagcaaatttcttggttactttgcaaaatgttgtggaatgttttagtaattttctcggagaaggaaaatgggttttaaggggctgttcaaattgatgtcatttttaatcataccattttttttctgacatagttgctaaaaatatctctacgtttagtttgttgccaaactttagtaaatacatagaaaatcttttggtaaaattttgataatattactaacttaccaaaattttagcaatatttattttagttacaatttgaatagaccctaaaaaatcttcaacacggaagatcctgacttctaaagaaggacatatcattagttacagttcacaagctaacaaaaattgcagcgtacgtgccggccattcagcaagctgcacaaagcttacgacaagccaagggacggtaacagcagcttacctaagtacctcgtgttacttaaagacacaaaacaaatattctagtaccctaaactcctaatctccttttcacctgagttctggaggatttcacgagcatcaaactgcattctgtatccggccgctcttcgtgctgtggtatactgtcctgtctgtgtaagcggacaaatagcactttgggccataagttgggctagctgtgccacgctactttatgggattctttatattgggcctaagtctccttgctaaagaaactatccaatttgattccctcaactataggttgagtctaattcatatccctcacctgcaaaatcaggtataacaacacctccaactattaaaacaagtgcaaaatgattacctcgataatattgatggtagttttcattgacgtgacacattgacatagtcttcatcctacgtgtcaattttacaagaaaaaaaaccatgggaccacatgtcagtcactagggaaaaaaattgcggtgccacttgttagccattcctcctctcttctctctcgtcccatgtaaatggaggggtgatggcgaggagtcatgcagaagtaggcctctaaagcaacggcggaggacagcaggttaacctagtctcaggatgaggagaagaagagcacgatgtggaggagggaagaggagcagcatcgctacgctcagtaaggaggtggcccgcacaaggaggaacaacggtggccatcctcgtcattgttgccaacctgccatcatcgctgctggcctcttcgttctctttcctcgtcagcctgtaagagaggagggtgtgaaggtagaggagagaggggaagagaggaaagagatggggtagcgctcacttacctagccaccgctagccagcactggcaggaggagcgcaacgtgatgatgttcgcaaggaggagcacgtgctaacggcagctactgtcctcttgcctcgagcctgggtggccgcctctgtgctattttcttgatttcgttgaagatttggtacgaaacatgaatgcccgattcattgatttgttgaagttttggcgtggttgcagatggcggtcctatccgtgctagtgcacgtgaacatgacgattgtgggagaggagtgggtcagggtatgtcagggtgcttacaagcactgcttttaggtggctccatagacacgtgcaccttgcactacaaaccgacccgcgtgcaggccagcaatgatgctcgagctcactgatattccatcagtgtgctcatgaaaatagataggagggtgtcctttgtgcgatgtcccaaccgaatcaattcaatggttagggtggtgacaagatctgggtgaacgaccgatctacaactctcatttaatctccaacattatctttgtggttttcgtcagccgctatgtcagcgaaattcgaccggtataaatgttatacggaggtactgtttttttatttgaggaagacaagaactatatatataacttgcaagctatggggataaataacggttgtgtatatttttgtcaactatagattaagcttatctttatctttaggctggtaatctaagtaaatttcttgttttcaattaagctatgattttataatacaaattaatttaacatgaaatgtttttaataactagttatagtttctttaaagtaaaggacgaaatgattttcattatcaaaagcaattcatcttgaccaacttccctcctgatatgcatactcgggcatatactataggaggaagggaaaaaaaacagggccggattttttttactccttttttcatgatgcatttttctttatccacgatcatcaagtgcgcggtgtgcatgctaattagctactactactaattattgtttca

SEQ ID NO: 19830 - DNA, 10785 bp, Oryza sativa
  unsure (1)..(10785): unsure at all n locations
nnnnnnnnnnnnnnnnnnnnnnnnnnnnnnnnnnnnnnnnnnnnnnnnnnnnnnnnnnnnnnnnnatgacgttgatagcagctgcgatgatctggatgaggggcgtgaacgccgtcgtgaacacaggccctctctgctccacgcaccatgacatcgccaagaacgctattcctgatccaactatcccctgcatttatattcatatcatactacaaaacgctataatgttgaatactatacagtttacgttactgacattagcatgatatctaggtatatcatgtgtatattatgtctgctacctgacgccagtaaatcaagtattccgttggaaagtaacgggtataggcttcccctactcgtcctccattcatatcgatcacaattactgtagcaattactactaactaattaaggtgtatatatcaattaaacgtaccacaaagagcacggtgatgatctgaagcttcgttgttaagatccatggggataagctaattctgtcgacggccaacgcgactgcagccatctgaaggaagctgagcaggaacatcagggcagtgcccgagtagagcgccgggtacttcttggcgatcctcgactgcaggatgaaccacagggaccagcaagctgaaccgcccagcagcgccaccgacccgatcgcccacctgtgcgcgccgccgccgctgccatgaccgacgactgccgccgttgcagaagaagaagatgatgacgatgatgatcgagcagcagcaggtcctagcttggtgagcgatggaccctggtagagagcgaggatcatcgctccgctgaatcctaacactgtgcctcccacttttgctatgccagctcctgtcttcaggtccactttctccagcctgcactagtactagcttagcttacatctttccgaggaagtgatttcatgcatgccacctaaatagttataatttttttaaaaaaattgtcatctatattgctaattttttttaaaaaaattaatatctattttgatgacatgcaaacaacgaaaggatgtctccttgaggaataaaaatccacatcccatctttcaaatatttcttcttctttagtactactcctaagtagttactccctccattccaaaatatcactctgtccaaatttatagtattaggatatgtctcatccggttctagattactatattctaaaacgagggagtagttaggttgttaattgcgtacccataaggcagtgctacaatgaaagtgaagatgggagtcatgttgatgaaggcgcaagcgaatgttgctgtggtgtactgcagccccaagaagaagagccattgggtaagggacgctctgcatgcaccattttattattattaattactatgtaattaatcaattcatttgttagagaaaagaatatatatcgatctttcaattcatcaagttaaaattgctagctactactagatatattatacatatatgaaaatgacttgcccgagcactgcactgaagaagagacacaccaagatttcagccgtaagctttggtcttgtcttcctgcatgcatatttggcacatacgtatcaaccaactagtaattaatacacatatatatggtactatacagctgctagctagcaatatatagtagtaccaatactaatcgattaacgcatatatacgaaattaaaacctatcaattaactgatatgcatcggactaaacgaataactgccatttatacaaaacacttatcctgagcacactcaagggaaccatagataggtaagtgaaatccaattcatgaaataatttaatccatggacggcaccattgtggtaaaggtcgtaattcaagtgaatcaaaaagaattaagtgtatatttacctctcccggaagtaggcgattggggcgaggaagagagtggcgatgagctgacggagcgtgatgaggacggtggagcgcatcccctcgttgaaggccatcttggtgagggtgttcatcaccgcgaacaccaccaccaccccaaccattgtcaacgttggcttccaactattacagctacccattaattcaggatctcttgaccataatcttctttttatctggctagagcttagctatacctatctgcaaatgtatatgtgtgcttgctaatgttgctttcgccttgctatatggcatcaagcatgctgctggtggcaacaatttatatgcatgcctggcctccaagtgacaatttgacaatattccgttccttgctttactacatatatcaacatatatcgcgcggtacgtacgtatttctgcattgctttaattatgtgcactcaattagaaggatgccaataagatattatagtattaattagccttactttcttacaccactcaagttgaacaacttatcatcttcatgcccaaaaatatttttttaagaaaaagatagaggaagaatttgttcatcagctttatatatgcattttctctttaaaaaaaaaagaaaagaagaatgagaaggttggatgcttggctggcatggaaaataggacaaggtacgcgtttagattacataacaaggagtaatatatgtatgtcaaagacagtagtaatgatgatgagattttcaggtattgtttggtgccacatactgtagtatagttagtattatatataaatcatatcttcaggttagtagtaatgatgatgagatcttcaggtctgttcttttctccttccttattagatcgatcatatctagctacctagtagtgattaattaatttgtcgtgcagttttaatttgatcacagggagagagatgctggctgcatatatatatatatatatttatcaaagctggcaacatgtataactttatagggattaaaaaacatttttattctgaaagaaaatgagatagatgctttaatttctttggtgcgtcatccgttgttggtcagcaaggtgactaggagggaagggggaaaaaggttaaagctgacttatagtatatgccccaacaaggaaaagaatgatcattaaaaaaacaaacattaagatggaacaaatatatatagcaattaaactatataaatcagataccatgcatagctgggcctctcctctcagctagagcatccgatgctccattgaatactagtagaacattcaatgcacgtacgcatgaaggaattgatccgatgtgtcatttttgccggatggaacacatgggctggccgggcgaccaatttatgttactaacaattaagtttttctaaggatggcacgtcattgtataaggagatactaacacaattatgttactttagtcttcttcagggcatcttaattaattactctaaatattattttcttccgctggaattcttccgtttgcaagcgaaagcaaccgtgtcacacgctgtcacttcgtaccggccatactcatactcatatagtcatattataagcatcacatatgcagtaatgctctttttttataatggaataacattttgatatttgtttaatgagttactacccattattataaagtttacgcataaataaatccaacgcacactgacgtgatattagtgaagtagtgcattaatatgctgatttttatgcccccccccctacgtcatataatatatgctaaccgaccaggcatcatatcagaaacagtaaaaattcaacctttgtgtacgtgcgctgaatatattatttcctctgcttttgcttgctccttttattttccaggaacaatactgtatgatgcttcattaattaagcgtattaatattcattttattttatgatacaagaaaatataattgattttatttatatgaaatgaaactttgcacgatcgatccgtcaaaagatataggaaagggagaaaacattgcacgatggccgtgtttagattcaaaattgttttttcaaacttccaatttttccgtcacatcaaatgcttggagcattaaatatggacgaaaaaaaccaattgcacagtttacatgtaaatcgcgagacgaatcttttgagcctaattatgccatgattttgataatatgatgctacagtaaatatttgttaatgacagattaattaggcttaataaattgtctcgcattttacaggcggaatctataatttattttgttattagtctacgtttaatacttcaaatgtgtgtccgtatactttacaataaatttagcacacaaactaaacatagcctatgtaagatttcgatcgaagtggaaggtactgagatatgctggtagccgacactgacaattaatggtttgcaaagcaaaggcattcgatccttgacgttctatgtctctcttgatcgagttaattcgataaatttcaaatcttttttttcccttttgtatgcgggccttgtaatcatcgtatgaatatttttcaattgtttggaatcaaacgatggatggatggagagtatatgtacttctagctagccctttattttagttttccccttaatttcgcaaaaaaaaaaaaggcagagaagaggaagaagaacaagtatatattccatttgtctaaatatttaacgttacgaggaacatataataaaacttccagaactttgacatcaataattctcaaatattcaagttctttttaaaaagtgatatatgtatatttggcttaatattttaaacatattatattttataaagttaataataaaaagtaatagttggagcaattgaatcttattttaaattatatatatttataatcaaatcatatcttatactaaacgtcaaatgttagttaaatactgcatgcaattaatccgtgcgtatatgcataagttagctcatatatatatatatatatatatatatatatatatatatatatatatatatatatagtgaaagagcatgtagtctagtggttgtagtgatctgagtaacaccctgtttcataagttcaaatctttggctaagttccatgtttaataggttaaattcctactccctccatttcataatataagagagataattggtgaatgtgatcacatcctagtgtaagggagtaatttaaaatggctgcataatatatccggttggatataaaggccgaaaaaaaaaacccttccaaaaaaatagttatatataggaggatactgtatcactggagtatgcacgtacgtatgcagtgcactgtttgactgacgtactataaggtaggaggactaacgaatattgatcttcatcgaccattcttcttatcagtattcgttcgttcgttcatttatttgtcatcgatgatatgatccatccatcattccatcttcaaccgattcaattctcatcttccctttcacaaaagaaaccgaccgacagacagagaataactagtccacgtctctgcatagtgtatactcctgctcccgtggatctgatcttcttcctcaatcgtcaattcgtcagcatactgctcgcttactatatatgacgaatcattctgcccggggtttgataaaataaatctacatcctattattaattcaagatctacagattattaaattttagcatattttgttttaacaaaaagtagcacattgtgtgtacattaaaggaaattatatcattttctagatatttttttaatttctacataaatttattatagcttttgatcccacggtgtcctttttccttcctaaatagtaggaagttggtggtggggttgtaagatcaaaaaaaaaccgagcttaccatagggaggtgaaaagtgataacattagcagaagtcaaataaccaaacttcgatagataaaaaactcaccccaaccttaaaaaccaaaagatcaaactttgacactctaaccggatctgtacgggtggctaatcgggcttagaactggtttgactgaagtacaattactagttcgatcgtcagattaaaaagaaccttacatcacttgtgtaaaatcttgttttctctaaaaccagccattagatcgagctctaatcttgacaggaaactaagagacaaatctatcgaagggtcatgcaaaagtaataaacggtttaagagaaaacatctcaaaagctagacgtctcagaaatttcatcaaatatgaataaaacataaattttaagcaaattcgagtcaagcaaataccaatgaaaccttttagatctgatctataatataatagaaatgtttcgggtggattaacttgaacaaaaccataacaaaactaagaatcacaaattaatgccaaaaacgaaaaaaataaagattacaaaaccagaaaagatcgttgacgccttgttgattgaatatgatatttctttttcaagtagtattcataagacggtcattgcacctctcacgaatttctcacataaccctaacacaaagagtagtaaactctttaatctctcaattgtggcttaccctcaatgcatagcctcccttattcacatctaattacaaaatcaaactaaactccaactctcttgaacttggactccaatccaaattcaacttatccatacgcacacaattccccttgtcacctccatgtgcattattctctagccttggtatccacatgatctccttgatcttctagaactcaacttctaccaagtctagtcttgatccatcatcggcaatactctcgtgacctcaagcaacagctacacgttaacaaacaaagaaaccatatttgagcacaagatcttccccaatttgactcacatatatctcacgtatagaaaccatctaaaagtcataaacatttagcaatcaacatattcgatagaatcaacccaaaactgattcatcaggagtttgccggtctaagtgctccctcccatggcagtcagatcgctggccccatggtggtgagaccactcttgccatgaaacttcgccaaattcaacatcacttcacaaacatcagctcaatcacttttttatcactcttaataattctttatcaccagaatcaaatcaacaccttaatttaataagggtggtgataaattcaccactcaccaccaccgctactctcttttaaaaagagttagaatagattactaattctctgcagttgtgatagttcaatccagttgaccaactataagatgtttttgattaattggggagtttcttttcagagatcccaactagtatacaaacaatatgagaagggctacaatgttttccaaaaataaaaaaaacacaaatcgcaacgcacaagggtcaattactcttttagacggtgcccatatagaaagcccaccgggcttgctttcaaccgtcatgtgggctaatgttggatttaagtatcaggctttaatgtttgatgttaatcacatggcaaatcggtgatgcaagtgtagctcaactggttatgtttttcttgtggtggaatcaacccacctgagttttagtcctatacttaacatcgatgctcatatttacatctaattattctttcgatggtaggtggctgtcggtgacacgggaccaggagtaccatgactagaggcttgaggcagacataatcgcccacgtggcctggcaccctcgggggacgtcgggcccgagggtgacgtgttcgccctcctcttagtctccccaagggggtcgggccactcccgcctcggccccgagggccgaagcgccccgacccctcgtggtttctcctccgcgtgtatgggttaggtgagcacagcggggctcacctaaccgcatttattgcggtttggttgaacctgtcatgccgcatgtaacgcagtgcagtgcgctcgtttatccggtctgtgacaggtcacagaccggtcagatcgcggtcaggtcgcgacaggcggtctgacgcacgcctcgccccatcccgtcaggacgagggcttctaggcgctcgttcccagacggagctagcgtgttacctcttagagatggcacgttagtcccggttagatatatgccaggcttcattctaaccattacagacaagatgttgtgtgaagaagggcaaacatgcatattgctaagctgacgcgtggtggacaagaatgaccgatttgtgaccagtctgacactgatcatgtcgtcagcagacagccacgtttcccacgtcgcacctgcctccggcggaagtggaggtaggtatgtgccgtcccatcagaagatcattcggacagcaatgatacaaatctccgtccatttatgaagagagggcaagtccagtttggaaagggagagagggtgcatgtggtatccccttaagatataaaaggaggaccttgcccactaagagagagggacgggactctggtagattgagaacggagagcaacggagactctggttcatactttgtagctccttcatacacagatccaccaaaaacacaggagtagggtcttacgcatttcagcggcccgaacctgtatacatcgcctgtgcctcgtgtgctctttcgactctcgcgaacattgtacacacagagagcttaggatttcaccctgagcccccggtcgaaccggcaaaggggggcctgcgcggtctcccggtgaggagccccgcgctccgtcagtggcatacctattgacaacgaagtgcccgtgtggtgatcgacaccttcattaatctcaagatatgttggtctaatattttaggggtgttaatagggatagggtgtgcgtgagttttttcgaggtgttcatatggatatataatgtgtatatgtgttcctatagggtgagtgtgtgcgcattgtgagtacttgtatttgtactgtgtttaaaaagaatcatattttagaggtgttcgtaggaataggatgtggtgaatcttttagaggtattcttagccatatggtgtacttgtgtgcccgtggtgatgggcacctttgtcgatctaaagatatattgattcagtctgttggtaaaatgggaactgtaatacccatttacctggtaaaagcattattatcaaataaatagtatgctcagaatgtccttaaaaataaaaaaggaaaccctagggtggcgtagctaggggcccactccggagggccccaggcccacctaaaatttcatacatggggttcactccggctgaggaggaatattgagtgtatggcccaaaactctgagtatcaaagcagcttggggcctagcttgggtcccaagcataccctaaagtatataccttaagaatgtaacctaaggtctgcccggggcccgatcccattccgggccctaggctcaccctagtcctcgcaggttctacggttcccggcaagaggagtgtaaaacatgcaagacctatatgccttaagaggataaactatggtctgcctcgggcccggccaagtcctgggcctcaggctcaccttaatccttacaagtcacgcattactcaaggaagaggggtgacggggcttgccaagcataaaggcgtaaaccaaggtgtgcttcgggccccgagctcaacttggaccttgtatagcttgcgttcctctgcttagagggttgtccaaaggtacaagacgcacaatcttaagatattcttccatcaacaacgccttcgagaagctcctcacggaataattaaccttctttaagtgcgacagggcgcgatctcagaaacttccaggaagttggccgtgctccacagccaactataaggtagcacgccccgccataaatgaaacaggtttatggggggattcccgaccagtctgagttgaaaggacgtagacaagacgccagagctaagtcactttggacggtggcgcctgggacacgcgtcgcacatgccccatgccacttcatttagccaaatagacagataagtactgtggccttgtttcgggcaagtcgggcctcgtcgagcccaccacgcaccacgtggtgagcacactggcgaaagctcaactatttcagacgaagcccgggagcccggggtaatatgaactgtaagacttgaacggtttcttggggctgcgttatgacaccggctggcaatgacaagacggttgatgagacaagactaagagtagatttgtaataatgtgagcccctctttggactataaaaggaaggggactagatacagatgaagggttggattcttctaggccaaatctattgctttgtagccgaagaaggcctccttcgtacttagttgatctagagaaaaagaacgaacaccaacacagaagtaaggtattacatcttcgaatggcctgaacctatataacctcctgcctcctcctcgcggggtggtcagaccccatgaatccaccgcgatcgcagataccatgaaccgtacgccgactaaccccctggccaaatcttcactcagggagagaggtctccactccccgctgtctgagggaccacaccctccgacacattcttttgaaggtgttcatgtagatatttagtgtgcgtgcgttcatatgagatgaatgcgtatgcatgttgtgggcaattattatttgtcctgtgcttaaaaaaaatcatatggcagattgtgttgctagttccgttgaaaacgagagacaaaatcatgctaccaatttgatttgtgatcttccgatctgcttcgcgaatggcaaactactagtactccacttcagtacaaccaatcgacggttcggccataaatgccactgccttcagctgtccnnnnnnnnnnnnnnnnnnnnnnnnnnnnnnnnnnnnnnnnnnnnnnnnnnnnnnnnnnnnnnnnnnnnnnn

SEQ ID NO: 19831 - DNA, 1960 bp, Oryza sativa
gccccgtggtgctggtgacgggctgctcggagggcgggatcgggcacgcgatggcgcgggcgttcgcggcggccgggtgcgccgtcgtggccacggcgcggtcgcgcgcctccatgcgcgggctggagggggacccgcggtacctgctgctggagctcgacgtgcgctccgacgagagcgcgcgcgctgccgtggccgacgccgtccgggagctcggccgcgtcgacgtgctcgtcaacaacgccggggtccacctcgtcgcgccgctcgccgaggtgcccatggaagagttccagcaggtgttcgacaccaatgtctatggtaggggtggaaatttttgctcccttttttttcttctttgttttaattgctgtctctcgtgcttgctggtatttggtgattgcgatgttctcgaagaagacgggattttagatcctgcgatcaggtggtccattaagtatgattagtaggcaattaaaatgtttgttcttgtatctatcgattggttgagtagtacaacggcagaaaagttgcaaatttaggattactttgtcaagacattttatcctgttagtgccagtactaatttaggaaaagtatgtaaaatcttctgtagtcacttgcagcactggattacttataagtttgcaactaggaaccctatgttagcaaggagatgcgttaatatttagtagatcacactgagctggttctagttgtgcaccacaatgaaaatccaaccaaaagaatagcttggtggcatgatatgtttagtaacatggggtttcattggcgaaattgcagtaccaatagttgaaagatgtattatacacttgcacactctaacactagtcagatcagtgctcccagggcacgcttcctgtcagttgcacaaattgacagtcaaagtgcagtgacgatgctgcgatgatgttgattgggaagcaactggaatgtggaattgactcattctctcattggatctgacaaattattttgtcccattaagtgtatgattcacaatagctcttaaaccaatgtaaaggtatttgaaaggagcatagcctgttaacctacaattaggctttccacgctgtttcatacgctgataaatagtcttcaaccggacgtaaatatatgtaattccaatgtaaaaatgtatgctggttgaactgctgagttattgtttcataatgctagaatgatgatggaggcgcaggggggaatagttatcaattaggctttccacattgtttcataatgcttgaatggttcatggcttcatgcttgtgcaacagcttgtttgagattacttacattgggcctgcacttatgaaaatgtctaaatgactgtcttttcatctacaggagcaatgaggctgattcatgctgttattccccaaatgatagaaagggaacaaggtacaatagtgaatgttggaagtataacagctttggctcctggaccatgggctggtgtatattcagcatcaaaagccgctcttcatgcattgagcgatacgctaaggtctgtacattcaaggagcactctatactatgctggtattattatgccacattgtttttctctccgtattactgctggtttatcactactctgagaacttgctaaattgtttgatcgtgcaacaaaatgcttttcaacagaagctataataagaaataaaaatgaataacgatacaatagtgtgagactattcgaaattcccatttgtttgttttccatgtcatcttcttgtatattcagttcttttcgacttgcaccgcatgatctgtggcttttgacgctgaaattatttttcacttttgacactgtcagttgacacgacagtttttatcactgcagactggagctaaaaagtttcggaattaatgttatgattgttgcacctggagggtcaaagtcgaatctgggaagtaactctacatccaagtatgt

SEQ ID NO: 19832 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnnnnnnnnnctatcatagctcaaccaaatgatttgtttgtttttttctcttactagaaaaaatgcctgtgcgttgcaatgagtaaatacgttttttcaatgatatattaagagctgagcaacaaattgaaatattgagatcgctatacattataattgaaaaagttaatgaaaattctaatattgggatcgctatatattataattaaaaaaagttaatgaaaatctttcttgggttttggggcgaaagcattccttacttttcagccctaggccagtccgctacctccctctatttagcttgcttgtttcgacccagtcacgagtgaagccgtttttagccctaggtcggtccgctacctccttcgtttggcctgcttccttcgacccatcaaatccggacgaatcttcctcaatcacccaaaattggttgagggttttttatccggccactcacctttttccgttttacccaaaatcagagcataaaactcgggataaaaataatcgggaaagatcgccgtcatcatcggcaaccgttagattaaatccgacaaaataaagcgaggaaaatcatagagagaatgatgagggaggagtaggaatcgatttttttatttgcaatcaaattggagggaaaacgcacgatcgatatggcgctagcgcgtcgccagggttcaacttggtacacgggccg

SEQ ID NO: 19833 - DNA, 786 bp, Oryza sativa
tttaatatatatattttttcatcgatttttgtatatatttacatgcctttgaaatatatttacataaatatacactctccgcgggatagaaacgagccaccgcaccgtcgacgtcacgcggcacaaaaggcgcaggatcgatgggaggggcggtggtgcggcacccacacgcgtgaccgcatgtgtgtaacatggatggattaggtattaataatacaatatatttacaacaaactattatataaatagattattagattgattatcgatgatattttaattaaacttcctcttcagagaaagaaactactatttgtttcaaagggacctagcccataagaaaatgaggcccaacccaacccaactcaaaccggcgaatctctgcgcgcggcccgatataaaagggctcgcaacatacagcacccaccatcccctaacccctgaccacccccccgcctccgcacccgcctgcggttgcctcctcccctctcgggcgggcggcggcagcaacggcggcagagtcagcagacctcgccgggaaagctatagccctaaagctcgcggaagcgttaatctcaaccggcgatggcggcggcggagcagaagcggaagaagccgaggaccgacggcgcggagaccgagcccgtcgacgccgccctgctgcagtccatcgagaagctccaggagatccaggacgagatcgagaaggtgagtcggcgttggatcctctagcacggcgtggttgctgctgctcgggcgtttgtatttttttttagggggctgggg

SEQ ID NO: 19834 - DNA, 633 bp, Oryza sativa
cgtacaagaaaacgtaaaatggtgcaccgtagagtactgaagccataggcgtcaagccggaggaatctggtcgcgccatcaagaccggagcgtatgtgaatatgtgaccccactcttgacacatggcctgtcagcctctagccaaagccccgcgattagagcatctctaacggtatagctatctcactctttaaactaaaatttgataattttgaaaaaaaaacgagctccaacagactagctatcccactatcccactttccaagctatatggctggccaaataacctccctggccagccaaaacaggctctccaacggtgggattgtaggacccacgttctctctatctgtatcagcgatggtggacaacggcgacgacaacgacgcggctgccatccatgcgcgcatcctctcctatgcgaggcggcgttgcagccgccgacctccgctcgccgcgccccgcctactccgctcgcagcgacagccggcgccactccctcctacctccgcccccatcccaatgcccgacgagccgccttcaggctgctgccgcgccgacgccgccctctgcgccgcctccgccgcgcgccgccccaccgcgcagctcctcgccgccggcctccgctcgccg
